(12) United States Patent
Domenyuk et al.

(10) Patent No.: US 10,731,166 B2
(45) Date of Patent: Aug. 4, 2020

(54) OLIGONUCLEOTIDE PROBES AND USES THEREOF

(71) Applicant: Caris Science, Inc., Irving, TX (US)

(72) Inventors: Valeriy Domenyuk, Phoenix, AZ (US); Tassilo Hornung, Phoenix, AZ (US); Heather O'Neill, Mesa, AZ (US); Mark Miglarese, Phoenix, AZ (US); David Spetzler, Paradise Valley, AZ (US)

(73) Assignee: Caris Science, Inc., Irving, TX (US)

( * ) Notice: Subject to any disclaimer, the term of this patent is extended or adjusted under 35 U.S.C. 154(b) by 0 days.

(21) Appl. No.: 16/084,504

(22) PCT Filed: Mar. 18, 2017

(86) PCT No.: PCT/US2017/023108
§ 371 (c)(1),
(2) Date: Sep. 12, 2018

(87) PCT Pub. No.: WO2017/161357
PCT Pub. Date: Sep. 21, 2017

(65) Prior Publication Data
US 2019/0078093 A1 Mar. 14, 2019

Related U.S. Application Data

(60) Provisional application No. 62/472,953, filed on Mar. 17, 2017, provisional application No. 62/457,691, filed on Feb. 10, 2017, provisional application No. 62/432,561, filed on Dec. 9, 2016, provisional application No. 62/420,497, filed on Nov. 10, 2016, provisional application No. 62/413,361, filed on Oct. 26, 2016, provisional application No. 62/310,665, filed on Mar. 18, 2016.

(51) Int. Cl.
*C12N 15/115* (2010.01)
*C12N 15/10* (2006.01)
*C12Q 1/6883* (2018.01)
*C12Q 1/6886* (2018.01)

(52) U.S. Cl.
CPC ............ *C12N 15/115* (2013.01); *C12N 15/10* (2013.01); *C12Q 1/6883* (2013.01); *C12Q 1/6886* (2013.01); *C12N 2310/16* (2013.01); *C12N 2330/31* (2013.01); *C12Q 2600/106* (2013.01); *C12Q 2600/156* (2013.01); *C12Q 2600/158* (2013.01)

(58) Field of Classification Search
CPC ........................... C12N 15/115; C12Q 1/6883
See application file for complete search history.

(56) References Cited

U.S. PATENT DOCUMENTS

| | | |
|---|---|---|
| 3,687,808 A | 8/1972 | Merigan et al. |
| 4,016,043 A | 4/1977 | Schuurs et al. |
| 4,018,653 A | 4/1977 | Mennen |
| 4,275,149 A | 6/1981 | Litman et al. |
| 4,376,110 A | 3/1983 | David et al. |
| 4,424,279 A | 1/1984 | Bohn et al. |
| 4,469,863 A | 9/1984 | Ts'o et al. |
| 4,476,301 A | 10/1984 | Imbach et al. |
| 4,486,530 A | 12/1984 | David et al. |
| 4,551,435 A | 11/1985 | Liberti et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,737,456 A | 4/1988 | Weng et al. |
| 4,762,779 A | 8/1988 | Snitman et al. |
| 4,789,737 A | 12/1988 | Miyoshi et al. |
| 4,795,698 A | 1/1989 | Owen et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Dinh et al. |
| 4,876,335 A | 10/1989 | Yamane et al. |
| 4,904,582 A | 2/1990 | Tullis |
| 4,925,788 A | 5/1990 | Liberti |
| 4,948,882 A | 8/1990 | Ruth |
| 4,958,013 A | 9/1990 | Letsinger |
| 5,013,830 A | 5/1991 | Ohtsuka et al. |
| 5,023,243 A | 6/1991 | Tullis |
| 5,034,506 A | 7/1991 | Summerton et al. |
| 5,082,830 A | 1/1992 | Brakel et al. |
| 5,108,933 A | 4/1992 | Liberti et al. |
| 5,109,124 A | 4/1992 | Ramachandran et al. |
| 5,112,963 A | 5/1992 | Pieles et al. |
| 5,118,802 A | 6/1992 | Smith et al. |

(Continued)

FOREIGN PATENT DOCUMENTS

| | | |
|---|---|---|
| CN | 104498500 | 4/2015 |
| EP | 0527905 | 2/1993 |

(Continued)

OTHER PUBLICATIONS

U.S. Pat. No. 5,756,703, dated Apr. 5, 1982, Horumeru.
U.S. Appl. No. 07/536,428, filed Jun. 11, 1990, Gold, et al.
U.S. Appl. No. 10/729,581, filed Dec. 3, 2003, Keefe, et al.
U.S. Appl. No. 10/873,856, filed Jun. 21, 2004, Keefe, et al.
U.S. Appl. No. 16/304,389, filed Nov. 26, 2018, Domenyuk, et al.
U.S. Appl. No. 60/430,761, filed Dec. 3, 2002, Keefe, et al.
U.S. Appl. No. 60/487,474, filed Jul. 15, 2003, Keefe, et al.
U.S. Appl. No. 60/517,039, filed Nov. 4, 2003, Keefe, et al.
U.S. Appl. No. 62/310,665, filed Mar. 18, 2016, Domenyuk, et al.
U.S. Appl. No. 62/341,617, filed May 25, 2016, Domenyuk, et al.

(Continued)

*Primary Examiner* — Brian Whiteman
(74) *Attorney, Agent, or Firm* — Fish & Richardson P.C.

(57) ABSTRACT

Methods and compositions are provided to identify oligonucleotides that bind targets of interest. The targets include tissues, cells, circulating biomarkers such as microvesicles, including those derived from various diseases. The oligonucleotides can be used in diagnostic and therapeutic applications.

21 Claims, 100 Drawing Sheets
Specification includes a Sequence Listing.

(56) References Cited

U.S. PATENT DOCUMENTS

| | | |
|---|---|---|
| 5,130,302 A | 7/1992 | Spielvogel et al. |
| 5,134,066 A | 7/1992 | Rogers et al. |
| 5,138,045 A | 8/1992 | Cook et al. |
| 5,149,797 A | 9/1992 | Pederson et al. |
| 5,158,871 A | 10/1992 | Rossomando et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,185,444 A | 2/1993 | Summerton et al. |
| 5,186,827 A | 2/1993 | Liberti et al. |
| 5,188,897 A | 2/1993 | Suhadolnik et al. |
| 5,200,084 A | 4/1993 | Liberti et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,220,007 A | 6/1993 | Pederson et al. |
| 5,235,033 A | 8/1993 | Summerton et al. |
| 5,245,022 A | 9/1993 | Weis et al. |
| 5,254,469 A | 10/1993 | Warren, III et al. |
| 5,256,775 A | 10/1993 | Froehler |
| 5,258,506 A | 11/1993 | Urdea et al. |
| 5,262,536 A | 11/1993 | Hobbs, Jr. |
| 5,264,423 A | 11/1993 | Cohen et al. |
| 5,264,562 A | 11/1993 | Matteucci |
| 5,264,564 A | 11/1993 | Matteucci |
| 5,270,163 A | 12/1993 | Gold et al. |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,321,131 A | 6/1994 | Agrawal et al. |
| 5,366,878 A | 11/1994 | Pederson et al. |
| 5,367,066 A | 11/1994 | Urdea et al. |
| 5,371,241 A | 12/1994 | Brush |
| 5,376,252 A | 12/1994 | Eksrom et al. |
| 5,391,723 A | 2/1995 | Priest |
| 5,399,676 A | 3/1995 | Froehler |
| 5,403,711 A | 4/1995 | Walder et al. |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,470,967 A | 11/1995 | Huie et al. |
| 5,475,096 A | 12/1995 | Gold et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,491,133 A | 2/1996 | Walder et al. |
| 5,496,938 A | 3/1996 | Gold et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van Ness et al. |
| 5,519,126 A | 5/1996 | Hecht |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,552 A | 10/1996 | Magda et al. |
| 5,567,588 A | 10/1996 | Gold et al. |
| 5,567,810 A | 10/1996 | Weis et al. |
| 5,571,799 A | 11/1996 | Tkachuk et al. |
| 5,574,142 A | 11/1996 | Meyer, Jr. et al. |
| 5,578,717 A | 11/1996 | Urdea et al. |
| 5,578,718 A | 11/1996 | Cook et al. |
| 5,580,731 A | 12/1996 | Chang et al. |
| 5,580,737 A | 12/1996 | Polinsky et al. |
| 5,585,481 A | 12/1996 | Arnold, Jr. et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,599,923 A | 2/1997 | Sessler et al. |
| 5,599,928 A | 2/1997 | Hemmi et al. |
| 5,602,240 A | 2/1997 | Mesmaeker et al. |
| 5,608,046 A | 3/1997 | Cook et al. |
| 5,610,289 A | 3/1997 | Cook et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,633,360 A | 5/1997 | Bischofberger et al. |
| 5,637,459 A | 6/1997 | Burke et al. |
| 5,648,214 A | 7/1997 | Nieuwlandt et al. |
| 5,652,355 A | 7/1997 | Metelev et al. |
| 5,652,356 A | 7/1997 | Agrawal et al. |
| 5,660,985 A | 8/1997 | Pieken et al. |
| 5,663,312 A | 9/1997 | Chaturvedula et al. |
| 5,672,695 A | 9/1997 | Eckstein et al. |
| 5,677,437 A | 10/1997 | Teng et al. |
| 5,677,439 A | 10/1997 | Weis et al. |
| 5,681,941 A | 10/1997 | Cook et al. |
| 5,683,867 A | 11/1997 | Biesecker et al. |
| 5,688,941 A | 11/1997 | Cook et al. |
| 5,698,687 A | 12/1997 | Eckstein et al. |
| 5,700,922 A | 12/1997 | Cook |
| 5,705,337 A | 1/1998 | Gold et al. |
| 5,707,796 A | 1/1998 | Gold et al. |
| 5,714,331 A | 2/1998 | Buchardt et al. |
| 5,719,262 A | 2/1998 | Buchardt et al. |
| 5,736,330 A | 4/1998 | Fulton |
| 5,750,692 A | 5/1998 | Cook et al. |
| 5,763,177 A | 6/1998 | Gold et al. |
| 5,817,635 A | 10/1998 | Eckstein et al. |
| 5,858,731 A | 1/1999 | Sorge et al. |
| 5,861,254 A | 1/1999 | Schneider et al. |
| 5,958,691 A | 9/1999 | Pieken et al. |
| 6,011,020 A | 1/2000 | Gold et al. |
| 6,051,698 A | 4/2000 | Janjic et al. |
| 6,057,107 A | 5/2000 | Fulton |
| 6,329,209 B1 | 12/2001 | Wagner et al. |
| 6,365,418 B1 | 4/2002 | Wagner et al. |
| 6,406,921 B1 | 6/2002 | Wagner et al. |
| 6,408,878 B2 | 6/2002 | Unger et al. |
| 6,475,808 B1 | 11/2002 | Wagner et al. |
| 6,475,809 B1 | 11/2002 | Wagner et al. |
| 6,599,331 B2 | 7/2003 | Chandler et al. |
| 6,623,526 B1 | 9/2003 | Lloyd |
| 6,645,432 B1 | 11/2003 | Anderson et al. |
| 6,719,868 B1 | 4/2004 | Schueller et al. |
| 6,773,812 B2 | 8/2004 | Chandler et al. |
| 6,793,753 B2 | 9/2004 | Unger et al. |
| 6,899,137 B2 | 5/2005 | Unger et al. |
| 6,929,030 B2 | 8/2005 | Unger et al. |
| 7,040,338 B2 | 5/2006 | Unger et al. |
| 7,118,661 B2 | 10/2006 | Surh et al. |

(56) References Cited

U.S. PATENT DOCUMENTS

| | | |
|---|---|---|
| 7,118,910 B2 | 10/2006 | Unger et al. |
| 7,125,711 B2 | 10/2006 | Pugia et al. |
| 7,135,147 B2 | 11/2006 | Cox et al. |
| 7,138,062 B2 | 11/2006 | Yin et al. |
| 7,141,978 B2 | 11/2006 | Peck et al. |
| 7,144,616 B1 | 12/2006 | Unger et al. |
| 7,189,368 B2 | 3/2007 | Andersson et al. |
| 7,189,580 B2 | 3/2007 | Beebe et al. |
| 7,189,581 B2 | 3/2007 | Beebe et al. |
| 7,195,986 B1 | 3/2007 | Bousse et al. |
| 7,201,881 B2 | 4/2007 | Cox et al. |
| 7,216,671 B2 | 5/2007 | Unger et al. |
| 7,229,538 B2 | 6/2007 | Tseng et al. |
| 7,233,865 B2 | 6/2007 | Chien |
| 7,238,255 B2 | 7/2007 | Derand et al. |
| 7,238,324 B2 | 7/2007 | Ko et al. |
| 7,250,128 B2 | 7/2007 | Unger et al. |
| 7,253,003 B2 | 8/2007 | Beebe et al. |
| 7,258,837 B2 | 8/2007 | Yager et al. |
| 7,261,824 B2 | 8/2007 | Schlautmann et al. |
| 7,274,316 B2 | 9/2007 | Moore |
| 7,323,140 B2 | 1/2008 | Handique et al. |
| 7,329,391 B2 | 2/2008 | Cox |
| 7,338,637 B2 | 3/2008 | Pease et al. |
| 7,351,380 B2 | 4/2008 | Simmons et al. |
| 7,351,592 B2 | 4/2008 | Storek et al. |
| 7,357,864 B2 | 4/2008 | Takada et al. |
| 7,381,471 B2 | 6/2008 | Augustine et al. |
| 7,390,463 B2 | 6/2008 | He et al. |
| 7,399,600 B2 | 7/2008 | Carr |
| 7,399,632 B2 | 7/2008 | Simmons et al. |
| 7,402,229 B2 | 7/2008 | Sibbett et al. |
| 7,411,184 B2 | 8/2008 | Sarrut |
| 7,413,709 B2 | 8/2008 | Roitman et al. |
| 7,419,639 B2 | 9/2008 | Osterfeld et al. |
| 7,419,822 B2 | 9/2008 | Jeon et al. |
| 7,422,669 B2 | 9/2008 | Jacobson et al. |
| 7,422,725 B2 | 9/2008 | Kimizuka |
| 7,431,887 B2 | 10/2008 | Storek et al. |
| 7,445,844 B2 | 11/2008 | Chandler et al. |
| 7,449,096 B2 | 11/2008 | Berndt et al. |
| 7,452,509 B2 | 11/2008 | Cox et al. |
| 7,452,713 B2 | 11/2008 | Barlocchi et al. |
| 7,467,928 B2 | 12/2008 | Fakunle et al. |
| 7,485,214 B2 | 2/2009 | Palmieri |
| 7,488,596 B2 | 2/2009 | Palmieri |
| 7,494,555 B2 | 2/2009 | Unger et al. |
| 7,501,245 B2 | 3/2009 | Quake et al. |
| 7,518,726 B2 | 4/2009 | Rulison et al. |
| 7,541,578 B2 | 6/2009 | Weng |
| 7,544,506 B2 | 6/2009 | Breidford et al. |
| 7,552,741 B2 | 6/2009 | Yamada et al. |
| 7,568,399 B2 | 8/2009 | Sparks et al. |
| 7,575,722 B2 | 8/2009 | Arnold |
| 7,579,136 B2 | 8/2009 | Shim et al. |
| 7,581,429 B2 | 9/2009 | Sparks et al. |
| 7,591,936 B2 | 9/2009 | Sarrut |
| 7,601,270 B1 | 10/2009 | Unger et al. |
| 7,640,947 B2 | 1/2010 | Fernandes et al. |
| 7,666,361 B2 | 2/2010 | McBride et al. |
| 7,691,333 B2 | 4/2010 | McBride et al. |
| 7,704,735 B2 | 4/2010 | Facer et al. |
| 7,751,053 B2 | 7/2010 | Carr |
| 7,754,010 B2 | 7/2010 | Unger et al. |
| 7,837,946 B2 | 11/2010 | McBride et al. |
| 7,955,802 B2 | 6/2011 | Whitman et al. |
| 8,008,019 B2 | 8/2011 | Merante et al. |
| 8,124,015 B2 | 2/2012 | Diercks et al. |
| 2003/0061687 A1 | 4/2003 | Hansen et al. |
| 2005/0084421 A1 | 4/2005 | Unger et al. |
| 2005/0112882 A1 | 5/2005 | Unger et al. |
| 2005/0129581 A1 | 6/2005 | McBride et al. |
| 2005/0145496 A1 | 7/2005 | Goodsaid et al. |
| 2005/0201901 A1 | 9/2005 | Grossman et al. |
| 2005/0214173 A1 | 9/2005 | Facer et al. |
| 2005/0252773 A1 | 11/2005 | McBride et al. |
| 2006/0006067 A1 | 1/2006 | Unger |
| 2006/0257900 A1 | 11/2006 | Hudson et al. |
| 2009/0264508 A1 | 10/2009 | Sullenger et al. |
| 2012/0258870 A1 | 10/2012 | Schwartz et al. |
| 2013/0017837 A1 | 1/2013 | Hakola et al. |
| 2013/0217582 A1 | 8/2013 | Borer et al. |
| 2014/0371088 A1 | 12/2014 | Webster |

FOREIGN PATENT DOCUMENTS

| | | |
|---|---|---|
| EP | 1065378 | 1/2001 |
| EP | 2703488 | 3/2014 |
| WO | WO 91/19813 | 12/1991 |
| WO | WO 92/07065 | 4/1992 |
| WO | WO 1993/022684 | 11/1993 |
| WO | WO 98/18480 | 5/1998 |
| WO | WO 2007/137187 | 11/2007 |
| WO | WO 2009/015357 | 1/2009 |
| WO | WO 2009/036236 | 3/2009 |
| WO | WO 2010/045318 | 4/2010 |
| WO | WO 2010/056337 | 5/2010 |
| WO | WO 2010/062706 | 6/2010 |
| WO | WO 2010/072410 | 7/2010 |
| WO | WO 2010/093465 | 8/2010 |
| WO | WO 2011/056688 | 5/2011 |
| WO | WO 2011/066589 | 6/2011 |
| WO | WO 2011/088226 | 7/2011 |
| WO | WO 2011/109440 | 9/2011 |
| WO | WO 2011/127219 | 10/2011 |
| WO | WO 2012/024543 | 2/2012 |
| WO | WO 2012/092336 | 7/2012 |
| WO | WO 2012/115885 | 8/2012 |
| WO | WO 2012/170711 | 12/2012 |
| WO | WO 2012/170715 | 12/2012 |
| WO | WO 2012/174282 | 12/2012 |
| WO | WO 2013/022995 | 2/2013 |
| WO | WO 2013/134786 | 9/2013 |
| WO | WO 2013/022786 | 2/2014 |
| WO | WO 2014/068408 | 5/2014 |
| WO | WO 2014/082083 | 5/2014 |
| WO | WO 2014/089241 | 6/2014 |
| WO | WO 2014/100434 | 6/2014 |
| WO | WO 2015/031694 | 3/2015 |
| WO | WO 2015/116868 | 8/2015 |
| WO | WO 2016/081941 | 5/2016 |
| WO | WO 2016/141169 | 9/2016 |
| WO | WO 2016/145128 | 9/2016 |
| WO | WO 2017/004243 | 1/2017 |
| WO | WO 2017/019918 | 2/2017 |
| WO | WO-2017205686 A1 * | 11/2017 ........... C12Q 1/6811 |

OTHER PUBLICATIONS

U.S. Appl. No. 62/413,361, filed Oct. 26, 2016, Domenyuk et al.
U.S. Appl. No. 62/420,497, filed Nov. 10, 2016, Domenyuk, et al.
U.S. Appl. No. 62/432,561, filed Dec. 9, 2016, Domenyuk, et al.
U.S. Appl. No. 62/441,527, filed Jan. 2, 2017, Domenyuk, et al.
U.S. Appl. No. 62/457,691, filed Feb. 10, 2017, Hornung, et al.
U.S. Appl. No. 62/472,953, filed Mar. 17, 2017, Hornung, et al.
U.S. Appl. No. 62/508,353, filed May 18, 2017, Domenyuk, et al.
[No Author Listed] "Guidance for industry: clinical trial endpoints for the approval of cancer drugs and biologics," Washington, DC, US Food and Drug Administration, May 2007, 19 pages.
Altschul et al., "Basic local alignment search tool," Journal of molecular biology, Oct. 5, 1990, 215(3):403-10.
Altschul et al., "Gapped BLAST and PSI-BLAST: a new generation of protein database search programs," Nucleic Acids Research Sep. 1, 1997, 25(17):3389-402.
Avci-Adali et al., "Upgrading SELEX technology by using lambda exonuclease digestion for single-stranded DNA generation," Molecules, Jan. 2010, 15(1): 11 Pages.
Bartsch et al., "Trastuzumab in the management of early and advanced stage breast cancer," Biologics: Targets & Therapy, Mar. 2007, 1(1):19-31.

(56) References Cited

OTHER PUBLICATIONS

Bonotto et al., "Treatment of metastatic breast cancer in a real-world scenario: is progression-free survival with first line predictive of benefit from second and later lines?," The Oncologist, Jul. 1, 2015, 20(7):719-24.
Braasch et al "Novel antisense and peptide nucleic acid strategies for controlling gene expression." Biochemistry, Apr. 9, 2002, 41(14):4503-10.
Brody et al., "Aptamers as therapeutic and diagnostic agents," Reviews in Molecular Biotechnology, Mar. 1, 2000, 74(1):5-13.
Budayeva et al., "A mass spectrometry view of stable and transient protein interactions," Advancements of Mass Spectrometry in Biomedical Research, Springer, Cham, 2014, 263-282.
Burstein, "The distinctive nature of HER2-positive breast cancers," New England Journal of Medicine, Oct. 20, 2005, 353(16):1652-4.
Chang et al., "Combination therapy targetirig ectopic ATP synthase and 26S proteasome induces ER stress in breast cancer cells," Cell Death & Disease, Nov. 5, 2014, (11):e1540, 12 pages.
Chanas et al., "Blebs lead the way: how to migrate without lamellipodia," Nature Reviews Molecular Cell Biology, Sep. 2008, 9(9):730-6.
Chen et al., "Aptamer microarray as a novel bioassay for protein-protein interaction discovery and analysis," Biosensors and Bioelectronics, Apr. 15, 2013, 42:248-55.
Chen et al., "Microfluidic isolation and transcriptome analysis of serum microvesicles," Lab on a Chip, 2010, 10(4):505-11.
ClinicalTrials.gov, "Chemotherapy With or Without Trastuzumab After Surgery in Treating Women With Invasive Breast Cancer," Jan. 12, 2011, retrieved from URL<https://clinicaltrials.gov/ct2/show/NCT01275677?term=NSABP+B01275647&rank=01275671>, 20 pages.
Colcher et al., "Effects of genetic engineering on the pharmacokinetics of antibodies," The Quarterly Journal of Nuclear Medicine and Molecular Imaging. Jun. 1, 1999;43(2):132-9.
Cotten et al., "2'-O-methyl, 2'-O-ethyl oligoribonucleotides and phosphorothioate oligodeoxyribonucleotides as inhibitors of the in vitro U7 snRNP-dependent mRNA processing event," Nucleic Acids Research, May 25, 1991, 19(10):2629-35.
Crooke et al., "Pharmacokinetic properties of several novel oligonucleotide analogs in mice," Journal of Pharmacology and Experimental Therapeutics, May 1, 1996, 277(2):923-37.
Cutillas et al., "Proteomic analysis of plasma membrane vesicles isolated from the rat renal cortex," Proteomics, Jan. 2005, 5(1):101-12.
Cutillas et al., "Quantification of gel-separated proteins and their phosphorylation sites by LC-MS using unlabeled internal standards: analysis of phosphoprotein dynamics in a B cell lymphoma cell line," Molecular & Cellular Proteomics, Aug. 1, 2005, 4(8):1038-51.
De Mesmaeker et al., "Antisense oligonucleotides," Accounts of Chemical Research, Sep. 1, 1995, 28(9):366-74.
DNA Replication, 2nd Ed., 1980, Chapter 2, 47 pages.
Domenyuk et al., "Plasma exosome profiling of cancer patients by a next generation systems biology approach," Scientific Reports, Feb. 20, 2017, 7:42741.
Duffy et al., "Companion biomarkers: paving the pathway to personalized treatment for cancer," Clinical Chemistry, Oct. 1, 2013, 59(10):1447-56.
EP Search Report in International Appln. 17767690.5, dated Oct. 9, 2019, 41 Pages.
Epelbaum et al., Molecular profiling-selected therapy for treatment of advanced pancreaticobiliary cancer: a retrospective multicenter study, BioMed Research International, 2015, 2015, 9 pages.
Espelund et al., "A simple method for generating single-stranded DNA probes labeled to high activities," Nucleic Acids Research, Oct. 25, 1990, 18(20):6157-8.
Eswarakumar et al., "Cellular signaling by fibroblast growth factor receptors," Cytokine & Growth Factor Reviews, Apr. 1, 2005, 16(2):139-49.

Famulok et al., "Aptamer modules as sensors and detectors," Accounts of Chemical Research, Aug. 5, 2011, 44(12):1349-58.
Famulok et al., "Functional aptamers and aptazymes in biotechnology, diagnostics, and therapy," Chemical Reviews, Sep. 12, 2007, 107(9):3715-43.
Faoro et al., "Ribonornic approaches to study the RNA-binding proteome," FEBS Letters, Oct. 16, 2014, 588(20):3649-64.
Fouz et al. "Gene expression analysis in MCF-7 breast cancer cellstreated with recombinant bromelain," Applied Biochemistry and Biotechnology, Aug. 1, 2014, 173(7):1618-39.
Froehler et al., "Synthesis of DNA via deoxynudeoside H-phosphonate intermediates," Nucleic Acids Research, Jul. 11, 1986. 5399-407.
Froehler, "Deoxynucleoside H-phosphonate diester intermediates in the synthesis of internucleotide phosphate analogues," Tetrahedron Letters, Jan. 1, 1986, 27(46):5575-8.
Garraway et al., "Lessons from the cancer genome," Cell, Mar. 28, 2013, 153(1):17-37.
Gatalica et al., "The expression of Fhit protein is related inversely to disease progression in patients with breast carcinoma," Cancer, Mar. 15, 2000, 88(6):1378-83.
Gerlinger et al., "Intratumor heterogeneity and branched evolution revealed by multiregion sequencing," New England Journal of Medicine, Mar. 8, 2012, 366(10):883-92.
Gyllenstenet al., "Generation of single-stranded DNA by the polymerase chain reaction and its application to direct sequencing of the HLA-DQA locus," Proceedings of the National Academy of Sciences, Oct. 1, 1988,85(20):76520-6.
Hanahan et al., "Hallmarks of cancer: the next generation," Cell, Mar. 4, 2011, 144(5):646-74.
Heasman, "Morpholino oligos: making sense of antisense?," Developmental Biology, Mar. 15, 2002, 243(2):209-14.
Herzog et al., "Impact of molecular profiling on overall survival of patients with advanced ovarian cancer," Oncotarget, Apr. 12, 2016, 7(15):19840-9.
Hicke et al., "Escort aptamers: a delivery service for diagnosis and therapy," The Journal of Clinical Investigation, Oct. 15, 2000, 106(8):923-8.
Higuchi et al., "Production of single-stranded DNA templates by exonuclease digestion following the polymerase chain reaction," Nucleic Acids Research, Jul. 25, 1989, 17(14):5865, 1 Page.
Hirose et al. "Rapid synthesis of trideoxyribonucleotide blocks," Tetrahedron Letters, Jan. 1, 1978, 19(28):2449-52.
Hobbs et al., "Polynucleotides containing 2'-amino-2'-deoxyribose and 2'-azido-2'-deoxyribose,"Biochemistry, Dec. 1, 1973, 12(25):5138-45.
Hofacker et al., "Fast folding and comparison of RNA secondary structures," Monatshefte für Chemie/Chemical Monthly, Feb. 1, 1994, 125(2):167-88.
Hofacker, "Vienna RNA secondary structure server," Nucleic Acids Research, Jul. 1, 2003,31(13):3429-31.
Hoopmann et al., "Tumor M2 pyruvate kinase-determination in breast cancer patients receiving trastuzumab therapy," Cancer Letters, Dec. 10, 2002, 187(1-2):223-8.
Horton, "Trastuzumab use in breast cancer: clinical issues," Cancer Control, Nov. 2002, 9(6):499-507.
Hurley et al., "Membrane budding and scission by the ESCRT machinery: it's all in the neck," Nature Reviews Molecular Cell Biology, Aug. 2010 Aug. 11(8):556-566.
International Preliminary Report on Patentability in International Application No. PCT/US2017/23108, dated Sep. 18, 2018, 7 pages.
International Preliminary Report on Patentability in International Application No. PCT/US2017/34567, dated Nov. 27, 2018, 7 pages.
International Search Report and Written Opinion in International Application No. PCT/US2017/23108, dated Jul. 7, 2017, 11 pages.
International Search Report and Written Opinion in International Application No. PCT/US2017/34567, dated Aug. 25, 2017, 11 pages.
Ithimakin et al., "HER2 drives luminal breast cancer stem cells in the absence of HER2 amplification: implications for efficacy of adjuvant trastuzumab," Cancer Research, Mar. 1, 2013, 73(5):1635-46.
Jain, "Integrative omics, pharmacoproteomics, and human body fluids," Proteomics of Human Body Fluids, Humana Press, 2007, 175-192.

(56) References Cited

OTHER PUBLICATIONS

Jameson et al., "A pilot study utilizing multi-omic molecular profiling to find potential targets and select individualized treatments for patients with previously treated metastatic breast cancer," Breast Cancer Research and Treatment, Oct. 1, 2014, 147(3):579-88.

Jeong et al., "PMCA2 regulates HER2 protein kinase localization and signaling and promotes HER2-mediated breast cancer," Proceedings of the National Academy of Sciences, Jan. 19, 2016, 113(3):E282-90.

Jones et al., "High-affinity aptamers to subtype 3a hepatitis C virus polymerase display genotypic specificity," Antimicrobial Agents and Chemotherapy, Sep. 1, 2006, 50(9):3019-27.

Kabanov et al., "A new class of antivirals: antisense oligonucleotides combined with a hydrophobic substituent effectively inhibit influenza virus reproduction and synthesis of virus-specific proteins in MDCK cells," FEBS Letters, Jan. 1, 1990, 259(2):327-30.

Kärkkäinen et al., "POSH2 is a RING finger E3 ligase with Rac1 binding activity through a partial CRIB domain," FEBS Letters, Sep. 24, 2010, 584(18):3867-72.

Kartalov et al., "High-throughput multi-antigen microfluidic fluorescence immunoassays," BioTechniques, Jan. 2006, 40(1):85-90.

Keller et al., "Exosomes: from biogenesis and secretion to biological function," Immunology Letters, Nov. 2006, 107(2):102-8.

Klement et al., "Future paradigms for precision oncology," Oncotarget, Jul. 19, 2016, 7(29):46813.

Kowal et al., "Biogenesis and secretion of exosomes," Current Opinion in Cell Biology, Aug. 1, 2014, 29:116-25.

Kurzrock et al., "Precision oncology for patients with advanced cancer: the challenges of malignant snowflakes," Cell Cycle, Jul. 18, 2015, 14(14):2219-21.

Kuypers et al., "On-line melting of double-stranded DNA for analysis of single-stranded DNA using capillary electrophoresis," Journal of Chromatography B: Biomedical Sciences and Applications, Jan. 26, 1996, 675(2):205-11.

Lacerra et al., "Restoration of hemoglobin A synthesis in erythroid cells from peripheral blood of thalassemic patients," Proceedings of the National Academy of Sciences, Aug. 15, 2000, 97(17):9591-6.

Letsinger et al., "Cholesteryl-conjugated oligonucleotides: synthesis, properties, and activity as inhibitors of replication of human immunodeficiency virus in cell culture," Proceedings of the National Academy of Sciences, Sep. 1, 1989, 86(17):6553-6.

Li et al., "Identification of an aptamer targeting hnRNP A1 by tissue slide-based SELEX," The Journal of Pathology: A Journal of the Pathological Society of Great Britain and Ireland, Jul. 2009, 218(3):327-36.

Li et al., "The oral fluid MEMS/NEMS chip (OFMNC): diagnostic & translational applications," Advances in Dental Research, Jun. 2005, 18(1):3-5.

Liu et al, Comprehensive Proteomics Analysis Reveals Metabolic Reprogramming of Tumor-Associated Macrophages Stimulated by the Tumor Microenvironment. J Proteome Res. Jan. 6, 2017;16(1):288-297.

Liu et al., "High plasma fibrinogen is correlated with poor response to trastuzumab treatment in HER2 positive breast cancer," Medicine, Feb. 2015, 94(5).

Liu et al., "TiGER. A database for tissue-specific gene expression and regulation," BMC Bioinformatics, Dec. 2008, 9(1):271, 7 pages.

Loi et al., "Effects of estrogen receptor and human epidermal growth factor receptor-2 levels on the efficacy of trastuzumab: a secondary analysis of the HERA trial," JAMA Oncology, Aug. 1, 2016, 2(8):1040-7.

Lousberg et al., "Resistance to therapy in estrogen receptor positive and human epidermal growth factor 2 positive breast cancers: progress with latest therapeutic strategies," Therapeutic Advances in Medical Oncology, Nov. 2016, 8(6):429-49.

Manoharan et al., "Chemical modifications to improve uptake and bioavailability of antisense oligonucleotides," Annals of the New York Academy of Sciences, Oct. 1992, 660(1):306-9.

Manoharan et al., "Cholic acid-oligonucleotide conjugates for antisense applications," Bioorganic & Medicinal Chemistry Letters, Apr. 21, 1994, 4(8):1053-60.

Manoharan et al., "Introduction of a lipophilic thioether tether in the minor groove of nucleic acids for antisense applications," Bioorganic & Medicinal Chemistry Letters, Dec. 1, 1993, 3(12):2765-70.

Manoharan et al., "Lipidic nucleic acids," Tetrahedron Letters, May 22, 1995, 36(21):3651-4.

Manoharan et al., "Oligonucleotide conjugates: alteration of the pharmacokinetic properties of antisense agents," Nucleosides, Nucleotides & Nucleic Acids, May 1, 1995, 14(3-5):969-73.

Mathews et al., "Expanded sequence dependence of thermodynamic parameters provides robust prediction of RNA secondary structure," Journal of Molecular Biology, 1999, 288, 911-940.

Mere et al., "Miniaturized FRET assays and microfluidics: key components for ultra-high-throughput screening," Drug Discovery Today, Aug. 1, 1999, 4(8):363-9.

Mishra et al., "Improved leishmanicidal effect of phosphorotioate antisense oligonucleotides by LDL-mediated delivery," Biochimica et Biophysica Acta (BBA)—Gene Structure and Expression, Nov. 7, 1995, 1264(2):229-37.

Mitri et al., "The HER2 receptor in breast cancer: pathophysiology, clinical use, and new advances in therapy," Chemotherapy Research and Practice. Dec. 20, 2012, 2012, 8 pages.

Moosavian et al., "Development of RNA aptamers as molecular probes for HER2+ breast cancer study using cell-SELEX," Iranian Journal of Basic Medical Sciences, Jun. 2015 18(6) 576-86.

Nasevicius et al., "Effective targeted gene 'knockdown' in zebrafish," Nature Genetics, Oct. 2000, 26(2):216-20.

Nida et al., "Fluorescent nanocrystals for use in early cervical cancer detection," Gynecologic Oncology, Dec. 1, 2005, 99(3):S89-94.

Nielsen et al., "Sequence-selective recognition of DNA by strand displacement with a thymine-substituted polyamide," Science, Dec. 6, 1991, 254(5037):1497-500.

Oberhauser et al., "Effective incorporation of 2'-O-methyl-oligoribonuclectides into liposomes and enhanced cell association through modification with thiocholesterol," Nucleic Acids Research, Feb. 11, 1992, 20(3):533-8.

Oh et al., "Rapid, Efficient Aptamer Generation: Kinetic-Challenge Microfluidic SELEX," 12th Annual UC Systemwide Bioengineering Symposium, Jun. 13, 2011.

Ormerod, Flow Cytometry 2nd ed., Chapter 3, Springer-Verlag, New York (1999), 7 pages.

Ormerod, Flow Cytometry 2nd ed., Chapter 4, Springer-Verlag, New York (1999), 9 pages.

Paik et al., "HER2 status and benefit from adjuvant trastuzumab in breast cancer," New England Journal of Medicine, Mar. 27, 2008, 358(13):1409-11.

Pan et al., "ATP synthase ecto-α-subunit: a novel therapeutic target for breast cancer," Journal of Translational Medicine, Dec. 2011, 9(1):211, 15 Pages.

Paul et al., "Streptavidin-coated magnetic beads for DNA strand separation implicate a multitude of problems during cell-SELEX," Oligonucleotides, Sep. 1, 2009, 19(3):243-54.

Pei et al., "Clinical applications of nucleic acid aptamers in cancer," Molecular and Clinical Oncology, May 1, 2014 May, 2(3):341-8.

Peták et al., "Integrating molecular diagnostics into anticancer drug discovery," Nature Reviews Drug Discovery, Jul. 2010, 9(7):523.

Pipper et al., "Clockwork PCR including sample preparation," Angewandte Chemie International Edition, May 13, 2008 May, 47(21):3900-4.

Prasad et al., "Precision oncology: origins, optimism, and potential," The Lancet Oncologym, Feb. 1, 2016, 17(2):e81-6.

Prasad, "Perspective: the precision-oncology illusion," Nature, Sep. 7, 2016, 537(7619):S63.

Raiborg et al., "The ESCRT machinery in endosomal sorting of ubiquitylated membrane proteins," Nature, Mar. 25, 2009, 458(7237):445-52.

Reff et al., "A review of modifications to recombinant antibodies: attempt to increase efficacy in oncology applications," Critical Reviews in Oncology/Hematology, Oct. 1, 2001, 40(1):25-35.

(56) References Cited

OTHER PUBLICATIONS

Santangelo et al., "The RNA-binding protein SYNCRIP is a component of the hepatocyte exosomal machinery controlling microRNA sorting," Cell Reports, Oct. 11, 2016, 17(3):799-808.

Sayers et al., "Vaxjo: a web-based vaccine adjuvant database and its application for analysis of vaccine adjuvants and their uses in vaccine development," BioMed Research International, Mar. 13, 2012, 2012, 13 Pages.

Shea et al., "Synthesis, hybridization properties and antiviral activity of lipid-oligodeoxynucleotide conjugates," Nucleic Acids Research, Jul. 11, 1990, 18(13):3777-83.

Shrager et al., "Rapid learning for precision oncology," Nature Reviews Clinical oncology, Feb. 2014, 11(2):109.

Slamon et al., Human breast cancer: correlation of relapse and survival with amplification of the HER-2/neu oncogene, Science, Jan. 9, 1987, 235(4785):177-82.

Sood et al., "A rapid and convenient synthesis of poly-thymidylic acid by the modified triester approach," Nucleic Acids Research, Aug. 1, 1977, 4(8):2757-65.

Sproat et al., "New synthetic routes to synthons suitable for 2'-O-allyloligoribonucleotide assembly," Nucleic Acids Research, Feb. 25, 1991, 19(4):733-8.

Srinivas et al., "Aptamer-functionalized microgel particles for protein detection," Analytical Chemistry, Nov. 7, 2011, 83(23):9138-45.

Stumpf et al., "Estimating the size of the human interactome," Proceedings of the National Academy of Sciences, May 13, 2008, 105(19):6959-64.

Suchanek et al., "Photo-leucine and photo-methionine allow identification of protein-protein interactions in living cells," Nature Methods, Apr. 2005, 2(4):261.

Svinarchuk et al., "Inhibition of HIV proliferation in MT-4 cells by antisense oligonucleotide conjugated to lipophilic groups," Biochimie, Jan. 1, 1993, 75(1-2):49-54.

Svobodová et al., "Comparison of different methods for generation of single-stranded DNA for SELEX processes," Analytical and Bioanalytical Chemistry, Aug. 1, 2012, 404(3):835-42.

Swoboda et al., "Shared MHC class II-dependent melanoma ribosomal protein 18 identified by phage display," Cancer Research, Apr. 15, 2007, 67(8):3555-9.

Tacheny et al., "Mass spectrometry-based identification of proteins interacting with nucleic acids," Journal of Proteomics, Dec. 6, 2013, 94:89-109.

Tang et al., "Chip-based genotyping by mass spectrometry," Proceedings of the National Academy of Sciences, Aug. 31, 1999, 96(18):10016-20.

Théry et al., "Membrane vesicles as conveyors of immune responses," Nature Reviews Immunology, Aug. 2009, 9(8):581-93.

Unger et al., "Single-molecule fluorescence observed with mercury lamp illumination," Biotechniques, Nov. 1999, 27(5):1008-14.

Vinkenborg et al., "Aptamer-Based Affinity Labeling of Proteins," Angewandte Chemie International Edition, Sep. 3, 2012, 51(36):9176-80.

Von Hoff et al., "Pilot study using molecular profiling of patients' tumors to find potential targets and select treatments for their refractory cancers," Journal of Clinical Oncology, Nov. 20, 2010, 28(33):4877-83.

Wang et al., "Cyclohexene nucleic acids (CeNA): serum stable oligonucleotides that activate RNase H and increase duplex stability with complementary RNA," Journal of the American Chemical Society, Sep. 13, 2000, 122(36):8595-602.

Wang et al., "Integrative exploration of genomic profiles for triple negative breast cancer identifies potential drug targets," Medicine, Jul. 2016, 95(30).

Wang et al., "Morph-X-Select: Morphology-based tissue aptamer selection for ovarian cancer biomarker discovery," Biotechniques, Nov. 2016, 61(5):249-59.

Wilbur et al., "Rapid similarity searches of nucleic acid and protein data banks," Proceedings of the National Academy of Sciences, Feburary 1, 1983, 80(3):726-30.

Wilhelm et al., "Sh3rf2/POSHER protein promotes cell survival by ring-mediated proteasomal degradation of the c-Jun N-terminal kinase scaffold POSH (Plenty of SH3s) protein," Journal of Biological Chemistry, Jan. 13, 2012, 287(3):2247-56.

Williams et al., "PCR product with strands of unequal length," Nucleic Acids Research, Oct. 25, 1995, 23(20):4220-1.

Wolff et al., "Recommendations for human epidermal growth factor receptor 2 testing in breast cancer: American Society of Clinical Oncology/College of American Pathologists clinical practice guideline update," Archives of Pathology and Laboratory Medicine, Oct. 7, 2013 ,38(2):241-56.

Wu et al., "An allosteric synthetic DNA," Nucleic Acids Research, Mar. 1, 1999, 27(6):1512-6.

Xu et al, "Direct removal in the mouse of a floxed neo gene from a three-loxp conditional knockout allele by two novel approaches," Genesis, May 2001, 30(1):1-6.

Zhang et al "Indirect purification method provides high yield and quality ssDNA sublibrary for potential aptamer selection," Analytical Biochemistry, May 1, 2015, 476:84-90.

Zhou et al., Cell-type-specific, aptamer-functionalized agents for targeted disease therapy, Molecular Therapy-Nucleic Acids, Jan. 1, 2014, 3:e169, 17 pages.

Zong et al., "Forward-phase and reverse-phase protein microarray," Microarrays, Humana Press, 2007, 363-73.

\* cited by examiner

SEQ ID NO. 2

SEQ ID NO. 1

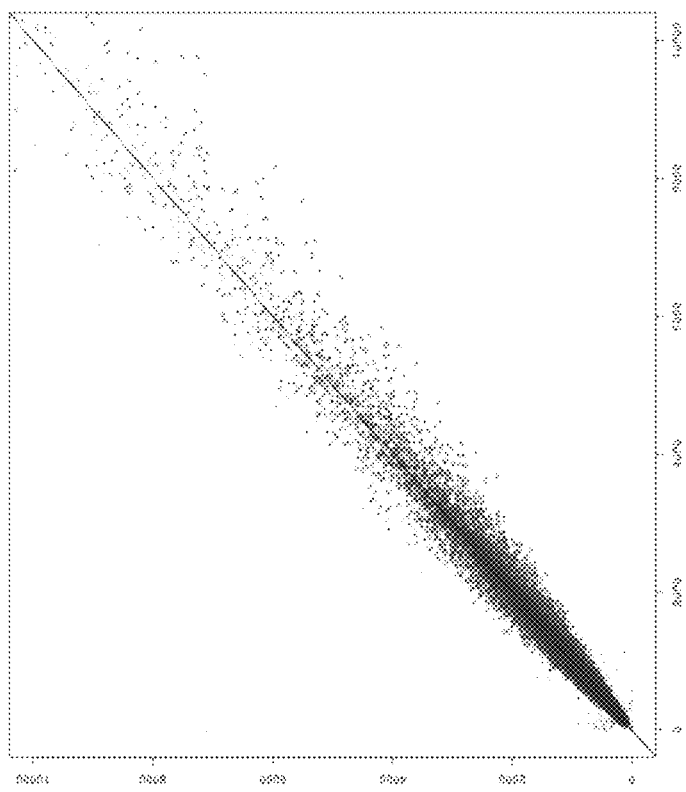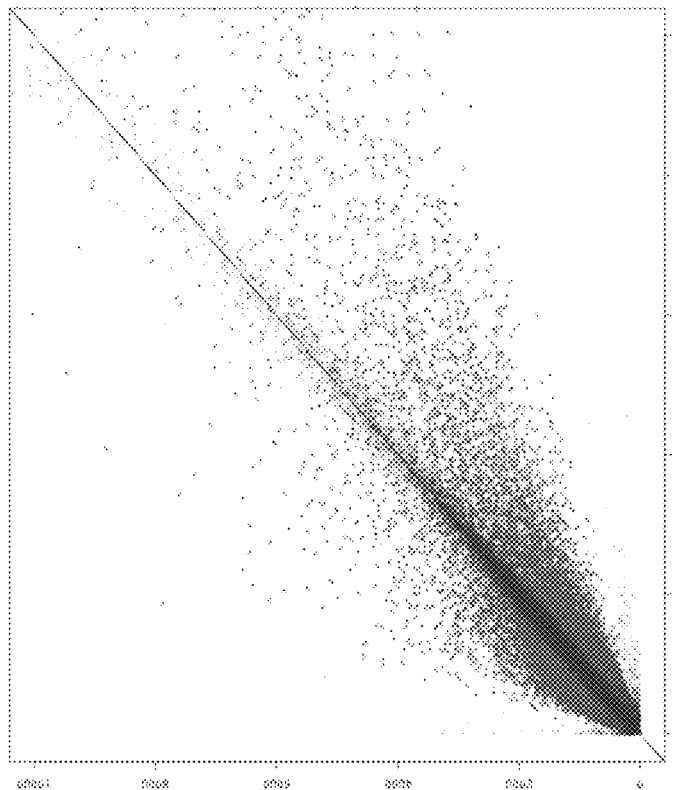
FIG. 5C

Cancer v Non-Cancer

| | P-0.005 |
|---|---|
| d-50 | 2471 |
| d-100 | 1615 |
| d-200 | 914 |
| d-500 | 315 |

| | P-0.005 |
|---|---|
| d-50 | 2.95% |
| d-100 | 3.07% |
| d-200 | 3.18% |
| d-500 | 3.10% |
| Random | 0.50% |

Random

| | P-0.005 |
|---|---|
| d-50 | 49 |
| d-100 | 27 |
| d-200 | 17 |
| d-500 | 5 |

| | P-0.005 |
|---|---|
| d-50 | 0.06% |
| d-100 | 0.05% |
| d-200 | 0.06% |
| d-500 | 0.05% |
| Random | 0.50% |

FIG. 5E

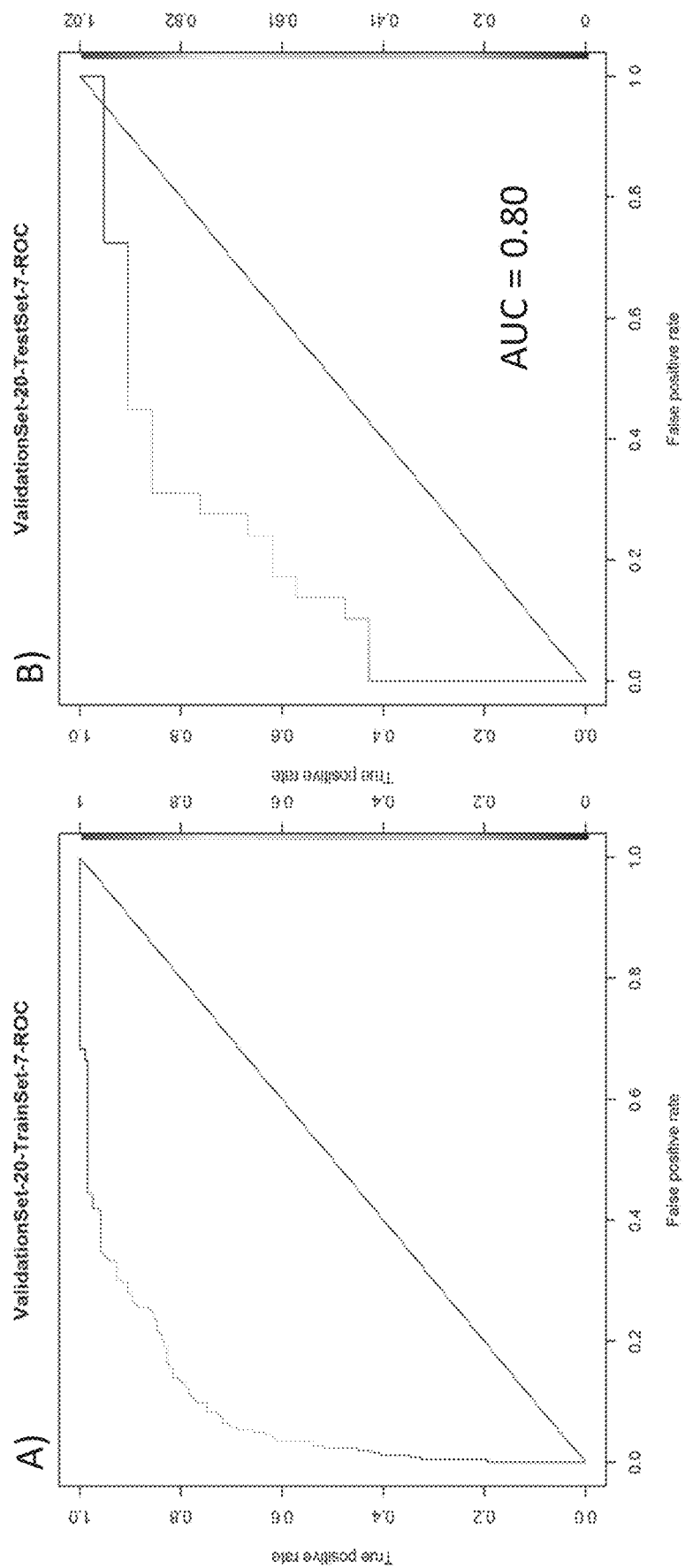
FIG. 7A-B

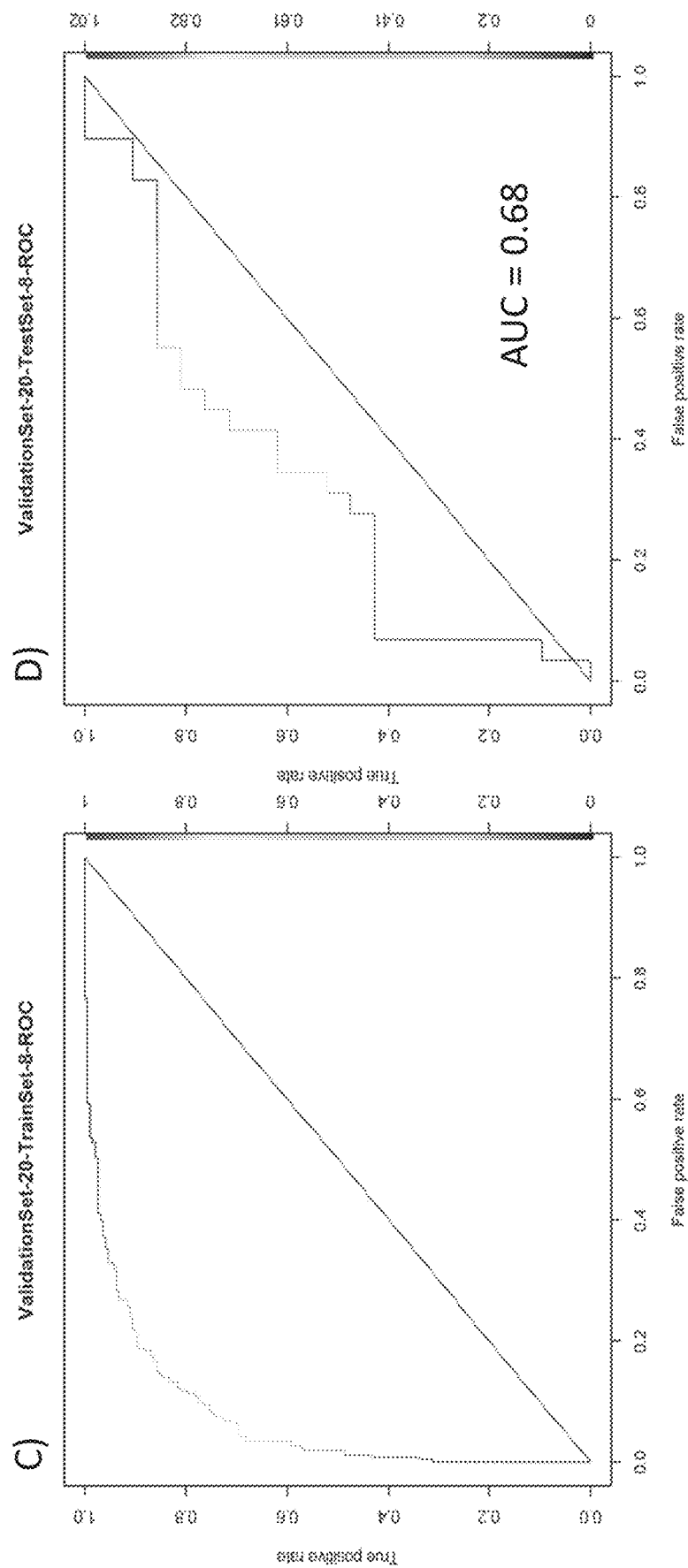
FIG. 7C-D

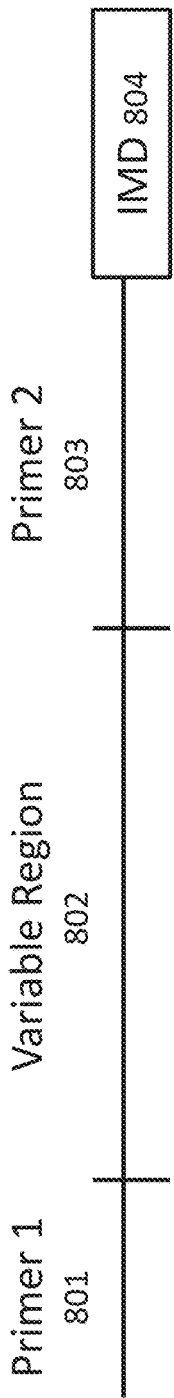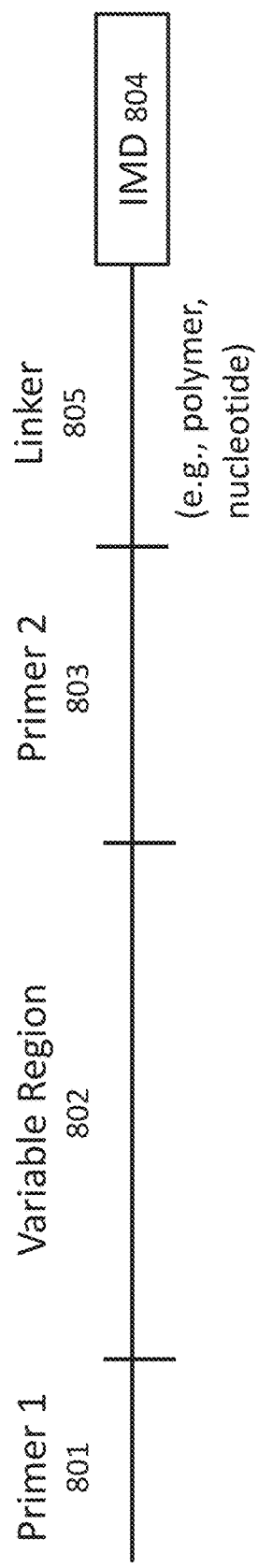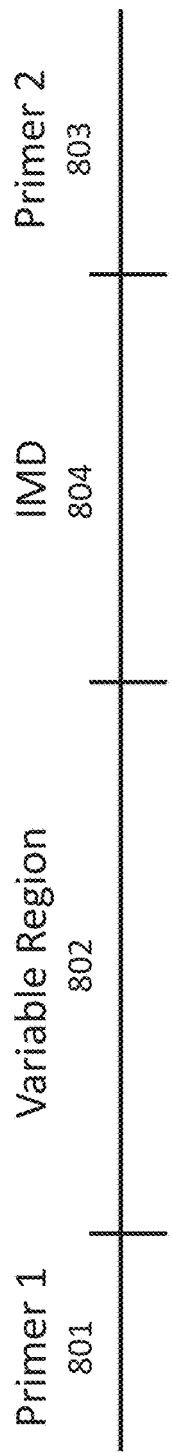
FIG. 8

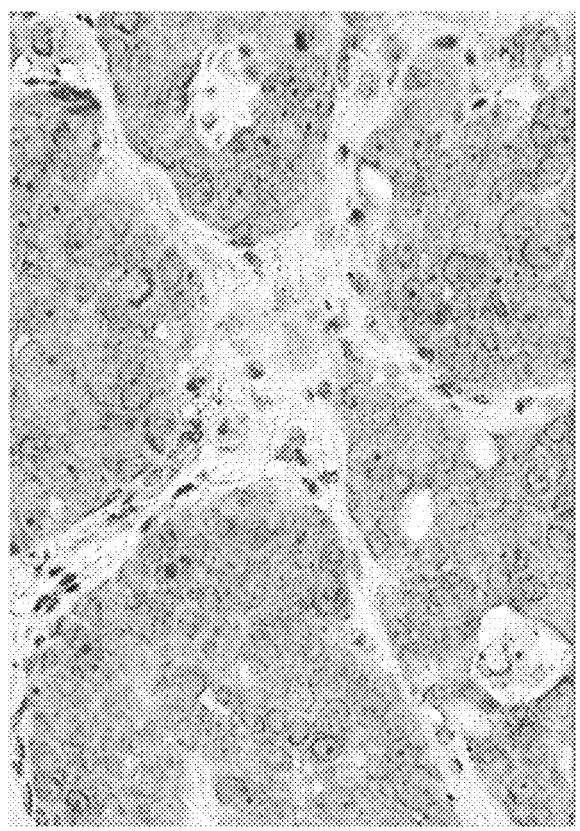
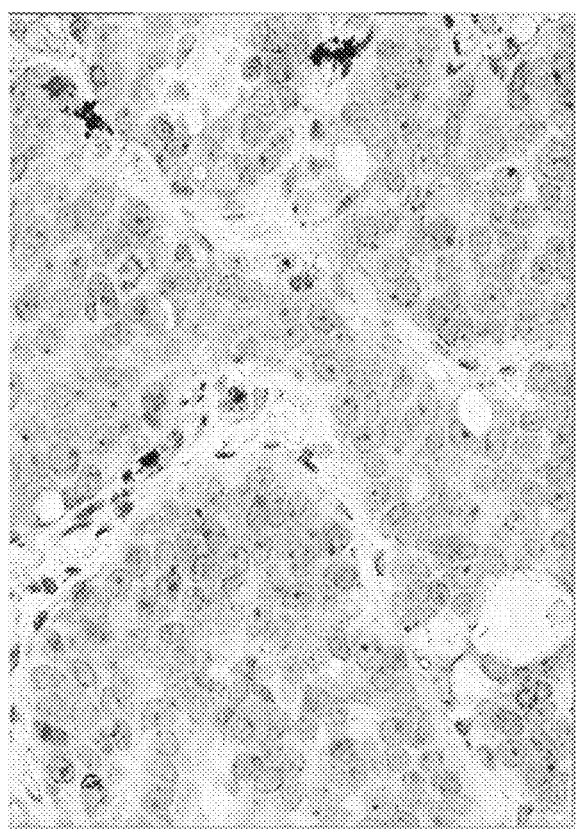
FIG. 15C

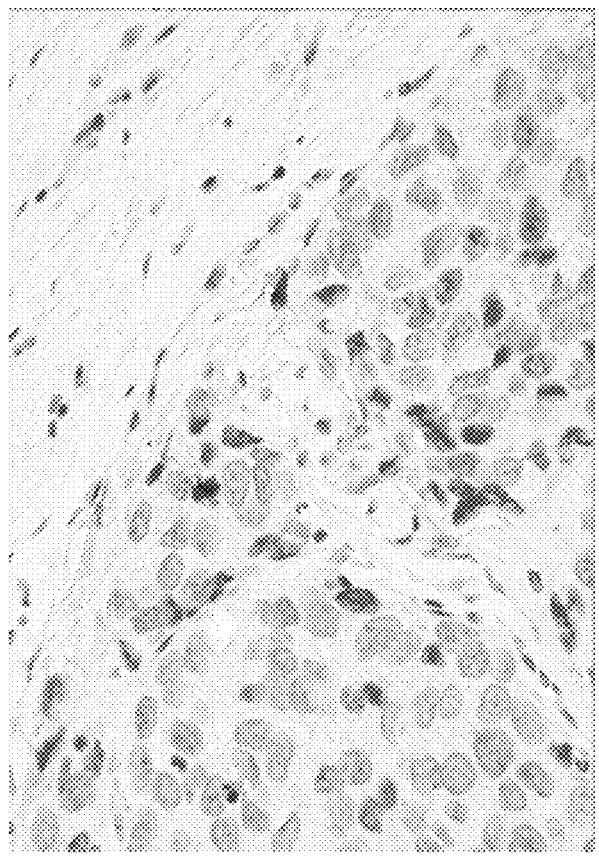
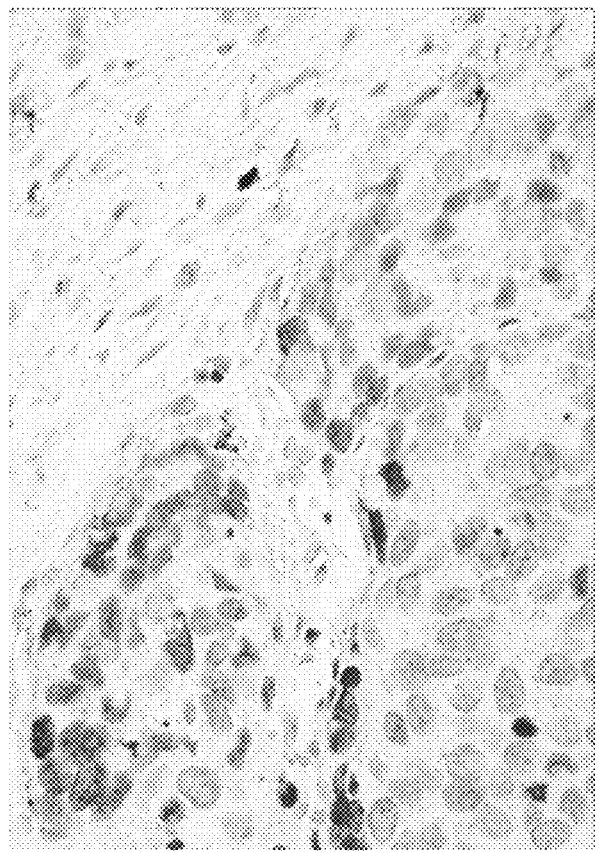
FIG. 15D

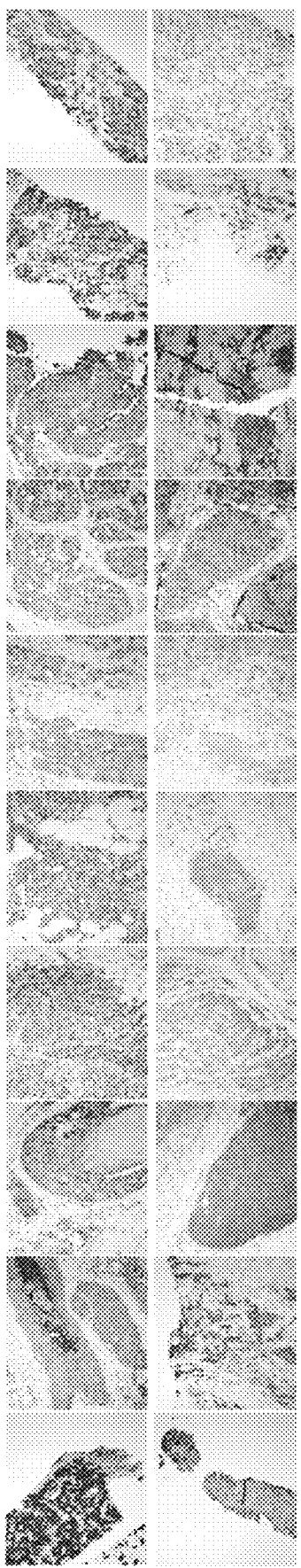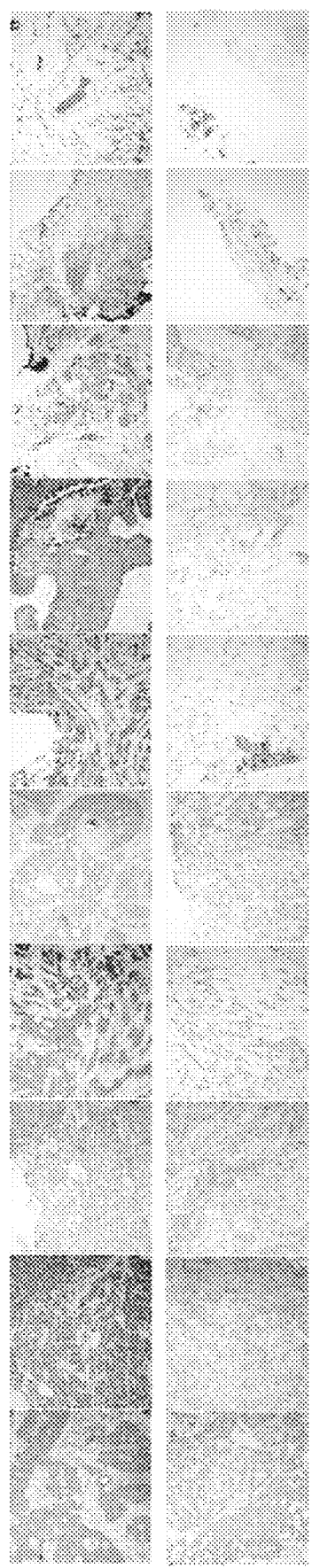
FIG. 16C i) B case, not used for enrichment
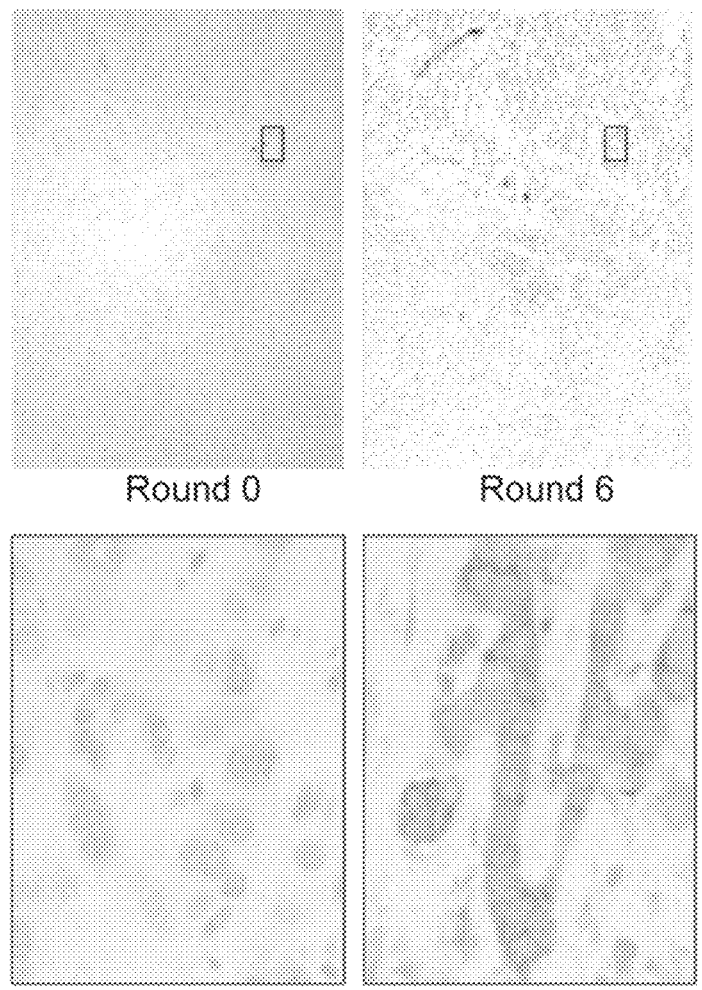
Round 0     Round 6
NB-case
ii)
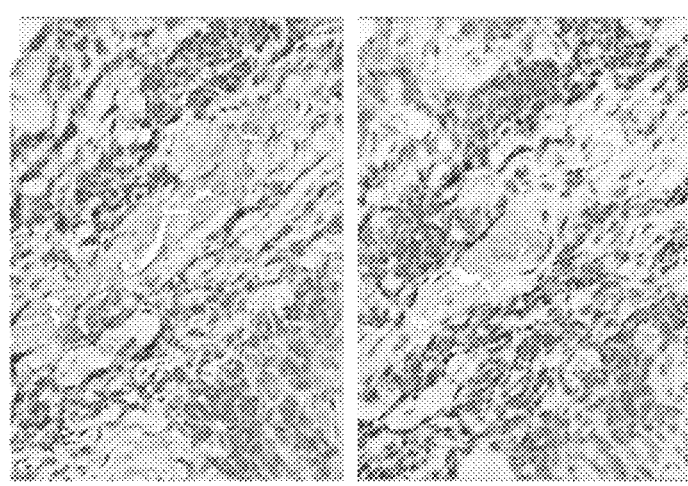
Round 4     Round 6
FIG. 17E

| | Compartment | % stained cells at: | | | | Histological score |
|---|---|---|---|---|---|---|
| | | 0 | 1 | 2 | 3 | Total | |
| Red area | Cytoplasm | 0 | 25 | 75 | 0 | | |
| | Nucleus | 15 | 10 | 75 | 0 | | |
| Blue area | Cytoplasm | 18 | 46 | 36 | 0 | | |
| | Nucleus | 27 | 27 | 46 | 0 | | |
| Total | Cytoplasm | 7 | 32 | 61 | 0 | 154 | 300 |
| | Nucleus | 19 | 16 | 65 | 0 | 146 | |

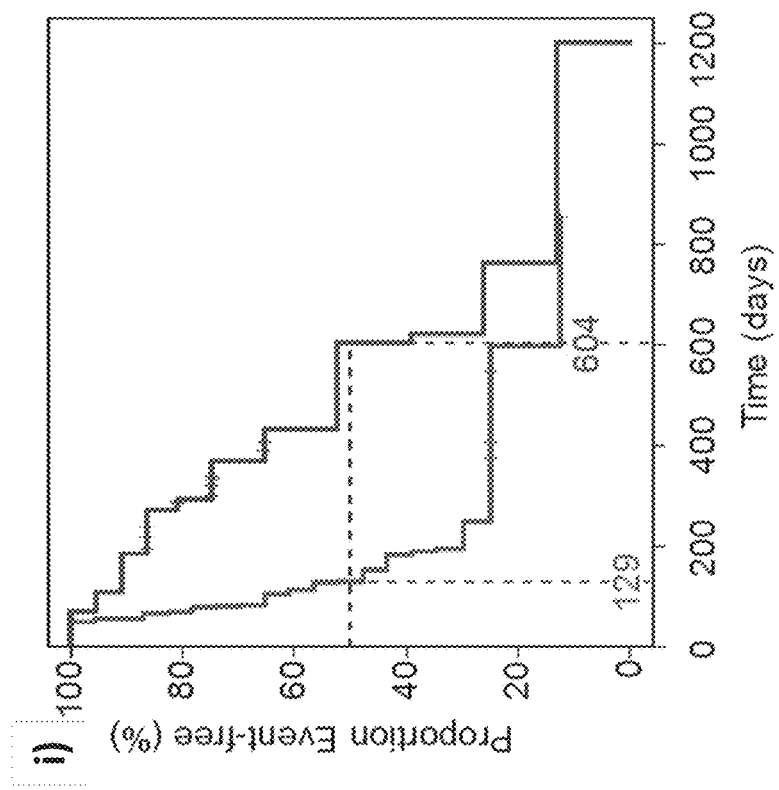
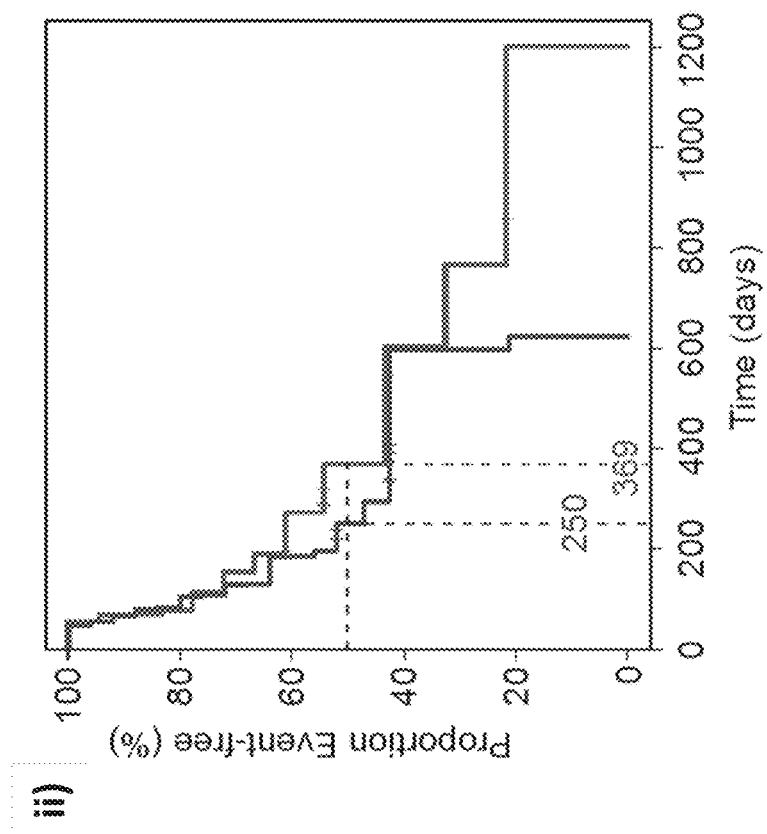
FIG. 17P

Enrichment scheme

Round 1: positive selection → PCR

Round 2: positive selection → PCR

Round 3: positive selection → PCR

Round 4: negative selection → negative selection → positive selection → PCR

Round 5: negative selection → negative selection → positive selection → PCR

Round 6: negative selection → negative selection → positive selection → PCR

FIG. 18A

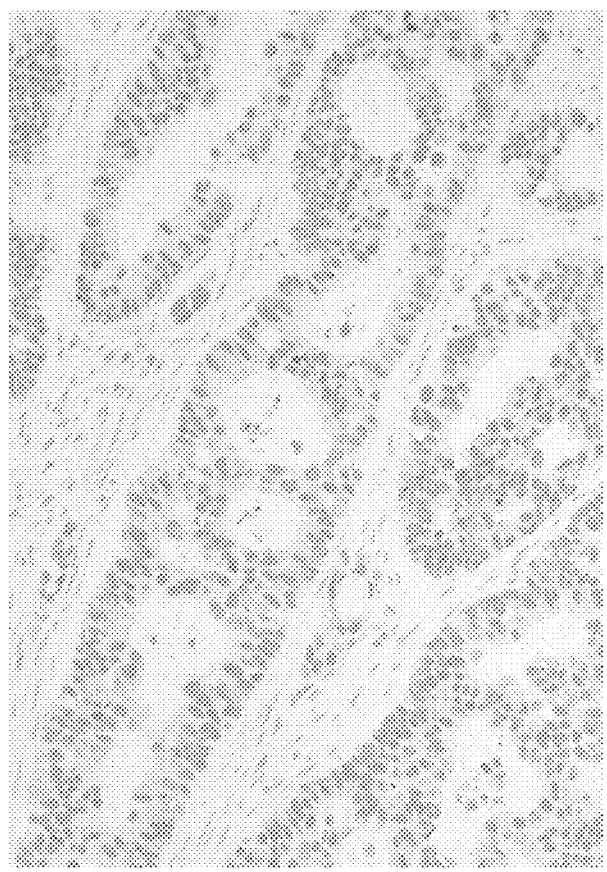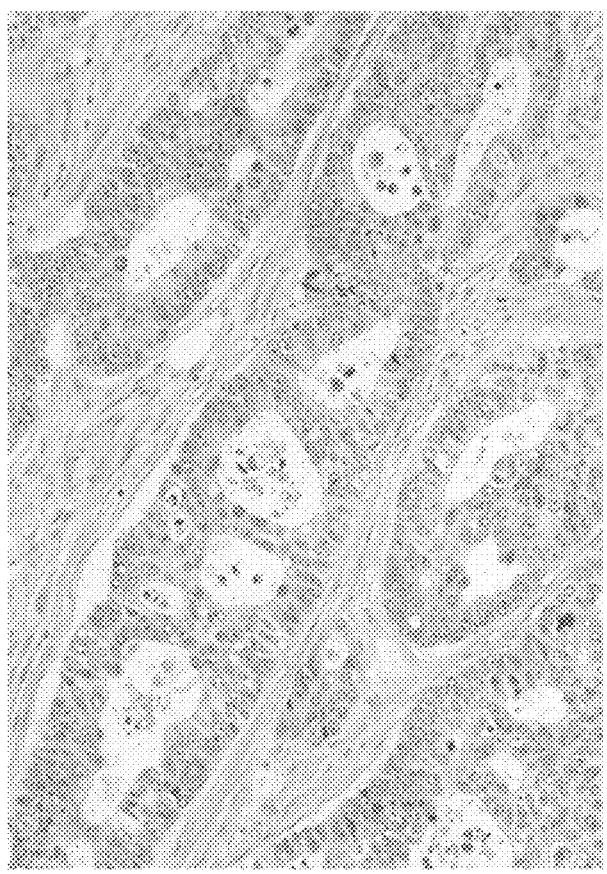
FIGs. 18D-E

| | Round 0 | Round 1-Pos | Round 2-Pos | Round 3-Pos | Round 4-N-P | Round 5-N-P | Round 6-Neg | Round 6-Pos | Round 7-Pos |
|---|---|---|---|---|---|---|---|---|---|
| Permeabilization | NA | ✓ | ✓ | ✓ | ✓ | ✓ | ✓ | ✓ | ✓ |
| Epitope retrieval | NA | ✓ | ✓ | ✓ | ✓ | ✓ | ✓ | ✓ | ✓ |
| Library input, ng | NA | 500 | 250 | 100 | 100 | 1 | 0.002 | 100 | 100 |
| Binding (-/+ reaction buffer) | NA | off line, 150ul | off line, 150ul | off line, 150ul | N/P-offline | N/P-offline | off line, 150+50ul | auto | auto |
| Binding cocktail: Triton x100 | NA | 0% | 0% | 0.005% | 0% | 0.01% | 0.005% | 0.01% | 0.01% |
| Binding cocktail: BlockAid | NA | 5% | 10% | 15% | 20% | 20% | 15% | 25% | 25% |
| Post AL Binding Rinses | NA | 1 dip | 1 dip | 1 rinse | 4 rinses | 4 rinses | NA | 4 rinses | 4 rinses |
| Enrichment staining | NA | NA | NA | ✓ | ✓ | ✓ | NA | ✓ | ✓ |
| Pre/Post-Enrichment staining | ✓ | NA | NA | | | | ✓ | | |

FIG. 20A

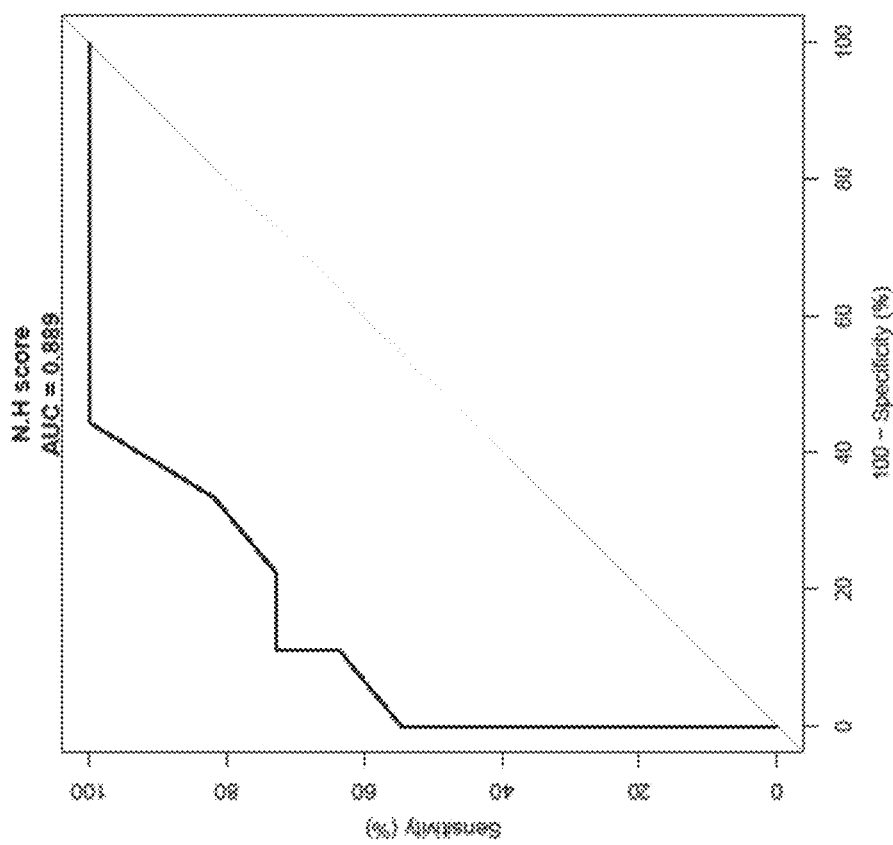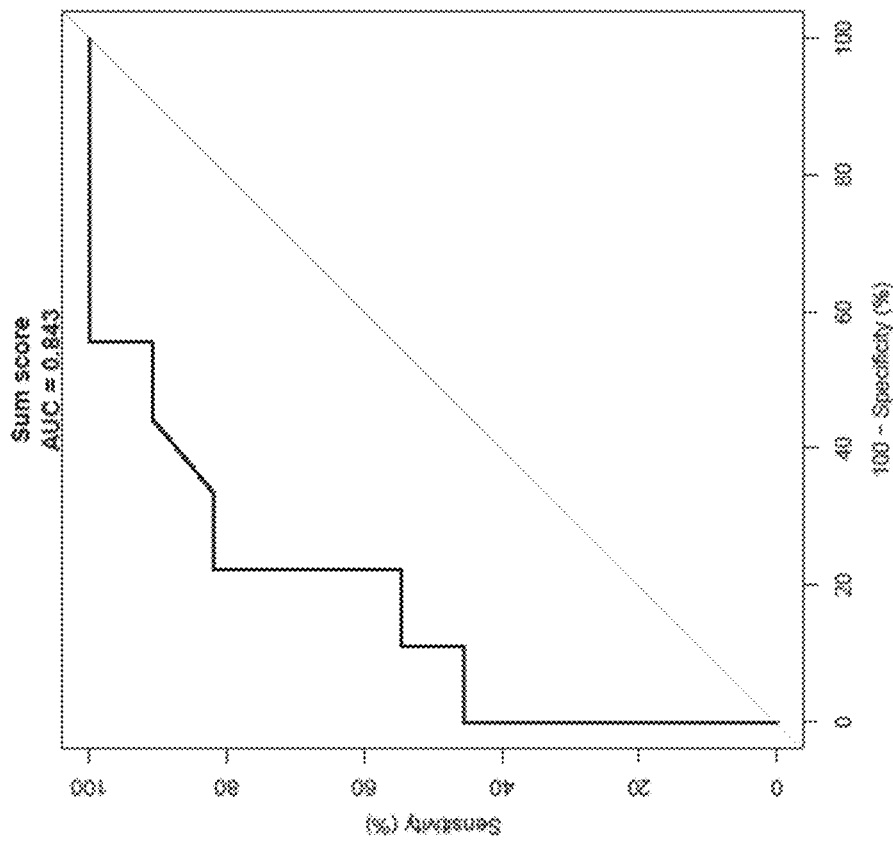
FIG. 20D

| Conditions | Round 0 | Round 1 Pos | Round 2 Pos | Round 3 Pos | Round 4 Neg | Round 4 Pos | Round 5 Neg | Round 5 Pos | Round 4 Neg->Pos | Round 5 Neg->Pos | Round 6 Neg->Pos | R6 staining |
|---|---|---|---|---|---|---|---|---|---|---|---|---|
| Permeabilization | NA | ✓ | ✓ | ✓ | ✓ | ✓ | ✓ | ✓ | ✓ | ✓ | ✓ | ✓ |
| Epitope retrieval | NA | ✓ | ✓ | ✓ | ✓ | ✓ | ✓ | ✓ | ✓ | ✓ | ✓ | ✓ |
| Library input, ng | NA | 500 | 80% of Rd 1 recovery | 200 | 0.1 | 100 | 0.075 | 100 | 100 | 100 | 100 | 100 |
| Binding (-/+ reaction buffer) | NA | auto | auto | auto | auto | auto | auto | auto | auto | auto | auto | auto |
| Binding cocktail: Triton x100 | NA | 0% | 0% | 0.005% | 0.005% | 0.01% | 0.01% | 0.01% | 0.005% | 0.01% | 0.01% | 0.01% |
| BlockAid: Binding cocktail | NA | 5% | 10% | 15% | 15% | 20% | 20% | 25% | 15% | 20% | 25% | 25% |
| BlockAid: Streptavidin | NA | 0% | 0% | 0% | NA | 0% | NA | 20% | NA | 0% | 20% | 20% |
| Post AL Binding Rinses | NA | 1 rinse | 1 rinse | 1 rinse | NA | 4 rinses | NA | 4 rinses | NA->4 rinses | NA->4 rinses | NA->4 rinses | 4 rinses |
| Enrichment staining | NA | NA | NA | ✓ | ✓ | ✓ | ✓ | ✓ | NA | ✓ | ✓ | NA |
| Post-Enrichment staining | ✓ N and P | NA | NA |  |  |  |  |  |  |  | ✓ | ✓ |

FIG. 21A

FIG. 23C

ii) Pool of eight control sequences
i) Pool of eight selected sequences
FIG. 23D

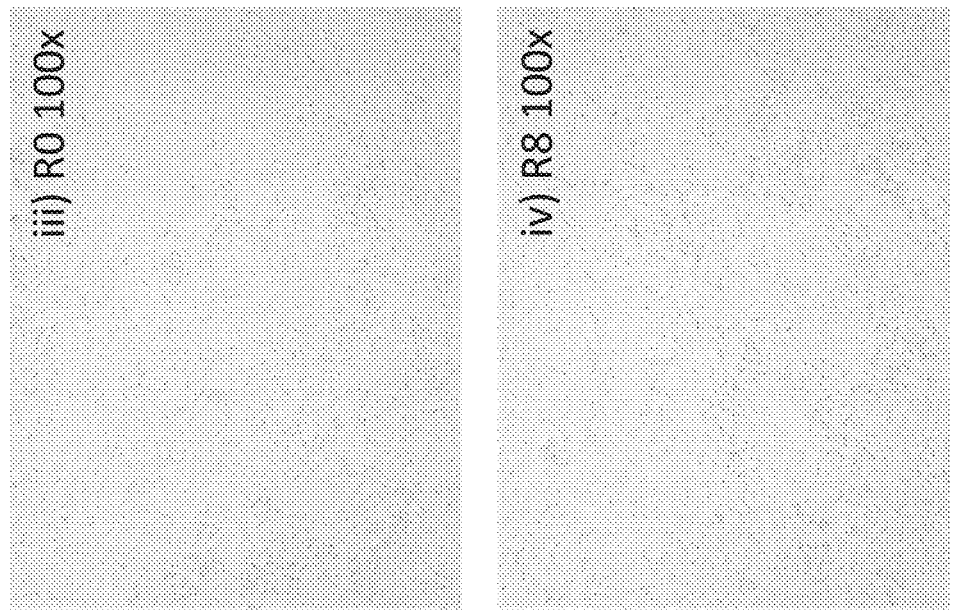
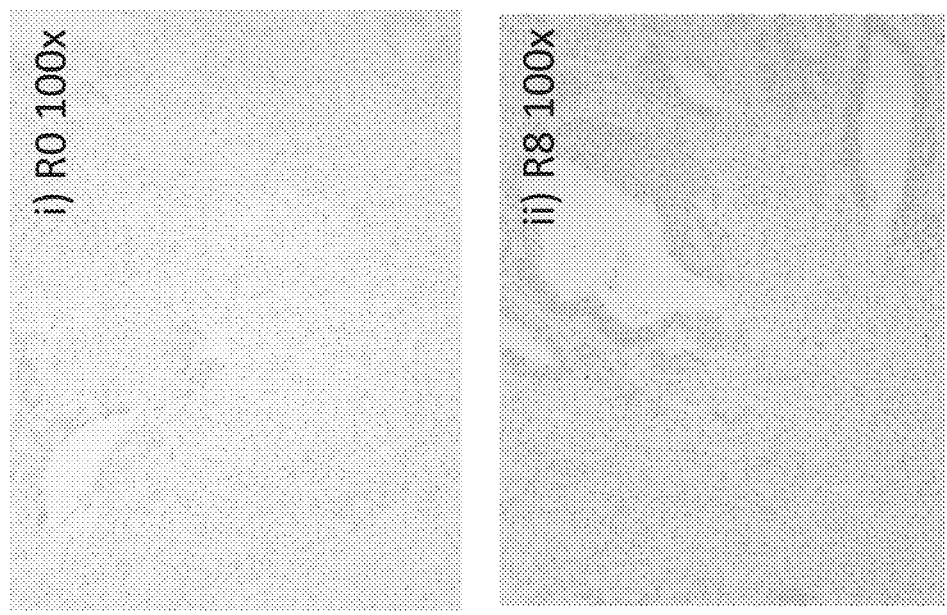
FIG. 24A

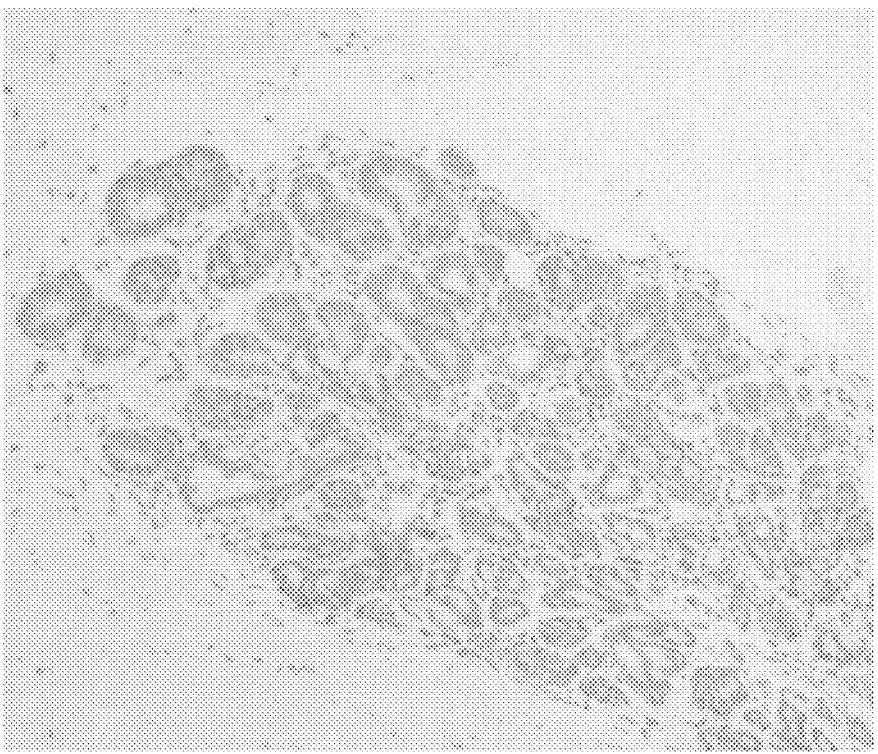
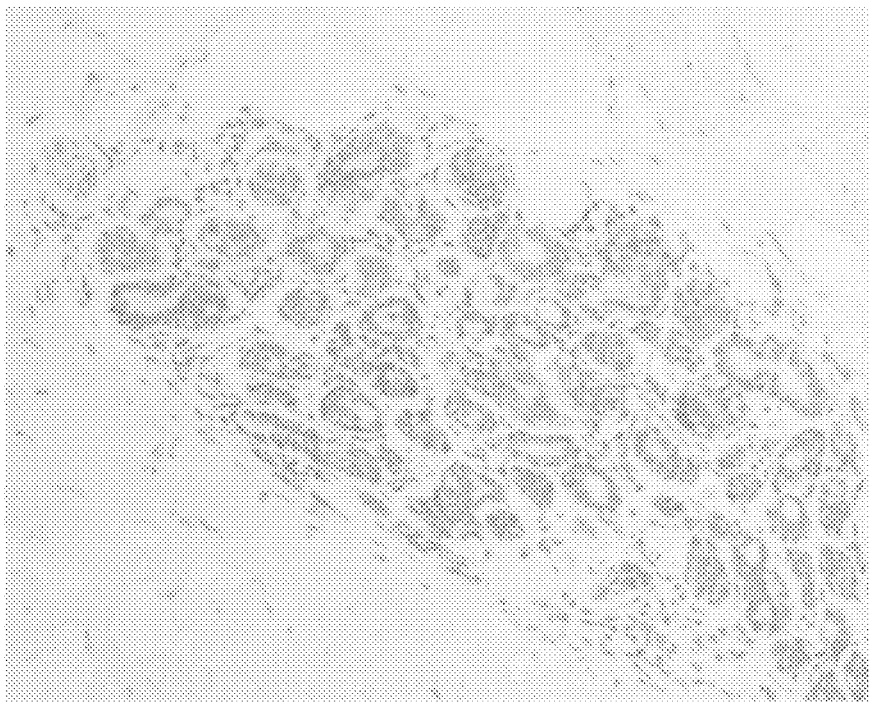
FIG. 25A

| Agent | Biomarker | Platform |
|---|---|---|
| afatinib (assoc. in NSCLC only) | EGFR | NGS Mutation |
| | ERBB2 (Her2) | NGS Mutation |
| afatinib + cetuximab (combination assoc. in NSCLC only) | EGFR T790M | NGS Mutation |
| alectinib, ceritinib | ALK | IHC; NGS Fusion Analysis (RNA) |
| aspirin (assoc. in CRC only) | PIK3CA | NGS Mutation |
| atezolizumab (assoc. in NSCLC only) | PD-L1 | IHC |
| cabozantinib | RET | NGS Fusion Analysis (RNA) |
| capecitabine, fluorouracil, pemetrexed | TS | IHC |
| carboplatin, cisplatin, oxaliplatin | ATM | NGS Mutation |
| | BRCA1[1] | NGS Mutation |
| | BRCA2 | NGS Mutation |
| | ERCC1 | IHC |
| cetuximab, panitumumab[2] (assoc. in CRC only) | BRAF | NGS Mutation |
| | KRAS | NGS Mutation |
| | NRAS | NGS Mutation |
| | PIK3CA | NGS Mutation |
| | PTEN | IHC |
| cetuximab | EGFR | NGS CNV |
| crizotinib | ALK | IHC; NGS Mutation (DNA) & Fusion Analysis (RNA) |
| | cMET | NGS Mutation, CNV (DNA) |
| | ROS1 | NGS Fusion Analysis (RNA) |
| dabrafenib, vemurafenib[3] | BRAF | NGS Mutation |
| dacarbazine, temozolomide | MGMT | IHC |
| | MGMT-Methylation | Pyrosequencing |
| | IDH1 (assoc. in High Grade Glioma only) | NGS |
| docetaxel, paclitaxel, nab-paclitaxel | TUBB3 | IHC |
| doxorubicin, liposomal-doxorubicin, epirubicin | TOP2A | IHC |
| | | CISH |
| enzalutamide, bicalutamide | AR (assoc. in TNBC only) | IHC |
| erlotinib, gefitinib (assoc. in NSCLC only) | EGFR | NGS Mutation |
| | KRAS | NGS Mutation |
| | PIK3CA | NGS Mutation |
| | cMET | NGS CNV (DNA) |
| | PTEN | IHC |

FIG. 26A

| Agent | Biomarker | Platform |
|---|---|---|
| everolimus, temsirolimus | ER (assoc. in Breast only) | IHC |
| | PIK3CA (excluding CRC) | NGS Mutation |
| exemestane + everolimus, fulvestrant, palbociclib combination therapy | ER | IHC |
| | ESR1 | NGS Mutation |
| gemcitabine | RRM1 | IHC |
| hormone therapies³ | AR | IHC |
| | ER | IHC |
| | PR | IHC |
| imatinib | cKIT | NGS Mutation |
| | PDGFRA | NGS Mutation |
| irinotecan | TOPO1 | IHC |
| topotecan (excluding Breast, CRC, NSCLC) | | |
| lapatinib, pertuzumab, T-DM1 | Her2/Neu | NGS CNV (DNA) |
| mitomycin-c | BRCA1¹ | NGS Mutation |
| | BRCA2¹ | |
| nivolumab, pembrolizumab (assoc. in Bladder, Kidney, Melanoma, NSCLC only) | PD-L1 | IHC |
| | MSI (pembrolizumab only) | FA |
| olaparib | ATM (assoc. in Prostate only) | NGS Mutation |
| | BRCA1¹ | |
| | BRCA2¹ | |
| osimertinib (assoc. in NSCLC only) | EGFR T790M | NGS Mutation |
| palbociclib (assoc. in Breast only) | ER | IHC |
| | Her2/Neu | IHC |
| sunitinib (assoc. in GIST only) | cKIT | NGS |
| trametinib² (assoc. in Melanoma only) | BRAF | NGS |
| trastuzumab | ERBB2 (Her2) (assoc. in NSCLC only) | NGS |
| | Her2/Neu | IHC; NGS CNV (DNA) |
| | PTEN (assoc. in Breast only) | IHC |
| | PIK3CA (assoc. in Breast only) | NGS Mutation |
| vandetanib | RET | NGS Mutation (DNA) & Fusion Analysis (RNA) |

FIG. 26B

OLIGONUCLEOTIDE PROBES AND USES THEREOF

CROSS REFERENCE

This application is the national stage entry of International Patent Application No. PCT/US2017/023108, filed Mar. 18, 2017, which claims the benefit of U.S. Provisional Patent Application Nos. 62/310,665, filed Mar. 18, 2016; 62/413,361, filed Oct. 26, 2016; 62/420,497, filed Nov. 10, 2016; 62/432,561, filed Dec. 9, 2016; 62/457,691, filed Feb. 10, 2017; and 62/472,953, filed Mar. 17, 2017; all of which applications are incorporated herein by reference in their entirety.

SEQUENCE LISTING SUBMITTED VIA EFS-WEB

The entire content of the following electronic submission of the sequence listing via the USPTO EFS-WEB server, as authorized and set forth in MPEP § 1730 II.B.2(a), is incorporated herein by reference in its entirety for all purposes. The sequence listing is within the electronically filed text file that is identified as follows:
  File Name: 836601_SEQUENCES.txt
  Date of Creation: Apr. 25, 2017
  Size (bytes): 40,256,522 bytes

BACKGROUND OF THE INVENTION

The invention relates generally to oligonucleotide probes, which are useful for diagnostics of cancer and/or other diseases or disorders and as therapeutics to treat such medical conditions. The invention further relates to materials and methods for the administration of oligonucleotide probes capable of binding to cells of interest.

Oligonucleotide probes, or aptamers, are oligomeric nucleic acid molecules having specific binding affinity to molecules, which may be through interactions other than classic Watson-Crick base pairing. Unless otherwise specified, an "aptamer" as the term is used herein can refer to nucleic acid molecules that can associate with targets, regardless of manner of target recognition. Unless other specified, the terms "aptamer," "oligonucleotide," "polynucleotide," "oligonucleotide probe," or the like may be used interchangeably herein.

Oligonucleotide probes, like peptides generated by phage display or monoclonal antibodies ("mAbs"), are capable of specifically binding to selected targets and modulating the target's activity, e.g., through binding aptamers may block their target's ability to function. Created by an in vitro selection process from pools of random sequence oligonucleotides, aptamers have been generated for numerous proteins including growth factors, transcription factors, enzymes, immunoglobulins, and receptors. A typical aptamer is 10-15 kDa in size (30-45 nucleotides), binds its target with sub-nanomolar affinity, and discriminates against closely related targets (e.g., aptamers can be designed to not bind other proteins from the same gene family). A series of structural studies have shown that aptamers are capable of using the same types of binding interactions (e.g., hydrogen bonding, electrostatic complementarity, hydrophobic contacts, steric exclusion) that drive affinity and specificity in antibody-antigen complexes.

We have previously identified oligonucleotides and libraries of oligonucleotides useful for the detection of microvesicles in bodily fluid samples. Microvesicles can be shed by diseased cells, such as cancer cells, into various bodily fluids such as blood. Thus provide a means of liquid biopsy, including without limitation blood based diagnostics. In some cases, tissue samples are available. The present invention provides methods of enriching oligonucleotide libraries against tissues of interest. Applications of the invention include without limitation theranostics (e.g., predicting a drug response) and diagnostics (e.g., detecting cancer samples). As the methods of the invention provide aptamers that specifically recognize diseased cells, the aptamers themselves can be used in therapeutic applications.

INCORPORATION BY REFERENCE

All publications, patents and patent applications mentioned in this specification are herein incorporated by reference to the same extent as if each individual publication, patent or patent application was specifically and individually indicated to be incorporated by reference.

SUMMARY OF THE INVENTION

Compositions and methods of the invention provide oligonucleotide probes that recognize tissues having phenotypes of interest. In various embodiments, oligonucleotide probes of the invention are used in diagnostic, prognostic or theranostic processes to characterize a phenotype of that sample. The diagnosis may be related to a cancer. In other embodiments, oligonucleotide probes of the invention are chemically modified or composed in a pharmaceutical composition for therapeutic applications.

In an aspect, the invention provides an oligonucleotide comprising a region corresponding to: a) a variable sequence as described in any one of Examples 19-31; b) a variable sequence as described in any one of Tables 20-23, 25, 27, 38-40, or 45; or c) a sequence listed in any one of SEQ ID NO. 1-206506. In some embodiments, the oligonucleotide further comprises a 5' region with sequence 5'-CTAGCATGACTGCAGTACGT (SEQ ID NO. 4), a 3' region with sequence 5'-CTGTCTCTTATACACATCTGACGCTGCCGACGA (SEQ ID NO. 5), or both. The invention further provides an oligonucleotide comprising a nucleic acid sequence or a portion thereof that is at least 50, 55, 60, 65, 70, 75, 80, 85, 90, 95, 96, 97, 98, 99 or 100 percent homologous to such oligonucleotide sequences. In a related aspect, the invention provides a plurality of oligonucleotides comprising at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, or at least 100000 different oligonucleotide sequences as described above.

In an embodiment, the oligonucleotide or the plurality of oligonucleotides comprise a DNA, RNA, 2'-O-methyl or phosphorothioate backbone, or any combination thereof. In some embodiments, the oligonucleotide or the plurality of oligonucleotides comprises at least one of DNA, RNA, PNA, LNA, UNA, and any combination thereof. The oligonucleotide or at least one member of the plurality of oligonucleotides can have at least one functional modification selected from the group consisting of DNA, RNA, biotinylation, a non-naturally occurring nucleotide, a deletion, an insertion, an addition, and a chemical modification. In some embodiments, the chemical modification comprises at least one of C18, polyethylene glycol (PEG), PEG4, PEG6, PEG8, PEG12 and digoxygenin.

The oligonucleotide or plurality of oligonucleotides of the invention can be labeled. For example, the oligonucleotide or plurality of oligonucleotides can be attached to a nanoparticle, liposome, gold, magnetic label, fluorescent label, light emitting particle, biotin moiety, or radioactive label.

In an aspect, the invention provides a method of enriching an oligonucleotide library using multiple rounds of positive and negative selection. The method of enriching a plurality of oligonucleotides may comprise: a) performing at least one round of positive selection, wherein the positive selection comprises: i) contacting at least one sample with the plurality of oligonucleotides, wherein the at least one sample comprises tissue; and ii) recovering members of the plurality of oligonucleotides that associated with the at least one sample; b) optionally performing at least one round of negative selection, wherein the negative selection comprises: i) contacting at least one additional sample with the plurality of oligonucleotides, wherein at least one additional sample comprises tissue; ii) recovering members of the plurality of oligonucleotides that did not associate with the at least one additional sample; and c) amplifying the members of the plurality of oligonucleotides recovered in at least one or step (a)(ii) and step (b)(ii), thereby enriching the oligonucleotide library. In an embodiments, the recovered members of the plurality of oligonucleotides in step (a)(ii) are used as the input for the next iteration of step (a)(i). In an embodiment, the recovered members of the plurality of oligonucleotides in step (b)(ii) are used as the input for the next iteration of step (a)(i). The unenriched oligonucleotide library may possess great diversity. For example, the unenriched oligonucleotide library may comprise at least 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 200000, 300000, 400000, 500000, $10^6$, $10^7$, $10^8$, $10^9$, $10^{10}$, $10^{11}$, $10^{12}$, $10^{13}$, $10^{14}$, $10^{15}$, $10^{16}$, $10^{17}$, or at least $10^{18}$ different oligonucleotide sequences. In an embodiment, the unenriched oligonucleotide library comprises the naïve F-Trin library as described herein.

In some embodiments of the enrichment methods of the invention, the at least one sample and/or at least one additional sample comprise fixed tissue. The fixed tissue may comprise formalin fixed paraffin embedded (FFPE) tissue. In embodiment, the FFPE tissue comprises at least one of a fixed tissue, unstained slide, bone marrow core or clot, biopsy sample, surgical sample, core needle biopsy, malignant fluid, and fine needle aspirate (FNA). The FFPE tissue can be fixed on a substrate. For example, the substrate can be a glass slide or membrane.

In some embodiment, the at least one sample and/or the at least one additional sample are fixed on different substrates. Alternately, the at least one sample and/or the at least one additional sample is fixed on a single substrate. In some embodiments, the at least one sample and/or the at least one additional sample are lysed, scraped from a substrate, or subjected to microdissection. Lysed samples can be arrayed on a substrate. In some embodiments, the substrate comprises a membrane. For example, the membrane can be a nitrocellulose membrane.

In various embodiments of the enrichment methods of the invention, the at least one sample and the at least one additional sample differ in a phenotype of interest. The at least one sample and the at least one additional sample can be from different sections of a same substrate. As a non-limiting example, the samples may comprise cancer tissue and normal adjacent tissue from a fixed tissue sample. In such cases, the at least one sample and the at least one additional sample may be scraped or microdissected from the same substrate to facilitate enrichment.

The oligonucleotide library can be enriched for analysis of any desired phenotype. In embodiments, the phenotype comprises a tissue, anatomical origin, medical condition, disease, disorder, or any combination thereof. For example, the tissue can be muscle, epithelial, connective and nervous tissue, or any combination thereof. For example, the anatomical origin can be the stomach, liver, small intestine, large intestine, rectum, anus, lungs, nose, bronchi, kidneys, urinary bladder, urethra, pituitary gland, pineal gland, adrenal gland, thyroid, pancreas, parathyroid, prostate, heart, blood vessels, lymph node, bone marrow, thymus, spleen, skin, tongue, nose, eyes, ears, teeth, uterus, vagina, testis, penis, ovaries, breast, mammary glands, brain, spinal cord, nerve, bone, ligament, tendon, or any combination thereof.

In various embodiments of the enrichment methods of the invention, the method further comprises determining a target of the enriched members of the oligonucleotide library. Techniques for such determining are provided herein.

In an aspect, the invention provides a method of characterizing a phenotype in a sample comprising: a) contacting the sample with at least one oligonucleotide or plurality of oligonucleotides; and b) identifying a presence or level of a complex formed between the at least one oligonucleotide or plurality of oligonucleotides and the sample, wherein the presence or level is used to characterize the phenotype. In a related aspect, the invention provides a method of visualizing a sample comprising: a) contacting the sample with at least one oligonucleotide or plurality of oligonucleotides; b) removing the at least one oligonucleotide or members of the plurality of oligonucleotides that do not bind the sample; and c) visualizing the at least one oligonucleotide or plurality of oligonucleotides that bound to the sample. The visualization can be used to characterize a phenotype.

The sample to be characterized can be any useful sample, including without limitation a tissue sample, bodily fluid, cell, cell culture, microvesicle, or any combination thereof. In some embodiments, the tissue sample comprises fixed tissue. The fixed tissue can be, e.g., formalin fixed paraffin embedded (FFPE) tissue. In various embodiments, the FFPE sample comprises at least one of a fixed tissue, unstained slide, bone marrow core or clot, biopsy sample, surgical sample, core needle biopsy, malignant fluid, and fine needle aspirate (FNA).

Identifying a presence or level may comprise any useful technique, including without limitation nucleic acid sequencing, amplification, hybridization, gel electrophoresis, chromatography, or visualization. In some embodiments, the identifying by hybridization comprises contacting the sample with at least one labeled probe that is configured to hybridize with at least one oligonucleotide or plurality of oligonucleotides. The at least one labeled probe can be directly or indirectly attached to a label. The label can be, e.g., a fluorescent, radioactive or magnetic label. An indirect label can be, e.g., biotin. In some embodiments, the sequencing comprises next generation sequencing, dye termination sequencing, and/or pyrosequencing of the at least one oligonucleotide or plurality of oligonucleotides. The visualization may be that of a signal linked directly or indirectly to the at least one oligonucleotide or plurality of oligonucleotides. The signal can be any useful signal, e.g., a fluorescent signal or an enzymatic signal. In some embodiments, the enzymatic signal is produced by at least one of a luciferase, firefly luciferase, bacterial luciferase, luciferin, malate dehydrogenase, urease, peroxidase, horseradish peroxidase (HRP), alkaline phosphatase (AP), β-galactosidase, glucoamylase, lysozyme, a saccharide oxidase, glucose oxidase, galactose oxidase, glucose-6-phosphate dehydrogenase, a heterocyclic oxidase, uricase, xanthine oxidase, lactoperoxidase, and microperoxidase. Visualization may comprise use of light microscopy or fluorescent microscopy.

In the methods of the invention directed to characterizing or visualizing a sample, the target of at least one of the at least one oligonucleotide or plurality of oligonucleotides may be known. For example, an oligonucleotide may bind a known protein target. In some embodiments, the target of at least one the at least one oligonucleotide or plurality of oligonucleotides is unknown. For example, the at least one oligonucleotide or plurality of oligonucleotides may themselves provide a biosignature or other useful result that does not necessarily require knowledge of the antigens bound by some or all of the oligonucleotides.

In the methods of characterizing or visualizing a sample, the at least one oligonucleotide or plurality of oligonucleotides can be as provided above. The at least one oligonucleotide or plurality of oligonucleotides may have been determined using the enrichment methods of the invention provided herein.

For example, the at least one oligonucleotide or plurality of oligonucleotides may comprise nucleic acids may have a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. In such cases, the phenotype may be, e.g., lung cancer or prostate cancer.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. In such cases, the phenotype may be, e.g., prostate cancer.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. In such cases, the phenotype may be, e.g., HER2 status (+/−).

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. In such cases, the phenotype may be, e.g., response to anti-HER2 therapy, wherein optionally the anti-HER2 therapy comprises traztuzamab.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. In such cases, the phenotype may be, e.g., response to at least one of FOLFOX and bevazicumab.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. In such cases, the phenotype may be, e.g., a tissue identity, including without limitation whether the tissue comprises breast, colon, kidney, lung or pancreatic tissue.

In the methods of the invention, including enriching an oligonucleotide library, characterizing a sample or visualizing a sample, the phenotype can be a biomarker status. In some embodiments, the biomarker is selected from Table 4. In some embodiments, the biomarker status comprises at least one of HER2 positive, HER2 negative, EGFR positive, EGFR negative, TUBB3 positive, or TUBB3 negative. In some embodiments, the biomarker status comprises expression, copy number, mutation, insertion, deletion or other alteration of at least one of ALK, AR, ER, ERCC1, Her2/Neu, MGMT, MLH, MSH2, MSH6, PD-1, PD-L1, PD-L1 (22c3), PMS2, PR, PTEN, RRM1, TLE3, TOP2A, TOPO1, TrkA, TrkB, TrkC, TS, and TUBB3. In various embodiments, the biomarker status comprises the presence or absence of at least one of EGFR vIII or MET Exon 14 Skipping. In embodiments, the biomarker status comprises expression, copy number, fusion, mutation, insertion, deletion or other alteration of at least one of ALK, BRAF, NTRK1, NTRK2, NTRK3, RET, ROS1, and RSPO3. In embodiments, the biomarker status comprises expression, copy number, fusion, mutation, insertion, deletion or other alteration of at least one of ABL2, ACSL3, ACSL6, AFF1, AFF3, AFF4, AKAP9, AKT2, AKT3, ALDH2, ALK, APC, ARFRP1, ARHGAP26, ARHGEF12, ARID1A, ARID2, ARNT, ASPSCR1, ASXL1, ATF1, ATIC, ATM, ATP1A1, ATR, AURKA, AURKB, AXIN1, AXL, BAP1, BARD1, BCL10, BCL11A, BCL2L11, BCL3, BCL6, BCL7A, BCL9, BCR, BIRC3, BLM, BMPR1A, BRAF, BRCA1, BRCA2, BRIP1, BUB1B, C11orf30 (EMSY), C2orf44, CACNA1D, CALR, CAMTA1, CANT1, CARD11, CARS, CASC5, CASP8, CBFA2T3, CBFB, CBL, CBLB, CCDC6, CCNBIP1, CCND1, CCND2, CCND3, CCNE1, CD274 (PDL1), CD74, CD79A, CDC73, CDH11, CDK4, CDK6, CDK8, CDKN1B, CDKN2A, CDX2, CHEK1, CHEK2, CHIC2, CHN1, CIC, CIITA, CLP1, CLTC, CLTCL1, CNBP, CNTRL, COPB1, CREB1, CREB3L1, CREB3L2, CREBBP, CRKL, CRTC1, CRTC3, CSF1R, CSF3R, CTCF, CTLA4, CTNNA1, CTNNB1, CYLD, CYP2D6, DAXX, DDR2, DDX10, DDX5, DDX6, DEK, DICER1, DOT1L, EBF1, ECT2L, EGFR, ELK4, ELL, EML4, EP300, EPHA3, EPHA5, EPHB1, EPS15, ERBB2 (HER2), ERBB3 (HER3), ERBB4 (HER4), ERC1, ERCC2, ERCC3, ERCC4, ERCC5, ERG, ESR1, ETV1, ETV5, ETV6, EWSR1, EXT1, EXT2, EZH2, EZR, FANCA, FANCC, FANCD2, FANCE, FANCG, FANCL, FAS, FBXO11, FBXW7, FCRL4, FGF10, FGF14, FGF19, FGF23, FGF3, FGF4, FGF6, FGFR1, FGFR1OP, FGFR2, FGFR3, FGFR4, FH, FHIT, FIP1L1, FLCN, FLI1, FLT1, FLT3, FLT4, FNBP1, FOXA1, FOXO1, FOXP1, FUBP1, FUS, GAS7, GATA3, GID4 (C17orf39), GMPS, GNA13, GNAQ, GNAS, GOLGA5, GOPC, GPHN, GPR124, GRIN2A, GSK3B, H3F3A, H3F3B, HERPUD1, HGF, HIP1, HMGA1, HMGA2, HNRNPA2B1, HOOK3, HSP90AA1, HSP90AB1, IDH1, IDH2, IGF1R, IKZF1, IL2, IL21R, IL6ST, IL7R, IRF4, ITK, JAK1, JAK2, JAK3, JAZF1, KDM5A, KDR (VEGFR2), KEAP1, KIAA1549, KIF5B, KIT, KLHL6, KMT2A (MLL), KMT2C (MLL3), KMT2D (MLL2), KRAS, KTN1, LCK, LCP1, LGR5, LHFP, LIFR, LPP, LRIG3, LRP1B, LYL1, MAF, MALT, MAML2, MAP2K1, MAP2K2, MAP2K4, MAP3K1, MCL1, MDM2, MDM4, MDS2, MEF2B, MEN1, MET (cMET), MITF, MLF1, MLH1 (NGS), MLLT1, MLLT10, MLLT3, MLLT4, MLLT6, MNX1, MRE11A, MSH2 (NGS), MSH6 (NGS), MSI2, MTOR, MYB, MYC, MYCN, MYD88, MYH11, MYH9, NACA, NCKIPSD, NCOA1, NCOA2, NCOA4, NF1, NF2, NFE2L2, NFIB, NFKB2, NFKBIA, NIN, NOTCH2, NPM1, NR4A3, NSD1, NT5C2, NTRK1, NTRK2, NTRK3, NUP214, NUP93, NUP98, NUTM1, PALB2, PAX3, PAX5, PAX7, PBRM1, PBX1, PCM1, PCSK7, PDCD1 (PD1), PDCDILG2 (PDL2), PDGFB, PDGFRA, PDGFRB, PDK1, PER1, PICALM, PIK3CA, PIK3R1, PIK3R2, PIM1, PML, PMS2 (NGS), POLE, POT1, POU2AF1, PPARG, PRCC, PRDM1, PRDM16, PRKAR1A, PRRX1, PSIP1, PTCH1, PTEN (NGS), PTPN11, PTPRC, RABEP1, RAC1, RAD50, RAD51, RAD51B, RAF1, RALGDS, RANBP17, RAP1GDS1, RARA, RB1, RBM15, REL, RET, RICTOR, RMI2, RNF43, ROS1, RPL22, RPL5, RPN1, RPTOR, RUNX1, RUNXIT1, SBDS, SDC4, SDHAF2, SDHB, SDHC, SDHD, SEPT9, SET, SETBP1, SETD2, SF3B1, SH2B3, SH3GL1, SLC34A2, SMAD2, SMAD4, SMARCB1, SMARCE1, SMO, SNX29, SOX10, SPECC1, SPEN, SRGAP3, SRSF2, SRSF3, SS18, SS18L1, STAT3, STAT4, STAT5B, STIL, STK11, SUFU, SUZ12, SYK, TAF15, TCF12, TCF3, TCF7L2, TET1, TET2, TFEB, TFG, TFRC, TGFBR2, TLX1, TNFAIP3, TNFRSF14, TNFRSF7, TOP1, TP53, TPM3, TPM4, TPR, TRAF7, TRIM26, TRIM27, TRIM33, TRIP11, TRRAP, TSC1, TSC2, TSHR, TTL, U2AF1, USP6, VEGFA, VEGFB, VTI1A, WHSC1, WHSCIL1, WIF1, WISP3, WRN, WT1, WWTR1, XPA, XPC, XPO1, YWHAE, ZMYM2, ZNF217, ZNF331, ZNF384, ZNF521, and ZNF703. The biomarker status may comprise expression, copy number, fusion, mutation, insertion, deletion or other alteration of at least one of ABI1, ABL1, ACKR3, AKT1, AMER1 (FAM123B), AR, ARAF, ATP2B3, ATRX, BCL1B, BCL2, BCL2L2, BCOR, BCORL1, BRD3, BRD4, BTG1, BTK, C15orf65, CBLC, CD79B, CDH1, CDK12, CDKN2B, CDKN2C, CEBPA, CHCHD7, CNOT3, COL1A1, COX6C, CRLF2, DDB2, DDIT3, DNM2, DNMT3A, EIF4A2, ELF4, ELN, ERCC1 (NGS), ETV4, FAM46C, FANCF, FEV, FOXL2, FOXO3, FOXO4, FSTL3, GATA1, GATA2, GNA11, GPC3, HEY1, HISTIH3B, HIST1H4I, HLF, HMGN2P46, HNF1A, HOXA11, HOXA13, HOXA9, HOXC11, HOXC13, HOXD11, HOXD13, HRAS, IKBKE, INHBA, IRS2, JUN, KAT6A (MYST3), KAT6B, KCNJ5, KDM5C, KDM6A, KDSR, KLF4, KLK2, LASP1, LMO1, LMO2, MAFB, MAX, MECOM, MED12, MKL1, MLLT11, MN1, MPL, MSN, MTCP1, MUC1, MUTYH, MYCL (MYCL1), NBN, NDRG1, NKX2-1, NONO, NOTCH1, NRAS, NUMA1, NUTM2B, OLIG2, OMD, P2RY8, PAFAHIB2, PAK3, PATZ1, PAX8, PDE4DIP, PHF6, PHOX2B, PIK3CG, PLAG1, PMS1, POU5F1, PPP2RIA, PRF1, PRKDC, RAD21, RECQL4, RHOH, RNF213, RPL10, SEPT5, SEPT6, SFPQ, SLC45A3, SMARCA4, SOCS1, SOX2, SPOP, SRC, SSX1, STAG2, TAL1, TAL2, TBL1XR1, TCEA1, TCL1A, TERT, TFE3, TFPT, THRAP3, TLX3, TMPRSS2, UBR5, VHL, WAS, ZBTB16, and ZRSR2.

In the methods of the invention, including enriching an oligonucleotide library, characterizing a sample or visualizing a sample, the phenotype can be a phenotype comprises a disease or disorder. The methods can be employed to assist in providing a diagnosis, prognosis and/or theranosis for the disease or disorder. For example, the enriching may be performed using sample such that the enriched library can be used to assist in providing a diagnosis, prognosis and/or theranosis for the disease or disorder. Similarly, the characterizing may comprise assisting in providing a diagnosis, prognosis and/or theranosis for the disease or disorder. The visualization may also comprise assisting in providing a diagnosis, prognosis and/or theranosis for the disease or disorder. In some embodiments, the theranosis comprises predicting a treatment efficacy or lack thereof, classifying a patient as a responder or non-responder to treatment, or monitoring a treatment efficacy. The theranosis can be directed to any appropriate treatment, e.g., the treatment may comprise at least one of chemotherapy, immunotherapy, targeted cancer therapy, a monoclonal antibody, an anti-HER2 antibody, trastuzumab, an anti-VEGF antibody, bevacizumab, and/or platinum/taxane therapy. In some embodiments, the treatment comprises at least one of afatinib, afatinib+cetuximab, alectinib, aspirin, atezolizumab, bicalutamide, cabozantinib, capecitabine, carboplatin, ceritinib, cetuximab, cisplatin, crizotinib, dabrafenib, dacarbazine, doxorubicin, enzalutamide, epirubicin, erlotinib, everolimus, exemestane+everolimus, fluorouracil, fulvestrant, gefitinib, gemcitabine, hormone therapies, irinotecan, lapatinib, liposomal-doxorubicin, matinib, mitomycin-c, nab-paclitaxel, nivolumab, olaparib, osimertinib, oxaliplatin, palbociclib combination therapy, paclitaxel, palbociclib, panitumumab, pembrolizumab, pemetrexed, pertuzumab, sunitinib, T-DM1, temozolomide docetaxel, temsirolimus, topotecan, trametinib, trastuzumab, vandetanib, and vemurafenib. The hormone therapy can be one or more of tamoxifen, toremifene, fulvestrant, letrozole, anastrozole, exemestane, megestrol acetate, leuprolide, goserelin, bicalutamide, flutamide, abiraterone, enzalutamide, triptorelin, abarelix, and degarelix.

In the methods of the invention directed to characterizing a sample, the characterizing may comprise comparing the presence or level to a reference. In some embodiments, the reference comprises a presence or level determined in a sample from an individual without a disease or disorder, or from an individual with a different state of a disease or disorder. The presence or level can be that of a visual level, such as an IHC score, determined by the visualizing. As a non-limiting example, the comparison to the reference of at least one oligonucleotide or plurality of oligonucleotides provided by the invention indicates that the sample comprises a cancer sample or a non-cancer/normal sample.

In some embodiments of the methods of the invention, one or more sample comprises a bodily fluid. The bodily fluid can be any useful bodily fluid, including without limitation peripheral blood, sera, plasma, ascites, urine, cerebrospinal fluid (CSF), sputum, saliva, bone marrow, synovial fluid, aqueous humor, amniotic fluid, cerumen, breast milk, bronchioalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

In the methods of the invention, including characterizing a sample or visualizing a sample, the sample can be from a subject suspected of having or being predisposed to a medical condition, disease, or disorder.

In the methods of the invention, including enriching an oligonucleotide library, characterizing a sample or visualizing a sample, the medical condition, the disease or disorder may be a cancer, a premalignant condition, an inflammatory disease, an immune disease, an autoimmune disease or disorder, a cardiovascular disease or disorder, neurological disease or disorder, infectious disease or pain. In some embodiments, the cancer comprises an acute lymphoblastic leukemia; acute myeloid leukemia; adrenocortical carcinoma; AIDS-related cancers; AIDS-related lymphoma; anal cancer; appendix cancer, astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer, gallbladder cancer, gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma hypopharyngeal cancer; intraocular melanoma; islet cell tumors; Kaposi sarcoma; kidney cancer; Langerhans cell histiocytosis; laryngeal cancer; lip cancer; liver cancer, lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer, papillomatosis; paranasal sinus cancer; parathyroid cancer; pelvic cancer, penile cancer, pharyngeal cancer, pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer, respiratory tract cancer; retinoblastoma; rhabdomyosarcoma; salivary gland cancer; Sézary syndrome; small cell lung cancer; small intestine cancer, soft tissue sarcoma; squamous cell carcinoma; squamous neck cancer, stomach (gastric) cancer; supratentorial primitive neuroectodermal tumors; T-cell lymphoma; testicular cancer; throat cancer, thymic carcinoma; thymoma; thyroid cancer, transitional cell cancer; transitional cell cancer of the renal pelvis and ureter; trophoblastic tumor; ureter cancer; urethral cancer; uterine cancer; uterine sarcoma; vaginal cancer; vulvar cancer, Waldenström macroglobulinemia; or Wilm's tumor. In some embodiments, the premalignant condition comprises Barrett's Esophagus. In some embodiments, the autoimmune disease comprises inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. In some embodiments, the cardiovascular disease comprises atherosclerosis, congestive heart failure, vulnerable plaque, stroke, ischemia, high blood pressure, stenosis, vessel occlusion or a thrombotic event. In some embodiments, the neurological disease comprises Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neuropsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. In some embodiments, the pain comprises fibromyalgia, chronic neuropathic pain, or peripheral neuropathic pain. In some embodiments, the infectious disease comprises a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, influenza.

In an aspect, the invention provides a kit comprising at least one reagent for carrying out the methods provided by the invention, including enriching an oligonucleotide library, characterizing a sample or visualizing a sample. In a related aspect, the invention provides use of at least one reagent for carrying out the methods provided by the invention, including enriching an oligonucleotide library, characterizing a sample or visualizing a sample. In some embodiments, the at least one reagent comprises an oligonucleotide or a plurality of oligonucleotides provided herein. Additional useful reagents are also provided herein. See, e.g., the protocols provided in the Examples.

In an aspect, the invention provides a method of imaging at least one cell or tissue, comprising contacting the at least one cell or tissue with at least one oligonucleotide or plurality of oligonucleotides provided herein, and detecting the at least one oligonucleotide or the plurality of oligonucleotides in contact with at least one cell or tissue.

For example, the at least one oligonucleotide or plurality of oligonucleotides may comprise nucleic acids may have a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. In such cases, the imaging may be, e.g., directed to lung or prostate tissue.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. In such cases, the phenotype may be, e.g., prostate cancer.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. In such cases, the imaging may be, e.g., directed to HER2 status of a cell or tissue.

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. In such cases, the imaging may be, e.g., directed to a HER2 status of a cell or tissue.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. In such cases, the imaging may be, e.g., directed to colorectal cells or tissue.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. In such cases, the imaging may be, e.g., directed to a tissue, including without limitation breast, colon, kidney, lung or pancreatic tissue.

In the imaging methods provided by the invention, the at least one oligonucleotide or the plurality of oligonucleotides can carry various useful chemical structures or modifications such as described herein.

In the imaging methods provided by the invention, the at least one oligonucleotide or the plurality of oligonucleotides can be administered to a subject prior to the detecting. Such method may allow imaging of at least one cell or tissue in the subject. In some embodiments, the at least one cell or tissue comprises neoplastic, malignant, tumor, hyperplastic, or dysplastic cells. In some embodiments, the at least one cell or tissue comprises at least one of lymphoma, leukemia, renal carcinoma, sarcoma, hemangiopericytoma, melanoma, abdominal cancer, gastric cancer, colon cancer, cervical cancer, prostate cancer, pancreatic cancer, breast cancer, or non-small cell lung cancer cells. In some embodiments, the at least one cell or tissue comprises a medical condition, disease or disorder.

In an aspect, the invention provides a pharmaceutical composition comprising a construct comprising a therapeutically effective amount of the at least one oligonucleotide or the plurality of oligonucleotides as provided herein, or a salt thereof, and a pharmaceutically acceptable carrier, diluent, or both. In some embodiments, the at least one oligonucleotide or the plurality of oligonucleotides associates with at least one protein listed in Table 28 herein.

For example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. Such pharmaceutical composition may be useful for therapy related to a cancer, wherein optionally the cancer comprises lung cancer or prostate cancer.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. Such pharmaceutical composition may be useful for therapy related to a cancer, wherein optionally the cancer comprises prostate cancer.

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. Such pharmaceutical composition may be useful for therapy related to a cancer, wherein optionally the cancer comprises breast cancer.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. Such pharmaceutical composition may be useful for therapy related to a cancer, wherein optionally the cancer comprises breast cancer.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. Such pharmaceutical composition may be useful for therapy related to a cancer, wherein optionally the cancer comprises colorectal cancer.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. Such pharmaceutical composition may be useful for therapy related to a cancer, wherein optionally the cancer comprises a cancer of the breast, colon, kidney, lung or pancreas.

The at least one oligonucleotide or the plurality of oligonucleotides within the pharmaceutical composition can have any useful desired chemical modification. In an embodiment, the at least one oligonucleotide or the plurality of oligonucleotides is attached to a toxin or chemotherapeutic agent. The at least one oligonucleotide or the plurality of oligonucleotides may be comprised within a multipartite construct. The at least one oligonucleotide or the plurality of oligonucleotides can be attached to a liposome or nanoparticle. In some embodiments, the liposome or nanoparticle comprises a toxin or chemotherapeutic agent.

In a related aspect, the invention provides a method of treating or ameliorating a disease or disorder in a subject in need thereof, comprising administering the pharmaceutical composition of the invention to the subject. In another related aspect, the invention provides a method of inducing cytotoxicity in a subject, comprising administering the pharmaceutical composition of the invention to the subject. Any useful means of administering can be used, including without limitation at least one of intradermal, intramuscular, intraperitoneal, intravenous, subcutaneous, intranasal, epidural, oral, sublingual, intracerebral, intravaginal, transdermal, rectal, by inhalation, topical administration, or any combination thereof.

BRIEF DESCRIPTION OF THE DRAWINGS

FIG. 1A is a schematic of a planar substrate coated with a capture agent, such as an aptamer or antibody, which captures cells or microvesicles expressing the target antigen of the capture agent. The capture agent may bind a protein expressed on the surface of the diseased cell or vesicle. The detection agent, which may also be an aptamer or antibody, carries a detectable label, here a fluorescent signal. The detection agent binds to the captured cell or microvesicle and provides a detectable signal via its fluorescent label. The detection agent can detect an antigen that is generally associated a cell-of-origin or a disease, e.g., a cancer. FIG. 1B is a schematic of a particle bead conjugated with a capture agent, which captures cells or microvesicles expressing the target antigen of the capture agent. The capture agent may bind a protein expressed on the surface of the diseased cell or vesicle. The detection agent, which may also be an aptamer or antibody, carries a detectable label, here a fluorescent signal. The detection agent binds to the captured cell or microvesicle and provides a detectable signal via its fluorescent label. The detection agent can detect an antigen that is generally associated with a cell-of-origin or a disease, e.g., a cancer.

FIG. 2A illustrates a secondary structure of a 32-mer oligonucleotide, Aptamer 4, with sequence 5'-CCCCCCGAAT-CACATGACTTGGGCGGGGGTCG (SEQ ID NO. 1). In the figure, the sequence is shown with 6 thymine nucleotides added to the end, which can act as a spacer to attach a biotin molecule. This particular oligo has a high binding affinity to the target, EpCAM. Additional candidate EpCAM binders are identified by modeling the entire database of sequenced oligos to the secondary structure of this oligo. FIG. 2B illustrates another 32-mer oligo with sequence 5'-ACCG-GATAGCGGTTGGAGGCGTGCTCCACTCG (SEQ ID NO. 2) that has a different secondary structure than the aptamer in FIG. 2A. This aptamer is also shown with a 6-thymine tail.

FIGS. 5A-5G illustrate using an oligonucleotide probe library to differentiate cancer and non-cancer samples.

FIGS. 7A-B illustrate a model generated using a training (FIG. 7A) and test (FIG. 7B) set from a round of cross validation. The AUC for the test set was 0.803. Another exemplary round of cross-validation is shown in FIGS. 7C-D with training (FIG. 7C) and test (FIG. 7D) sets. The AUC for the test set was 0.678.

FIG. 8 illustrates multipart oligonucleotide constructs.

FIG. 10A is a schematic 1000 showing an assay configuration that can be used to detect and/or quantify a target of interest. In the figure, capture aptamer 1002 is attached to substrate 1001. Target of interest 1003 is bound by capture aptamer 1002. Detection aptamer 1004 is also bound to target of interest 1003. Detection aptamer 1004 carries label 1005 which can be detected to identify target captured to substrate 1001 via capture aptamer 1002. FIG. 10B is a schematic 1010 showing use of an aptamer pool to characterize a phenotype. A pool of aptamers to a target of interest is provided 1011. The pool is contacted with a test sample to be characterized 1012. The mixture is washed to remove unbound aptamers. The remaining aptamers are disassociated and collected 1013.

The collected aptamers are identified 1014 and the identity of the retained aptamers is used to characterize the phenotype 1015. FIG. 10C is a schematic 1020 showing an implementation of the method in FIG. 10B. A pool of aptamers identified as binding a microvesicle population is provided 1019. The input sample comprises microvesicles that are isolated from a test sample 1020. The pool is contacted with the isolated microvesicles to be characterized 1023. The mixture is washed to remove unbound aptamers and the remaining aptamers are disassociated and collected 1025. The collected aptamers are identified and the identity of the retained aptamers is used to characterize the phenotype 1026. FIG. 10D provides an outline 1030 of such method. An aptamer pool is provided that has been enriched against a tissue of interest 1031. The pool is contacted with a tissue sample 1032. The tissue sample can be in a format such as described herein. As a non-limiting example, the tissue sample can be fixed tumor sample. The sample may be a FFPE sample fixed to a glass slide or membrane. The sample is washed to remove unbound members of the aptamer pool and the remaining aptamers are visualized 1033. Any appropriate method to visualize the aptamers can be used. In an example, the aptamer pool is biotinylated and the bound aptamer are visualized using streptavidin-horse radish peroxidase (SA-HRP). As described herein, other useful visualization methods are known in the art, including alternate labeling. The visualized sample is scored to determine the amount of staining 1034. For example a pathologist can score the slide as in IHC. The score can be used to characterized the sample 1035 as described herein. For example, a score of +1 or higher may indicate that the sample is a cancer sample, or is a cancer sample expressing a given biomarker.

FIGS. 15A-E show identification of oligonucleotide probes that recognize HER2+ cancer samples.

FIGS. 16A-F show oligonucleotide probes that distinguish trastuzumab responder breast cancer samples.

FIGS. 18A-G show development of oligonucleotide probes that predict the response to a combinational therapy with FOLFOX/bevacizumab in individuals diagnosed with colorectal cancer.

FIGS. 20A-D show oligonucleotide probes that distinguish tubulin 3 (TUBB3) positive and negative pancreatic cancer tissue samples.

FIGS. 21A-B show development of oligonucleotide probes that predict the response to platinum/taxane therapy in individuals diagnosed with ovarian cancer.

FIGS. 23A-D illustrate oligonucleotide probe library enrichment using lysates from fixed tissue samples.

FIGS. 24A-B illustrate oligonucleotide probe library enrichment using scraped tissue from cancer and non-cancer regions from fixed tissue samples.

FIGS. 25A-B illustrate oligonucleotide probe library enrichment using microdissection of fixed tissue samples.

FIGS. 26A-B illustrate therapeutic agents whose benefit or lack of benefit for treating a cancer may depend on a biomarker status.

DETAILED DESCRIPTION OF THE INVENTION

Figure 1A:
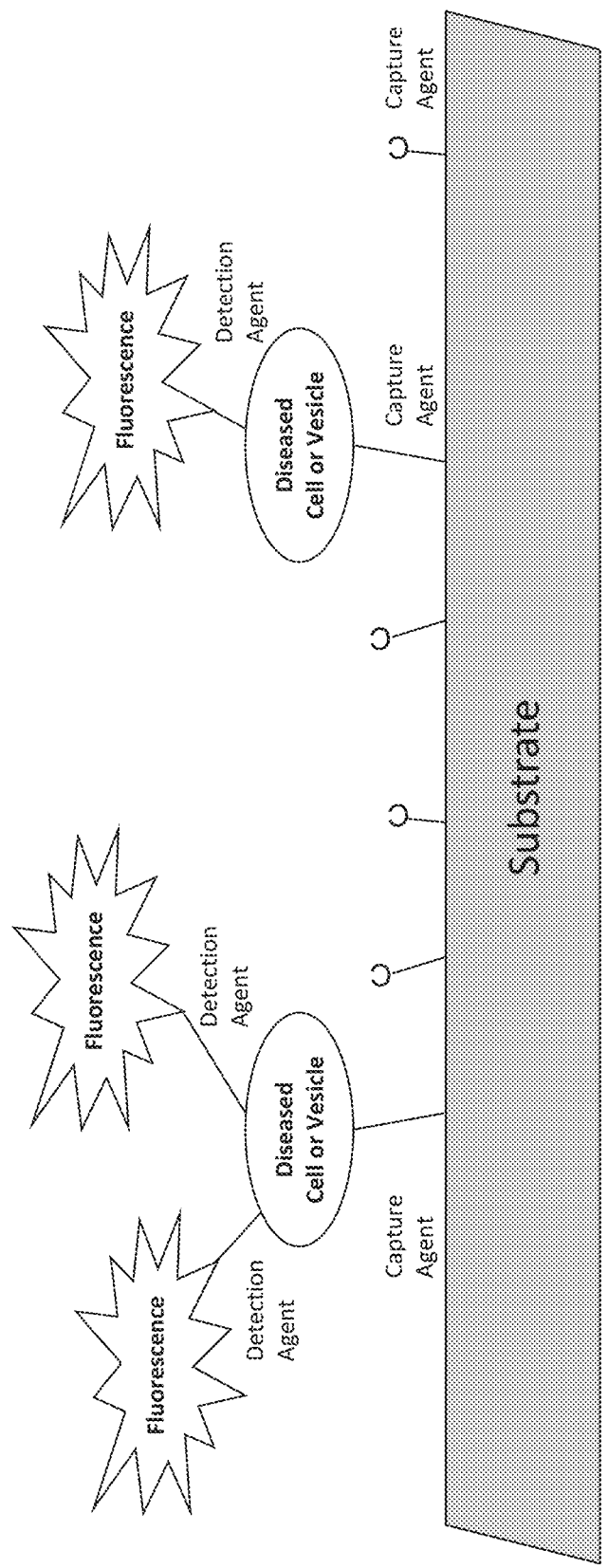
FIGS. 1A-1B illustrate methods of assessing biomarkers such as cellular or microvesicle surface antigens.

The details of one or more embodiments of the invention are set forth in the accompanying description below. Although any methods and materials similar or equivalent to those described herein can be used in the practice or testing of the present invention, the preferred methods and materials are now described. Other features, objects, and advantages of the invention will be apparent from the description. In the specification, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present Specification will control.

Disclosed herein are compositions and methods that can be used to characterize a phenotype, or assess, a biological sample. The compositions and methods of the invention comprise the use of oligonucleotide probes (aptamers) that bind biological entities of interest, including without limitation tissues, cell, microvesicles, or fragments thereof. The antigens recognized by the oligonucleotide aptamers may comprise proteins or polypeptides or any other useful biological components such as nucleic acids, lipids and/or carbohydrates. In general, the oligonucleotides disclosed are synthetic nucleic acid molecules, including DNA and RNA, and variations thereof. Unless otherwise specified, the oligonucleotide probes can be synthesized in DNA or RNA format or as hybrid molecules as desired. The methods disclosed herein comprise diagnostic, prognostic and theranostic processes and techniques using one or more aptamer of the invention. Alternatively, an oligonucleotide probe of the invention can also be used as a binding agent to capture, isolate, or enrich, a cell, cell fragment, microvesicle or any other fragment or complex that comprises the antigen or functional fragments thereof.

The compositions and methods of the invention also comprise individual oligonucleotides that can be used to assess biological samples. The invention further discloses compositions and methods of oligonucleotide pools that can be used to detect a biosignature in a sample.

Oligonucleotide probes and sequences disclosed in the compositions and methods of the invention may be identified herein in the form of DNA or RNA. Unless otherwise specified, one of skill in the art will appreciate that an oligonucleotide may generally be synthesized as either form of nucleic acid and carry various chemical modifications and remain within the scope of the invention. The term aptamer may be used in the art to refer to a single oligonucleotide that binds specifically to a target of interest through mechanisms other than Watson crick base pairing, similar to binding of a monoclonal antibody to a particular antigen. Within the scope of this disclosure and unless stated explicitly or otherwise implicit in context, the terms aptamer, oligonucleotide and oligonucleotide probe, and variations thereof, may be used interchangeably to refer to an oligonucleotide capable of distinguishing biological entities of interest (e.g., tissues, cells, microvesicles, biomarkers) whether or not the specific entity has been identified or whether the precise mode of binding has been determined.

An oligonucleotide probe or plurality of such probes of the invention can also be used to provide in vitro or in vivo detection or imaging and to provide diagnostic readouts, including for diagnostic, prognostic or theranostic purposes.

Separately, an oligonucleotide probe of the invention can also be used for treatment or as a therapeutic to specifically target a cell, tissue, organ or the like. As the invention provides methods to identify oligonucleotide probes that bind to specific tissues, cells, microvesicles or other biological entities of interest, the oligonucleotide probes of the invention target such entities and are inherently drug candidates, agents that can be used for targeted drug delivery, or both.

Phenotypes

Disclosed herein are products and processes for characterizing a phenotype using the methods and compositions of the invention. The term "phenotype" as used herein can mean any trait or characteristic that can be identified using in part or in whole the compositions and/or methods of the invention. For example, a phenotype can be a diagnostic, prognostic or theranostic determination based on a characterized biomarker profile for a sample obtained from a subject. A phenotype can be any observable characteristic or trait of, such as a disease or condition, a stage of a disease or condition, susceptibility to a disease or condition, prognosis of a disease stage or condition, a physiological state, or response/potential response to therapeutics. A phenotype can result from a subject's genetic makeup as well as the influence of environmental factors and the interactions between the two, as well as from epigenetic modifications to nucleic acid sequences.

A phenotype in a subject can be characterized by obtaining a biological sample from a subject and analyzing the sample using the compositions and/or methods of the invention. For example, characterizing a phenotype for a subject or individual can include detecting a disease or condition (including presymptomatic early stage detecting), determining a prognosis, diagnosis, or theranosis of a disease or condition, or determining the stage or progression of a disease or condition. Characterizing a phenotype can include identifying appropriate treatments or treatment efficacy for specific diseases, conditions, disease stages and condition stages, predictions and likelihood analysis of disease progression, particularly disease recurrence, metastatic spread or disease relapse. A phenotype can also be a clinically distinct type or subtype of a condition or disease, such as a cancer or tumor. Phenotype determination can also be a determination of a physiological condition, or an assessment of organ distress or organ rejection, such as post-transplantation. The compositions and methods described herein allow assessment of a subject on an individual basis, which can provide benefits of more efficient and economical decisions in treatment.

In an aspect, the invention relates to the analysis of tissues, microvesicles, and circulating biomarkers to provide a diagnosis, prognosis, and/or theranosis of a disease or condition. Theranostics includes diagnostic testing that provides the ability to affect therapy or treatment of a disease or disease state. Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, precision medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, analysis using the compositions and methods of the invention may indicate that treatment should be altered to select a more promising treatment, thereby avoiding the great expense of delaying beneficial treatment and avoiding the financial and morbidity costs of administering an ineffective drug(s).

In assessing a phenotype, a biosignature can be analyzed in the subject and compared against that of previous subjects that were known to respond or not to a treatment. The biosignature may comprise certain biomarkers or may comprise certain detection agents, such as the oligonucleotide probes as provided herein. If the biosignature in the subject more closely aligns with that of previous subjects that were known to respond to the treatment, the subject can be characterized, or predicted, as a responder to the treatment. Similarly, if the biomarker profile in the subject more closely aligns with that of previous subjects that did not respond to the treatment, the subject can be characterized, or predicted as a non-responder to the treatment. The treatment can be for any appropriate disease, disorder or other condition, including without limitation those disclosed herein.

In some embodiments, the phenotype comprises a medical condition including without limitation a disease or disorder listed in Table 1. For example, the phenotype can comprise detecting the presence of or likelihood of developing a tumor, neoplasm, or cancer, or characterizing the tumor, neoplasm, or cancer (e.g., stage, grade, aggressiveness, likelihood of metastasis or recurrence, etc). Cancers that can be detected or assessed by methods or compositions described herein include, but are not limited to, breast cancer, ovarian cancer, lung cancer, colon cancer, hyperplastic polyp, adenoma, colorectal cancer, high grade dysplasia, low grade dysplasia, prostatic hyperplasia, prostate cancer, melanoma, pancreatic cancer, brain cancer (such as a glioblastoma), hematological malignancy, hepatocellular carcinoma, cervical cancer, endometrial cancer, head and neck cancer, esophageal cancer, gastrointestinal stromal tumor (GIST), renal cell carcinoma (RCC) or gastric cancer. The colorectal cancer can be CRC Dukes B or Dukes C-D. The hematological malignancy can be B-Cell Chronic Lymphocytic Leukemia, B-Cell Lymphoma-DLBCL, B-Cell Lymphoma-DLBCL-germinal center-like, B-Cell Lymphoma-DLBCL-activated B-cell-like, and Burkitt's lymphoma.

The phenotype can be a premalignant condition, such as actinic keratosis, atrophic gastritis, leukoplakia, erythroplasia, Lymphomatoid Granulomatosis, preleukemia, fibrosis, cervical dysplasia, uterine cervical dysplasia, xeroderma pigmentosum, Barrett's Esophagus, colorectal polyp, or other abnormal tissue growth or lesion that is likely to develop into a malignant tumor. Transformative viral infections such as HIV and HPV also present phenotypes that can be assessed according to the invention.

A cancer characterized by the compositions and methods of the invention can comprise, without limitation, a carcinoma, a sarcoma, a lymphoma or leukemia, a germ cell tumor, a blastoma, or other cancers. Carcinomas include without limitation epithelial neoplasms, squamous cell neoplasms squamous cell carcinoma, basal cell neoplasms basal cell carcinoma, transitional cell papillomas and carcinomas, adenomas and adenocarcinomas (glands), adenoma, adenocarcinoma, linitis plastica insulinoma, glucagonoma, gastrinoma, vipoma, cholangiocarcinoma, hepatocellular carcinoma, adenoid cystic carcinoma, carcinoid tumor of appendix, prolactinoma, oncocytoma, hurthle cell adenoma, renal cell carcinoma, grawitz tumor, multiple endocrine adenomas, endometrioid adenoma, adnexal and skin appendage neoplasms, mucoepidermoid neoplasms, cystic, mucinous and serous neoplasms, cystadenoma, pseudomyxoma peritonei, ductal, lobular and medullary neoplasms, acinar cell neoplasms, complex epithelial neoplasms, warthin's tumor, thymoma, specialized gonadal neoplasms, sex cord stromal tumor, thecoma, granulosa cell tumor, arrhenoblastoma, sertoli leydig cell tumor, *glomus* tumors, paraganglioma, pheochromocytoma, *glomus* tumor, nevi and melanomas, melanocytic nevus, malignant melanoma, melanoma, nodular melanoma, dysplastic nevus, lentigo maligna melanoma, superficial spreading melanoma, and malignant acral lentiginous melanoma. Sarcoma includes without limitation Askin's tumor, botryodies, chondrosarcoma, Ewing's sarcoma, malignant hemangio endothelioma, malignant schwannoma, osteosarcoma, soft tissue sarcomas including: alveolar soft part sarcoma, angiosarcoma, cystosarcoma phyllodes, dermatofibrosarcoma, desmoid tumor, desmoplastic small round cell tumor, epithelioid sarcoma, extraskeletal chondrosarcoma, extraskeletal osteosarcoma, fibrosarcoma, hemangiopericytoma, hemangiosarcoma, kaposi's sarcoma, leiomyosarcoma, liposarcoma, lymphangiosarcoma, lymphosarcoma, malignant fibrous histiocytoma, neurofibrosarcoma, rhabdomyosarcoma, and synovialsarcoma. Lymphoma and leukemia include without limitation chronic lymphocytic leukemia/small lymphocytic lymphoma, B-cell prolymphocytic leukemia, lymphoplasmacytic lymphoma (such as waldenström macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nmzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezary syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical hodgkin lymphomas (nodular sclerosis, mixed cellularity, lymphocyte-rich, lymphocyte depleted or not depleted), and nodular lymphocyte-predominant hodgkin lymphoma. Germ cell tumors include without limitation germinoma, dysgerminoma, seminoma, nongerminomatous germ cell tumor, embryonal carcinoma, endodermal sinus turmor, choriocarcinoma, teratoma, polyembryoma, and gonadoblastoma. Blastoma includes without limitation nephroblastoma, medulloblastoma, and retinoblastoma. Other cancers include without limitation labial carcinoma, larynx carcinoma, hypopharynx carcinoma, tongue carcinoma, salivary gland carcinoma, gastric carcinoma, adenocarcinoma, thyroid cancer (medullary and papillary thyroid carcinoma), renal carcinoma, kidney parenchyma carcinoma, cervix carcinoma, uterine corpus carcinoma, endometrium carcinoma, chorion carcinoma, testis carcinoma, urinary carcinoma, melanoma, brain tumors such as glioblastoma, astrocytoma, meningioma, medulloblastoma and peripheral neuroectodermal tumors, gall bladder carcinoma, bronchial carcinoma, multiple myeloma, basalioma, teratoma, retinoblastoma, choroidea melanoma, seminoma, rhabdomyosarcoma, craniopharyngeoma, osteosarcoma, chondrosarcoma, myosarcoma, liposarcoma, fibrosarcoma, Ewing sarcoma, and plasmocytoma.

In a further embodiment, the cancer under analysis may be a lung cancer including non-small cell lung cancer and small cell lung cancer (including small cell carcinoma (oat cell cancer), mixed small cell/large cell carcinoma, and combined small cell carcinoma), colon cancer, breast cancer, prostate cancer, liver cancer, pancreas cancer, brain cancer, kidney cancer, ovarian cancer, stomach cancer, skin cancer, bone cancer, gastric cancer, breast cancer, pancreatic cancer, glioma, glioblastoma, hepatocellular carcinoma, papillary renal carcinoma, head and neck squamous cell carcinoma, leukemia, lymphoma, myeloma, or a solid tumor.

In embodiments, the cancer comprises an acute lymphoblastic leukemia; acute myeloid leukemia; adrenocortical carcinoma; AIDS-related cancers; AIDS-related lymphoma; anal cancer; appendix cancer, astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer, gallbladder cancer; gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer, malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasa cell neoplasm; mycosis fungoides; myelodysplastic syndromes;

myeloproliferative neoplasms; nasal cavity cancer, nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer, ovarian epithelial cancer; ovarian germ cell tumor; ovarian low malignant potential tumor, pancreatic cancer; papillomatosis; paranasal sinus cancer; parathyroid cancer; pelvic cancer, penile cancer; pharyngeal cancer; pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer, retinoblastoma; rhabdomyosarcoma; salivary gland cancer; Sdzary syndrome; small cell lung cancer, small intestine cancer; soft tissue sarcoma; squamous cell carcinoma; squamous neck cancer, stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter; trophoblastic tumor; ureter cancer; urethral cancer; uterine cancer; uterine sarcoma; vaginal cancer, vulvar cancer; Waldenstrbm macroglobulinemia; or Wilm's tumor. The methods of the invention can be used to characterize these and other cancers. Thus, characterizing a phenotype can be providing a diagnosis, prognosis or theranosis of one of the cancers disclosed herein.

In some embodiments, the cancer comprises an acute myeloid leukemia (AML), breast carcinoma, cholangiocarcinoma, colorectal adenocarcinoma, extrahepatic bile duct adenocarcinoma, female genital tract malignancy, gastric adenocarcinoma, gastroesophageal adenocarcinoma, gastrointestinal stromal tumors (GIST), glioblastoma, head and neck squamous carcinoma, leukemia, liver hepatocellular carcinoma, low grade glioma, lung bronchioloalveolar carcinoma (BAC), lung non-small cell lung cancer (NSCLC), lung small cell cancer (SCLC), lymphoma, male genital tract malignancy, malignant solitary fibrous tumor of the pleura (MSFT), melanoma, multiple myeloma, neuroendocrine tumor, nodal diffuse large B-cell lymphoma, non epithelial ovarian cancer (non-EOC), ovarian surface epithelial carcinoma, pancreatic adenocarcinoma, pituitary carcinomas, oligodendroglioma, prostatic adenocarcinoma, retroperitoneal or peritoneal carcinoma, retroperitoneal or peritoneal sarcoma, small intestinal malignancy, soft tissue tumor, thymic carcinoma, thyroid carcinoma, or uveal melanoma. The methods of the invention can be used to characterize these and other cancers. Thus, characterizing a phenotype can be providing a diagnosis, prognosis or theranosis of one of the cancers disclosed herein.

The phenotype can also be an inflammatory disease, immune disease, or autoimmune disease. For example, the disease may be inflammatory bowel disease (IBD), Crohn's disease (CD), ulcerative colitis (UC), pelvic inflammation, vasculitis, psoriasis, diabetes, autoimmune hepatitis, Multiple Sclerosis, Myasthenia Gravis, Type I diabetes, Rheumatoid Arthritis, Psoriasis, Systemic Lupus Erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis.

The phenotype can also comprise a cardiovascular disease, such as atherosclerosis, congestive heart failure, vulnerable plaque, stroke, or ischemia. The cardiovascular disease or condition can be high blood pressure, stenosis, vessel occlusion or a thrombotic event.

The phenotype can also comprise a neurological disease, such as Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The phenotype may also be a condition such as fibromyalgia, chronic neuropathic pain, or peripheral neuropathic pain.

The phenotype may also comprise an infectious disease, such as a bacterial, viral or yeast infection. For example, the disease or condition may be Whipple's Disease, Prion Disease, cirrhosis, methicillin-resistant *Staphylococcus aureus*, HIV, hepatitis, syphilis, meningitis, malaria, tuberculosis, or influenza. Viral proteins, such as HIV or HCV-like particles can be assessed in a vesicle, to characterize a viral condition.

The phenotype can also comprise a perinatal or pregnancy related condition (e.g. preeclampsia or preterm birth), metabolic disease or condition, such as a metabolic disease or condition associated with iron metabolism. For example, hepcidin can be assayed in a vesicle to characterize an iron deficiency. The metabolic disease or condition can also be diabetes, inflammation, or a perinatal condition.

The compositions and methods of the invention can be used to characterize these and other diseases and disorders. Thus, characterizing a phenotype can be providing a diagnosis, prognosis or theranosis of a medical condition, disease or disorder, including without limitation one of the diseases and disorders disclosed herein.

Subject

One or more phenotypes of a subject can be determined by analyzing a biological sample obtained from the subject. A subject or patient can include, but is not limited to, mammals such as bovine, avian, canine, equine, feline, ovine, porcine, or primate animals (including humans and non-human primates). A subject can also include a mammal of importance due to being endangered, such as a Siberian tiger; or economic importance, such as an animal raised on a farm for consumption by humans, or an animal of social importance to humans, such as an animal kept as a pet or in a zoo. Examples of such animals include, but are not limited to, carnivores such as cats and dogs; swine including pigs, hogs and wild boars; ruminants or ungulates such as cattle, oxen, sheep, giraffes, deer, goats, bison, camels or horses. Also included are birds that are endangered or kept in zoos, as well as fowl and more particularly domesticated fowl, e.g., poultry, such as turkeys and chickens, ducks, geese, guinea fowl. Also included are domesticated swine and horses (including race horses). In addition, any animal species connected to commercial activities are also included such as those animals connected to agriculture and aquaculture and other activities in which disease monitoring, diagnosis, and therapy selection are routine practice in husbandry for economic productivity and/or safety of the food chain.

The subject can have a pre-existing disease or condition, including without limitation cancer. Alternatively, the subject may not have any known pre-existing condition. The subject may also be non-responsive to an existing or past treatment, such as a treatment for cancer.

Samples

A sample used and/or assessed via the compositions and methods of the invention includes any relevant biological sample that can be used to characterize a phenotype of interest, including without limitation sections of tissues such as biopsy or tissue removed during surgical or other procedures, bodily fluids, autopsy samples, frozen sections taken for histological purposes, and cell cultures. Such samples include blood and blood fractions or products (e.g., serum, buffy coat, plasma, platelets, red blood cells, and the like), sputum, malignant effusion, cheek cells tissue, cultured cells (e.g., primary cultures, explants, and transformed cells), stool, urine, other biological or bodily fluids (e.g., prostatic fluid, gastric fluid, intestinal fluid, renal fluid, lung fluid, cerebrospinal fluid, and the like), etc. The sample can comprise biological material that is a fresh frozen & formalin fixed paraffin embedded (FFPE) block, formalin-fixed paraffin embedded, or is within an RNA preservative+ formalin fixative. More than one sample of more than one type can be used for each patient.

The sample used in the methods described herein can be a formalin fixed paraffin embedded (FFPE) sample. The FFPE sample can be one or more of fixed tissue, unstained slides, bone marrow core or clot, core needle biopsy, malignant fluids and fine needle aspirate (FNA). In an embodiment, the fixed tissue comprises a tumor containing formalin fixed paraffin embedded (FFPE) block from a surgery or biopsy. In another embodiment, the unstained slides comprise unstained, charged, unbaked slides from a paraffin block. In another embodiment, bone marrow core or clot comprises a decalcified core. A formalin fixed core and/or clot can be paraffin-embedded. In still another embodiment, the core needle biopsy comprises 1, 2, 3, 4, 5, 6, 7, 8, 9, 10 or more, e.g., 3-6, paraffin embedded biopsy samples. An 18 gauge needle biopsy can be used. The malignant fluid can comprise a sufficient volume of fresh pleural/ascitic fluid to produce a 5×5×2 mm cell pellet. The fluid can be formalin fixed in a paraffin block. In an embodiment, the core needle biopsy comprises 1, 2, 3, 4, 5, 6, 7, 8, 9, 10 or more, e.g., 4-6, paraffin embedded aspirates.

A sample may be processed according to techniques understood by those in the art. A sample can be without limitation fresh, frozen or fixed cells or tissue. In some embodiments, a sample comprises formalin-fixed paraffin-embedded (FFPE) tissue, fresh tissue or fresh frozen (FF) tissue. A sample can comprise cultured cells, including primary or immortalized cell lines derived from a subject sample. A sample can also refer to an extract from a sample from a subject. For example, a sample can comprise DNA, RNA or protein extracted from a tissue or a bodily fluid. Many techniques and commercial kits are available for such purposes. The fresh sample from the individual can be treated with an agent to preserve RNA prior to further processing, e.g., cell lysis and extraction. Samples can include frozen samples collected for other purposes. Samples can be associated with relevant information such as age, gender, and clinical symptoms present in the subject; source of the sample; and methods of collection and storage of the sample. A sample is typically obtained from a subject, e.g., a human subject.

A biopsy comprises the process of removing a tissue sample for diagnostic or prognostic evaluation, and to the tissue specimen itself. Any biopsy technique known in the art can be applied to the molecular profiling methods of the present invention. The biopsy technique applied can depend on the tissue type to be evaluated (e.g., colon, prostate, kidney, bladder, lymph node, liver, bone marrow, blood cell, lung, breast, etc.), the size and type of the tumor (e.g., solid or suspended, blood or ascites), among other factors. Representative biopsy techniques include, but are not limited to, excisional biopsy, incisional biopsy, needle biopsy, surgical biopsy, and bone marrow biopsy. An "excisional biopsy" refers to the removal of an entire tumor mass with a small margin of normal tissue surrounding it. An "incisional biopsy" refers to the removal of a wedge of tissue that includes a cross-sectional diameter of the tumor. The invention can make use a "core-needle biopsy" of the tumor mass, or a "fine-needle aspiration biopsy" which generally obtains a suspension of cells from within the tumor mass. Biopsy techniques are discussed, for example, in Harrison's Principles of Internal Medicine, Kasper, et al., eds., 16th ed., 2005, Chapter 70, and throughout Part V.

Standard molecular biology techniques known in the art and not specifically described are generally followed as in Sambrook et al., Molecular Cloning: A Laboratory Manual, Cold Spring Harbor Laboratory Press, New York (1989), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) can be carried out generally as in PCR Protocols: A Guide to Methods and Applications, Academic Press, San Diego, Calif. (1990).

The biological sample assessed using the compositions and methods of the invention can be any useful bodily or biological fluid, including but not limited to peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen (including prostatic fluid), Cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids, cells, cell culture, or a cell culture supernatant. A biological sample may also include the blastocyl cavity, umbilical cord blood, or maternal circulation which may be of fetal or maternal origin. The biological sample may also be a cell culture, tissue sample or biopsy from which microvesicles, circulating tumor cells (CTCs), and other circulating biomarkers may be obtained. For example, cells of interest can be cultured and microvesicles isolated from the culture. In various embodiments, biomarkers or more particularly biosignatures disclosed herein can be assessed directly from such biological samples (e.g., identification of presence or levels of nucleic acid or polypeptide biomarkers or functional fragments thereof) using various methods, such as extraction of nucleic acid molecules from blood, plasma, serum or any of the foregoing biological samples, use of protein or antibody arrays to identify polypeptide (or functional fragment) biomarker(s), as well as other array, sequencing, PCR and proteomic techniques known in the art for identification and assessment of nucleic acid and polypeptide molecules. In addition, one or more components present in such samples can be first isolated or enriched and further processed to assess the presence or levels of selected biomarkers, to assess a given biosignature (e.g., isolated microvesicles prior to profiling for protein and/or nucleic acid biomarkers).

Table 1 presents a non-limiting listing of diseases, conditions, or biological states and corresponding biological samples that may be used for analysis according to the methods of the invention.

TABLE 1

Examples of Biological Samples for Various Diseases, Conditions, or Biological States

| Illustrative Disease, Condition or Biological State | Illustrative Biological Samples |
| --- | --- |
| Cancers/neoplasms affecting the following tissue types/bodily systems: breast, lung, ovarian, colon, rectal, prostate, pancreatic, brain, bone, connective tissue, glands, skin, lymph, nervous system, endocrine, germ cell, genitourinary, hematologic/blood, bone marrow, muscle, eye, esophageal, fat tissue, thyroid, pituitary, spinal cord, bile duct, heart, gall bladder, bladder, testes, cervical, endometrial, renal, ovarian, digestive/gastrointestinal, stomach, head and neck, liver, leukemia, respiratory/thoracic, cancers of unknown primary (CUP) | Tumor, blood, serum, plasma, cerebrospinal fluid (CSF), urine, sputum, ascites, synovial fluid, semen, nipple aspirates, saliva, bronchoalveolar lavage fluid, tears, oropharyngeal washes, feces, peritoneal fluids, pleural effusion, sweat, tears, aqueous humor, pericardial fluid, lymph, chyme, chyle, bile, stool water, amniotic fluid, breast milk, pancreatic juice, cerumen, Cowper's fluid or pre-ejaculatory fluid, female ejaculate, interstitial fluid, menses, mucus, pus, sebum, vaginal lubrication, vomit |
| Neurodegenerative/neurological disorders: Parkinson's disease, Alzheimer's Disease and multiple sclerosis, Schizophrenia, and bipolar disorder, spasticity disorders, epilepsy | Blood, serum, plasma, CSF, urine |
| Cardiovascular Disease: atherosclerosis, cardiomyopathy, endocarditis, vunerable plaques, infection | Blood, serum, plasma, CSF, urine |
| Stroke: ischemic, intracerebral hemorrhage, subarachnoid hemorrhage, transient ischemic attacks (TIA) | Blood, serum, plasma, CSF, urine |
| Pain disorders: peripheral neuropathic pain and chronic neuropathic pain, and fibromyalgia, | Blood, serum, plasma, CSF, urine |
| Autoimmune disease: systemic and localized diseases, rheumatic disease, Lupus, Sjogren's syndrome | Blood, serum, plasma, CSF, urine, synovial fluid |
| Digestive system abnormalities: Barrett's esophagus, irritable bowel syndrome, ulcerative colitis, Crohn's disease, Diverticulosis and Diverticulitis, Celiac Disease | Blood, serum, plasma, CSF, urine |
| Endocrine disorders: diabetes mellitus, various forms of Thyroiditis, adrenal disorders, pituitary disorders | Blood, serum, plasma, CSF, urine |
| Diseases and disorders of the skin: psoriasis | Blood, serum, plasma, CSF, urine, synovial fluid, tears |
| Urological disorders: benign prostatic hypertrophy (BPH), polycystic kidney disease, interstitial cystitis | Blood, serum, plasma, urine |
| Hepatic disease/injury: Cirrhosis, induced hepatotoxicity (due to exposure to natural or synthetic chemical sources) | Blood, serum, plasma, urine |
| Kidney disease/injury: acute, sub-acute, chronic conditions, Podocyte injury, focal segmental glomerulosclerosis | Blood, serum, plasma, urine |
| Endometriosis | Blood, serum, plasma, urine, vaginal fluids |
| Osteoporosis | Blood, serum, plasma, urine, synovial fluid |
| Pancreatitis | Blood, serum, plasma, urine, pancreatic juice |
| Asthma | Blood, serum, plasma, urine, sputum, bronchiolar lavage fluid |
| Allergies | Blood, serum, plasma, urine, sputum, bronchiolar lavage fluid |
| Prion-related diseases | Blood, serum, plasma, CSF, urine |
| Viral Infections: HIV/AIDS | Blood, serum, plasma, urine |
| Sepsis | Blood, serum, plasma, urine, tears, nasal lavage |
| Organ rejection/transplantation | Blood, serum, plasma, urine, various lavage fluids |
| Differentiating conditions: adenoma versus hyperplastic polyp, irritable bowel syndrome (IBS) versus normal, classifying Dukes stages A, B, C, and/or D of colon cancer, adenoma with low-grade hyperplasia versus high-grade hyperplasia, adenoma versus normal, colorectal cancer versus normal, IBS versus. ulcerative colitis (UC) versus Crohn's disease (CD), | Blood, serum, plasma, urine, sputum, feces, colonic lavage fluid |

TABLE 1-continued

Examples of Biological Samples for Various Diseases, Conditions, or Biological States

| Illustrative Disease, Condition or Biological State | Illustrative Biological Samples |
|---|---|
| Pregnancy related physiological states, conditions, or affiliated diseases: genetic risk, adverse pregnancy outcomes | Maternal serum, plasma, amniotic fluid, cord blood |

The methods of the invention can be used to characterize a phenotype using a blood sample or blood derivative. Blood derivatives include plasma and serum. Blood plasma is the liquid component of whole blood, and makes up approximately 55% of the total blood volume. It is composed primarily of water with small amounts of minerals, salts, ions, nutrients, and proteins in solution. In whole blood, red blood cells, leukocytes, and platelets are suspended within the plasma. Blood serum refers to blood plasma without fibrinogen or other clotting factors (i.e., whole blood minus both the cells and the clotting factors).

The biological sample may be obtained through a third party, such as a party not performing the analysis of the sample. For example, the sample may be obtained through a clinician, physician, or other health care manager of a subject from which the sample is derived. Alternatively, the biological sample may obtained by the same party analyzing the sample. In addition, biological samples be assayed, are archived (e.g., frozen) or ortherwise stored in under preservative conditions.

In various embodiments, the biological sample comprises a microvesicle or cell membrane fragment that is derived from a cell of origin and available extracellularly in a subject's biological fluid or extracellular milieu. Methods of the invention may include assessing one or more such microvesicles, including assessing populations thereof. A vesicle or microvesicle, as used herein, is a membrane vesicle that is shed from cells. Vesicles or membrane vesicles include without limitation: circulating microvesicles (cMVs), microvesicle, exosome, nanovesicle, dexosome, bleb, blebby, prostasome, microparticle, intralumenal vesicle, membrane fragment, intralumenal endosomal vesicle, endosomal-like vesicle, exocytosis vehicle, endosome vesicle, endosomal vesicle, apoptotic body, multivesicular body, secretory vesicle, phospholipid vesicle, liposomal vesicle, argosome, texasome, secresome, tolerosome, melanosome, oncosome, or exocytosed vehicle. Furthermore, although vesicles may be produced by different cellular processes, the methods of the invention are not limited to or reliant on any one mechanism, insofar as such vesicles are present in a biological sample and are capable of being characterized by the methods disclosed herein. Unless otherwise specified, methods that make use of a species of vesicle can be applied to other types of vesicles. Vesicles comprise spherical structures with a lipid bilayer similar to cell membranes which surrounds an inner compartment which can contain soluble components, sometimes referred to as the payload. In some embodiments, the methods of the invention make use of exosomes, which are small secreted vesicles of about 40-100 nm in diameter. For a review of membrane vesicles, including types and characterizations, see Thery et al., Nat Rev Immunol. 2009 August; 9(8):581-93. Some properties of different types of vesicles include those in Table 2:

TABLE 2

Vesicle Properties

| Feature | Exosomes | Microvesicles | Ectosomes | Membrane particles | Exosome-like vesicles | Apoptotic vesicles |
|---|---|---|---|---|---|---|
| Size | 50-100 nm | 100-1,000 nm | 50-200 nm | 50-80 nm | 20-50 nm | 50-500 nm |
| Density in sucrose | 1.13-1.19 g/ml | | | 1.04-1.07 g/ml | 1.1 g/ml | 1.16-1.28 g/ml |
| EM appearance | Cup shape | Irregular shape, electron dense | Bilamellar round structures | Round | Irregular shape | Heterogeneous |
| Sedimentation | 100,000 g | 10,000 g | 160,000-200,000 g | 100,000-200,000 g | 175,000 g | 1,200 g, 10,000 g, 100,000 g |
| Lipid composition | Enriched in cholesterol, sphingomyelin and ceramide; contains lipid rafts; expose PPS | Expose PPS | Enriched in cholesterol and diacylglycerol; expose PPS | | No lipid rafts | |
| Major protein markers | Tetraspanins (e.g., CD63, CD9), Alix, TSG101 | Integrins, selectins and CD40 ligand | CR1 and proteolytic enzymes; no CD63 | CD133; no CD63 | TNFRI | Histones |
| Intracellular origin | Internal compartments (endosomes) | Plasma membrane | Plasma membrane | Plasma membrane | | |

Abbreviations: phosphatidylserine (PPS); electron microscopy (EM)

Vesicles include shed membrane bound particles, or "microparticles," that are derived from either the plasma membrane or an internal membrane. Vesicles can be released into the extracellular environment from cells. Cells releasing vesicles include without limitation cells that originate from, or are derived from, the ectoderm, endoderm, or mesoderm. The cells may have undergone genetic, environmental, and/or any other variations or alterations. For example, the cell can be tumor cells. A vesicle can reflect any changes in the source cell, and thereby reflect changes in the originating cells, e.g., cells having various genetic mutations. In one mechanism, a vesicle is generated intracellularly when a segment of the cell membrane spontaneously invaginates and is ultimately exocytosed (see for example, Keller et al., *Immunol. Lett.* 107 (2): 102-8 (2006)). Vesicles also include cell-derived structures bounded by a lipid bilayer membrane arising from both herniated evagination (blebbing) separation and sealing of portions of the plasma membrane or from the export of any intracellular membrane-bounded vesicular structure containing various membrane-associated proteins of tumor origin, including surface-bound molecules derived from the host circulation that bind selectively to the tumor-derived proteins together with molecules contained in the vesicle lumen, including but not limited to tumor-derived microRNAs or intracellular proteins. Blebs and blebbing are further described in Charras et al., *Nature Reviews Molecular and Cell Biology*, Vol. 9, No. 11. p. 730-736 (2008). A vesicle shed into circulation or bodily fluids from tumor cells may be referred to as a "circulating tumor-derived vesicle." When such vesicle is an exosome, it may be referred to as a circulating-tumor derived exosome (CTE). In some instances, a vesicle can be derived from a specific cell of origin. CTE, as with a cell-of-origin specific vesicle, typically have one or more unique biomarkers that permit isolation of the CTE or cell-of-origin specific vesicle, e.g., from a bodily fluid and sometimes in a specific manner. For example, a cell or tissue specific markers are used to identify the cell of origin. Examples of such cell or tissue specific markers are disclosed herein and can further be accessed in the Tissue-specific Gene Expression and Regulation (TiGER) Database, available at bioinfo.wilmer.jhu.edu/tiger/; Liu et al. (2008) TiGER: a database for tissue-specific gene expression and regulation. BMC Bioinformatics. 9:271; TissueDistributionDBs, available at genome.dkfz-heidelberg.de/menu/tissue_db/index.html.

A vesicle can have a diameter of greater than about 10 nm, 20 nm, or 30 nm. A vesicle can have a diameter of greater than 40 nm, 50 nm, 100 nm, 200 nm, 500 nm, 1000 nm, 1500 nm, 2000 nm or greater than 10,000 nm. A vesicle can have a diameter of about 20-2000 nm, about 20-1500 nm, about 30-1000 nm, about 30-800 nm, about 30-200 nm, or about 30-100 nm. In some embodiments, the vesicle has a diameter of less than 10,000 nm, 2000 nm, 1500 nm, 1000 nm, 800 nm, 500 nm, 200 nm, 100 nm, 50 nm, 40 nm, 30 nm, 20 nm or less than 10 nm. As used herein the term "about" in reference to a numerical value means that variations of 10% above or below the numerical value are within the range ascribed to the specified value. Typical sizes for various types of vesicles are shown in Table 2. Vesicles can be assessed to measure the diameter of a single vesicle or any number of vesicles. For example, the range of diameters of a vesicle population or an average diameter of a vesicle population can be determined. Vesicle diameter can be assessed using methods known in the art, e.g., imaging technologies such as electron microscopy. In an embodiment, a diameter of one or more vesicles is determined using optical particle detection. See, e.g., U.S. Pat. No. 7,751,053, entitled "Optical Detection and Analysis of Particles" and issued Jul. 6, 2010; and U.S. Pat. No. 7,399,600, entitled "Optical Detection and Analysis of Particles" and issued Jul. 15, 2010.

In some embodiments, the methods of the invention comprise assessing vesicles directly such as in a biological sample without prior isolation, purification, or concentration from the biological sample. For example, the amount of vesicles in the sample can by itself provide a biosignature that provides a diagnostic, prognostic or theranostic determination. Alternatively, the vesicle in the sample may be isolated, captured, purified, or concentrated from a sample prior to analysis. As noted, isolation, capture or purification as used herein comprises partial isolation, partial capture or partial purification apart from other components in the sample. Vesicle isolation can be performed using various techniques as described herein, e.g., chromatography, filtration, centrifugation, flow cytometry, affinity capture (e.g., to a planar surface or bead), and/or using microfluidics. FIGS. 10B-C present an overview of a method of the invention for assessing microvesicles using an aptamer pool.

Vesicles such as exosomes can be assessed to provide a phenotypic characterization by comparing vesicle characteristics to a reference. In some embodiments, surface antigens on a vesicle are assessed. The surface antigens can provide an indication of the anatomical origin and/or cellular of the vesicles and other phenotypic information, e.g., tumor status. For example, wherein vesicles found in a patient sample, e.g., a bodily fluid such as blood, serum or plasma, are assessed for surface antigens indicative of colorectal origin and the presence of cancer. The surface antigens may comprise any informative biological entity that can be detected on the vesicle membrane surface, including without limitation surface proteins, lipids, carbohydrates, and other membrane components. For example, positive detection of colon derived vesicles expressing tumor antigens can indicate that the patient has colorectal cancer. As such, methods of the invention can be used to characterize any disease or condition associated with an anatomical or cellular origin, by assessing, for example, disease-specific and cell-specific biomarkers of one or more vesicles obtained from a subject.

In another embodiment, the methods of the invention comprise assessing one or more vesicle payload to provide a phenotypic characterization. The payload with a vesicle comprises any informative biological entity that can be detected as encapsulated within the vesicle, including without limitation proteins and nucleic acids, e.g., genomic or cDNA, mRNA, or functional fragments thereof, as well as microRNAs (miRs). In addition, methods of the invention are directed to detecting vesicle surface antigens (in addition or exclusive to vesicle payload) to provide a phenotypic characterization. For example, vesicles can be characterized by using binding agents (e.g., antibodies or aptamers) that are specific to vesicle surface antigens, and the bound vesicles can be further assessed to identify one or more payload components disclosed therein. As described herein, the levels of vesicles with surface antigens of interest or with payload of interest can be compared to a reference to characterize a phenotype. For example, overexpression in a sample of cancer-related surface antigens or vesicle payload, e.g., a tumor associated mRNA or microRNA, as compared to a reference, can indicate the presence of cancer in the sample. The biomarkers assessed can be present or absent, increased or reduced based on the selection of the desired target sample and comparison of the target sample to the desired reference sample. Non-limiting examples of target samples include: disease; treated/not-treated; different time points, such as a in a longitudinal study; and non-limiting examples of reference sample: non-disease; normal; different time points; and sensitive or resistant to candidate treatment(s).

Diagnostic Methods

The aptamers of the invention can be used in various methods to assess presence or level of biomarkers in a biological sample, e.g., biological entities of interest such as proteins, nucleic acids, or microvesicles. The biological entities can be part of larger entities, such as complexes, cells or tissue, or can be circulating in bodily fluids. The aptamers may be used to assess presence or level of the target molecule/s. Therefore, in various embodiments of the invention directed to diagnostics, prognostics or theranostics, one or more aptamers of the invention are configured in a ligand-target based assay, where one or more aptamer of the invention is contacted with a selected biological sample, where the or more aptamer associates with or binds to its target molecules. Aptamers of the invention are used to identify candidate biosignatures based on the biological samples assessed and biomarkers detected. In some embodiments, aptamer or oligonucleotide probes, or libraries thereof, may themselves provide a biosignature for a particular condition or disease. A biosignature refers to a biomarker profile of a biological sample comprising a presence, level or other characteristic that can be assessed (including without limitation a sequence, mutation, rearrangement, translocation, deletion, epigenetic modification, methylation, post-translational modification, allele, activity, complex partners, stability, half life, and the like) of one or more biomarker of interest. Biosignatures can be used to evaluate diagnostic and/or prognostic criteria such as presence of disease, disease staging, disease monitoring, disease stratification, or surveillance for detection, metastasis or recurrence or progression of disease. For example, methods of the invention using aptamers against microvesicle surface antigen are useful for correlating a biosignature comprising microvesicle antigens to a selected condition or disease. As another example, methods of the invention using aptamers against tissue are useful for correlating a biosignature comprising tissue antigens to a selected condition or disease. A biosignature can also be used clinically in making decisions concerning treatment modalities including therapeutic intervention. A biosignature can further be used clinically to make treatment decisions, including whether to perform surgery or what treatment standards should be used along with surgery (e.g., either pre-surgery or post-surgery). As an illustrative example, a biosignature of circulating biomarkers or biomarkers displayed on fixed tissue may indicate an aggressive form of cancer and may call for a more aggressive surgical procedure and/or more aggressive therapeutic regimen to treat the patient.

Characterizing a phenotype, such as providing a diagnosis, prognosis or theranosis, may comprise comparing a biosignature to a reference. For example, the level of a biomarker in a diseased state may be elevated or reduced as compared to a reference control without the disease, or with a different state of the disease. An oligonucleotide probe library according to the invention may be engineered to detect a certain phenotype and not another phenotype. As a non-limiting example, the oligonucleotide probe library may stain a cancer tissue using an immunoassay but not a non-cancer reference tissue. Alternately, the oligonucleotide probe library may stain a cancer tissue using an immunoassay at a detectable higher level than a non-cancer reference tissue. One of skill will appreciate that one may engineer an oligonucleotide probe library to stain a non-cancer tissue using an immunoassay at a detectable higher level than cancer tissue as well.

A biosignature can be used in any methods disclosed herein, e.g., to assess whether a subject is afflicted with disease, is at risk for developing disease or to assess the stage or progression of the disease. For example, a biosignature can be used to assess whether a subject has prostate cancer, colon cancer, or other cancer as described herein. See, e.g., section labeled "Phenotypes." Furthermore, a biosignature can be used to determine a stage of a disease or condition, such as cancer.

A biosignature/biomarker profile comprising a microvesicle can include assessment of payload within the microvesicle. For example, one or more aptamer of the invention can be used to capture a microvesicle population, thereby providing readout of microvesicle antigens, and then the payload content within the captured microvesicles can be assessed, thereby providing further biomarker readout of the payload content.

A biosignature for characterizing a phenotype may comprise any number of useful criteria. The term "phenotype" as used herein can mean any trait or characteristic that is attributed to a biosignature/biomarker profile. A phenotype can be detected or identified in part or in whole using the compositions and/or methods of the invention. In some embodiments, at least one criterion is used for each biomarker. In some embodiments, at least 1, 2, 3, 4, 5, 6, 7, 8, 9, 10, 15, 20, 30, 40, 50, 60, 70, 80, 90 or at least 100 criteria are used. For example, for the characterizing of a cancer, a number of different criteria can be used when the subject is diagnosed with a cancer: 1) if the amount of a biomarker in a sample from a subject is higher than a reference value; 2) if the amount of a biomarker within specific cell types or specific microvesicles (e.g., microvesicles derived from a specific tissue or organ) is higher than a reference value; or 3) if the amount of a biomarker within a cell, tissue or microvesicle with one or more cancer specific biomarkers is higher than a reference value. Similar rules can apply if the amount of the biomarkers is less than or the same as the reference. The method can further include a quality control measure, such that the results are provided for the subject if the samples meet the quality control measure. In some embodiments, if the criteria are met but the quality control is questionable, the subject is reassessed.

A biosignature can be used in therapy related diagnostics to provide tests useful to diagnose a disease or choose the correct treatment regimen, such as provide a theranosis. Theranostics includes diagnostic testing that provides the ability to affect therapy or treatment of a diseased state. Theranostics testing provides a theranosis in a similar manner that diagnostics or prognostic testing provides a diagnosis or prognosis, respectively. As used herein, theranostics encompasses any desired form of therapy related testing, including predictive medicine, personalized medicine, integrated medicine, pharmacodiagnostics and Dx/Rx partnering. Therapy related tests can be used to predict and assess drug response in individual subjects, i.e., to provide personalized medicine. Predicting a drug response can be determining whether a subject is a likely responder or a likely non-responder to a candidate therapeutic agent, e.g., before the subject has been exposed or otherwise treated with the treatment. Assessing a drug response can be monitoring a response to a drug, e.g., monitoring the subject's improvement or lack thereof over a time course after initiating the treatment. Therapy related tests are useful to select a subject for treatment who is particularly likely to benefit from the treatment or to provide an early and objective indication of treatment efficacy in an individual subject. Thus, a biosignature as disclosed herein may indicate that treatment should be altered to select a more promising treatment, thereby avoiding the great expense of delaying beneficial treatment and avoiding the financial and morbidity costs of administering an ineffective drug(s).

The compositions and methods of the invention can be used to identify or detect a biosignature associated with a variety of diseases and disorders, which include, but are not limited to cardiovascular disease, cancer, infectious diseases, sepsis, neurological diseases, central nervous system related diseases, endovascular related diseases, and autoimmune related diseases. Therapy related diagnostics also aid in the prediction of drug toxicity, drug resistance or drug response. Therapy related tests may be developed in any suitable diagnostic testing format, which include, but are not limited to, e.g., immunohistochemical tests, clinical chemistry, immunoassay, cell-based technologies, nucleic acid tests or body imaging methods. Therapy related tests can further include but are not limited to, testing that aids in the determination of therapy, testing that monitors for therapeutic toxicity, or response to therapy testing. Thus, a biosignature can be used to predict or monitor a subject's response to a treatment. A biosignature can be determined at different time points for a subject after initiating, removing, or altering a particular treatment.

In some embodiments, the compositions and methods of the invention provide for a determination or prediction as to whether a subject is responding to a treatment is made based on a change in the amount of one or more components of a biosignature (e.g., biomarkers of interest), an amount of one or more components of a particular biosignature, or the biosignature detected for the components. In another embodiment, a subject's condition is monitored by determining a biosignature at different time points. The progression, regression, or recurrence of a condition is determined. Response to therapy can also be measured over a time course. Thus, the invention provides a method of monitoring a status of a disease or other medical condition in a subject, comprising isolating or detecting a biosignature from a biological sample from the subject, detecting the overall amount of the components of a particular biosignature, or detecting the biosignature of one or more components (such as the presence, absence, or expression level of a biomarker). The biosignatures are used to monitor the status of the disease or condition.

One or more novel biosignatures can also be identified by the methods of the invention. For example, one or more vesicles can be isolated from a subject that responds to a drug treatment or treatment regimen and compared to a reference, such as another subject that does not respond to the drug treatment or treatment regimen. Differences between the biosignatures can be determined and used to identify other subjects as responders or non-responders to a particular drug or treatment regimen.

In some embodiments, a biosignature is used to determine whether a particular disease or condition is resistant to a drug, in which case a physician need not waste valuable time with such drug treatment. To obtain early validation of a drug choice or treatment regimen, a biosignature is determined for a sample obtained from a subject. The biosignature is used to assess whether the particular subject's disease has the biomarker associated with drug resistance. Such a determination enables doctors to devote critical time as well as the patient's financial resources to effective treatments.

Biosignatures can be used in the theranosis of diseases such as cancer, e.g., identifying whether a subject suffering from a disease is a likely responder or non-responder to a particular treatment. The subject methods can be used to theranose cancers including without limitation those listed herein, e.g., in the "Phenotypes" section herein. These include without limitation lung cancer, non-small cell lung cancer small cell lung cancer (including small cell carcinoma (oat cell cancer), mixed small cell/large cell carcinoma, and combined small cell carcinoma), colon cancer, breast cancer, prostate cancer, liver cancer, pancreatic cancer, brain cancer, kidney cancer, ovarian cancer, stomach cancer, melanoma, bone cancer, gastric cancer, breast cancer, glioma, glioblastoma, hepatocellular carcinoma, papillary renal carcinoma, head and neck squamous cell carcinoma, leukemia, lymphoma, myeloma, or other solid tumors.

A biosignature of circulating biomarkers, including markers associated with a component present in a biological sample (e.g., cell, cell-fragment, cell-derived microvesicle), in a sample from a subject suffering from a cancer can be used select a candidate treatment for the subject. The biosignature can be determined according to the methods of the invention presented herein. In some embodiments, the candidate treatment comprises a standard of care for the cancer. The treatment can be a cancer treatment such as radiation, surgery, chemotherapy or a combination thereof. The cancer treatment can be a therapeutic such as anti-cancer agents and chemotherapeutic regimens. Further drug associations and rules that are used in embodiments of the invention are found in PCT/US2007/69286, filed May 18, 2007; PCT/US2009/60630, filed Oct. 14, 2009; PCT/2010/000407, filed Feb. 11, 2010; PCT/US12/41393, filed Jun. 7, 2012; PCT/US2013/073184, filed Dec. 4, 2013; PCT/US2010/54366, filed Oct. 27, 2010; PCT/US11/67527, filed Dec. 28, 2011; PCT/US15/13618, filed Jan. 29, 2015; and PCT/US16/20657, filed Mar. 3, 2016; each of which applications is incorporated herein by reference in its entirety.

Biomarkers

The methods and compositions of the invention can be used in assays to detect the presence or level of one or more biomarker of interest. Given the adaptable nature of the invention, the biomarker can be any useful biomarker including those disclosed herein or in the literature, or to be discovered. In an embodiment, the biomarker comprises a protein or polypeptide. As used herein, "protein," "polypeptide" and "peptide" are used interchangeably unless stated otherwise. The biomarker can be a nucleic acid, including DNA, RNA, and various subspecies of any thereof as disclosed herein or known in the art. The biomarker can comprise a lipid. The biomarker can comprise a carbohydrate. The biomarker can also be a complex, e.g., a complex comprising protein, nucleic acids, lipids and/or carbohydrates. In some embodiments, the biomarker comprises a microvesicle. In an embodiment, the invention provides a method wherein a pool of aptamers is used to assess the presence and/or level of a population of microvesicles of interest without knowing the precise microvesicle antigen targeted by each member of the pool. See, e.g., FIGS. 10B-C. In other cases, biomarkers associated with microvesicles are assessed according to the methods of the invention. See, e.g., FIG. 10A. The oligonucleotide pools of the invention can also used to assess cells and tissue whether or not the target biomarkers of the individual oligonucleotide aptamers are known. The invention further includes determining the targets of such oligonucleotide aptamer pools and members thereof. See Examples 19-31.

A biosignature may comprise one type of biomarker or multiple types of biomarkers. As a non-limiting example, a biosignature can comprise multiple proteins, multiple nucleic acids, multiple lipids, multiple carbohydrates, multiple biomarker complexes, multiple microvesicles, or a combination of any thereof. For example, the biosignature may comprise one or more microvesicle, one or more protein, and one or more microRNA, wherein the one or more protein and/or one or more microRNA is optionally in association with the microvesicle as a surface antigen and/or payload, as appropriate. As another example, the biosignature may be an oligonucleotide pool signature, and the members of the oligonucleotide pool can associate with various biomarker or multiple types of biomarkers.

In some embodiments, microvesicles are detected using vesicle surface antigens. A commonly expressed vesicle surface antigen can be referred to as a "housekeeping protein," or general vesicle biomarker. The biomarker can be CD63, CD9, CD81, CD82, CD37, CD53, Rab-5b, Annexin V or MFG-E8. Tetraspanins, a family of membrane proteins with four transmembrane domains, can be used as general vesicle biomarkers. The tetraspanins include CD151, CD53, CD37, CD82, CD81, CD9 and CD63. There have been over 30 tetraspanins identified in mammals, including the TSPAN1 (TSP-1), TSPAN2 (TSP-2), TSPAN3 (TSP-3), TSPAN4 (TSP-4, NAG-2), TSPAN5 (TSP-5), TSPAN6 (TSP-6), TSPAN7 (CD231, TALLA-1, A15), TSPAN8 (CO-029), TSPAN9 (NET-5), TSPAN10 (Oculospanin), TSPAN11 (CD151-like), TSPAN12 (NET-2), TSPAN13 (NET-6), TSPAN14, TSPAN15 (NET-7), TSPAN16 (TM4-B), TSPAN17, TSPAN18, TSPAN19, TSPAN20 (UP1b, UPK1B), TSPAN21 (UP1a, UPK1A), TSPAN22 (RDS, PRPH2), TSPAN23 (ROM1), TSPAN24 (CD151), TSPAN25 (CD53), TSPAN26 (CD37), TSPAN27 (CD82), TSPAN28 (CD81), TSPAN29 (CD9), TSPAN30 (CD63), TSPAN31 (SAS), TSPAN32 (TSSC6), TSPAN33, and TSPAN34. Other commonly observed vesicle markers include those listed in Table 3. One or more of these proteins can be useful biomarkers for the characterizing a phenotype using the subject methods and compositions.

TABLE 3

Proteins Observed in Microvesicles from Multiple Cell Types

| Class | Protein |
| --- | --- |
| Antigen Presentation | MHC class I, MHC class II, Integrins, Alpha 4 beta 1, Alpha M beta 2, Beta 2 |
| Immunoglobulin family | ICAM1/CD54, P-selection |
| Cell-surface peptidases | Dipeptidylpeptidase IV/CD26, Aminopeptidase n/CD13 |
| Tetraspanins | CD151, CD53, CD37, CD82, CD81, CD9 and CD63 |
| Heat-shock proteins | Hsp70, Hsp84/90 |
| Cytoskeletal proteins | Actin, Actin-binding proteins, Tubulin |
| Membrane transport and fusion | Annexin I, Annexin II, Annexin IV, Annexin V, Annexin VI, RAB7/RAP1B/RADGDI |
| Signal transduction | Gi2alpha/14-3-3, CBL/LCK |
| Abundant membrane proteins | CD63, GAPDH, CD9, CD81, ANXA2, ENO1, SDCBP, MSN, MFGE8, EZR, GK, ANXA1, LAMP2, DPP4, TSG101, HSPA1A, GDI2, CLTC, LAMP1, Cd86, ANPEP, TFRC, SLC3A2, RDX, RAP1B, RAB5C, RAB5B, MYH9, ICAM1, FN1, RAB11B, PIGR, LGALS3, ITGB1, EHD1, CLIC1, ATP1A1, ARF1, RAP1A, P4HB, MUC1, KRT10, HLA-A, FLOT1, CD59, C1orf58, BASP1, TACSTD1, STOM |
| Other Transmembrane Proteins | Cadherins: CDH1, CDH2, CDH12, CDH3, Deomoglein, DSG1, DSG2, DSG3, DSG4, Desmocollin, DSC1, DSC2, DSC3, Protocadherins, PCDH1, PCDH10, PCDH11x, PCDH11y, PCDH12, FAT, FAT2, FAT4, PCDH15, PCDH17, PCDH18, PCDH19; PCDH20; PCDH7, PCDH8, PCDH9, PCDHA1, PCDHA10, PCDHA11, PCDHA12, PCDHA13, PCDHA2, PCDHA3, PCDHA4, PCDHA5, PCDHA6, PCDHA7, PCDHA8, PCDHA9, PCDHAC1, PCDHAC2, PCDHB1, PCDHB10, PCDHB11, PCDHB12, PCDHB13, PCDHB14, PCDHB15, PCDHB16, PCDHB17, PCDHB18, PCDHB2, PCDHB3, PCDHB4, PCDHB5, PCDHB6, PCDHB7, PCDHB8, PCDHB9, PCDHGA1, PCDHGA10, PCDHGA11, PCDHGA12, PCDHGA2; PCDHGA3, PCDHGA4, PCDHGA5, PCDHGA6, PCDHGA7, PCDHGA8, PCDHGA9, PCDHGB1, PCDHGB2, PCDHGB3, PCDHGB4, PCDHGB5, PCDHGB6, PCDHGB7, PCDHGC3, PCDHGC4, PCDHGC5, CDH9 (cadherin 9, type 2 (T1-cadherin)), CDH10 (cadherin 10, type 2 (T2-cadherin)), CDH5 (VE-cadherin (vascular endothelial)), CDH6 (K-cadherin (kidney)), CDH7 (cadherin 7, type 2), CDH8 (cadherin 8, type 2), CDH11 (OB-cadherin (osteoblast)), CDH13 (T-cadherin-H-cadherin (heart)), CDH15 (M-cadherin (myotubule)), CDH16 (KSP-cadherin), CDH17 (LI cadherin (liver-intestine)), CDH18 (cadherin 18, type 2), CDH19 (cadherin 19, type 2), CDH20 (cadherin 20, type 2), CDH23 (cadherin 23, (neurosensory epithelium)), CDH10, CDH11, CDH13, CDH15, CDH16, CDH17, CDH18, CDH19, CDH22, CDH23, CDH24, CDH26, CDH28, CDH4, CDH5, CDH6, CDH7, CDH8, CDH9, CELSR1, CELSR2, CELSR3, CLSTN1, CLSTN2, CLSTN3, DCHS1, DCHS2, LOC389118, PCLKC, RESDA1, RET |

Any of the types of biomarkers described herein can be used and/or assessed via the subject methods and compositions. Exemplary biomarkers include without limitation those in Table 4. The markers can be detected as protein, RNA or DNA as appropriate, which can be circulating freely or in a complex with other biological molecules. As desired, the markers in Table 4 can also be used to detect tumor tissue or for capture and/or detection of vesicles for characterizing phenotypes as disclosed herein. In some cases, multiple capture and/or detectors are used to enhance the characterization. The markers can be detected as vesicle surface antigens and/or vesicle payload. The "Illustrative Class" indicates indications for which the markers are known markers. Those of skill will appreciate that the markers can also be used in alternate settings in certain instances. For example, a marker which can be used to characterize one type of disease may also be used to characterize another disease as appropriate. Consider a non-limiting example of a tumor marker which can be used as a biomarker for tumors from various lineages. The biomarker references in Tables 3 and 4, or through the specification, are those commonly used in the art. Gene aliases and descriptions can be found using a variety of online databases, including GeneCards® (www-.genecards.org), HUGO Gene Nomenclature (www.genenames.org), Entrez Gene (www.ncbi.nlm.nih.gov/entrez/query.fcgi?db=gene), UniProtKB/Swiss-Prot (www.uniprot.org), UniProtKB/TrEMBL (www.uniprot.org), OMIM (www.ncbi.nlm.nih.gov/entrez/query.fcgi?db-OMIM), GeneLoc (genecards.weizmann.ac.il/geneloc/), and Ensembl (www.ensembl.org). Generally, gene symbols and names below correspond to those approved by HUGO, and protein names are those recommended by UniProtKB/Swiss-Prot. Common alternatives are provided as well. Where a protein name indicates a precursor, the mature protein is also implied. Throughout the application, gene and protein symbols may be used interchangeably and the meaning can be derived from context as necessary.

TABLE 4

Illustrative Biomarkers

| Illustrative Class | Biomarkers |
|---|---|
| Drug associated targets and prognostic markers | ABCC1, ABCG2, ACE2, ADA, ADH1C, ADH4, AGT, AR, AREG, ASNS, BCL2, BCRP, BDCA1, beta III tubulin, BIRC5, B-RAF, BRCA1, BRCA2, CA2, caveolin, CD20, CD25, CD33, CD52, CDA, CDKN2A, CDKN1A, CDKN1B, CDK2, CDW52, CES2, CK 14, CK 17, CK 5/6, c-KIT, c-Met, c-Myc, COX-2, Cyclin D1, DCK, DHFR, DNMT1, DNMT3A, DNMT3B, E-Cadherin, ECGF1, EGFR, EML4-ALK fusion, EPHA2, Epiregulin, ER, ERBR2, ERCC1, ERCC3, EREG, ESR1, FLT1, folate receptor, FOLR1, FOLR2, FSHB, FSHPRH1, FSHR, FYN, GART, GNA11, GNAQ, GNRH1, GNRHR1, GSTP1, HCK, HDAC1, hENT-1, Her2/Neu, HGF, HIF1A, HIG1, HSP90, HSP90AA1, HSPCA, IGF-1R, IGFRBP, IGFRBP3, IGFRBP4, IGFRBP5, IL13RA1, IL2RA, KDR, Ki67, KIT, K-RAS, LCK, LTB, Lymphotoxin Beta Receptor, LYN, MET, MGMT, MLH1, MMR, MRP1, MS4A1, MSH2, MSH5, Myc, NFKB1, NFKB2, NFKBIA, NRAS, ODC1, OGFR, p16, p21, p27, p53, p95, PARP-1, PDGFC, PDGFR, PDGFRA, PDGFRB, PGP, PGR, PI3K, POLA, POLA1, PPARG, PPARGC1, PR, PTEN, PTGS2, PTPN12, RAF1, RARA, ROS1, RRM1, RRM2, RRM2B, RXRB, RXRG, SIK2, SPARC, SRC, SSTR1, SSTR2, SSTR3, SSTR4, SSTR5, Survivin, TK1, TLE3, TNF, TOP1, TOP2A, TOP2B, TS, TUBB3, TXN, TXNRD1, TYMS, VDR, VEGF, VEGFA, VEGFC, VHL, YES1, ZAP70 |
| Drug associated targets and prognostic markers | ABL1, STK11, FGFR2, ERBB4, SMARCB1, CDKN2A, CTNNB1, FGFR1, FLT3, NOTCH1, NPM1, SRC, SMAD4, FBXW7, PTEN, TP53, AKT1, ALK, APC, CDH1, C-Met, HRAS, IDH1, JAK2, MPL, PDGFRA, SMO, VHL, ATM, CSF1R, FGFR3, GNAS, ERBB2, HNF1A, JAK3, KDR, MLH1, PTPN11, RB1, RET, c-Kit, EGFR, PIK3CA, NRAS, GNA11, GNAQ, KRAS, BRAF |
| Drug associated targets and prognostic markers | ALK, AR, BRAF, cKIT, cMET, EGFR, ER, ERCC1, GNA11, HER2, IDH1, KRAS, MGMT, MGMT promoter methylation, NRAS, PDGFRA, Pgp, PIK3CA, PR, PTEN, ROS1, RRM1, SPARC, TLE3, TOP2A, TOPO1, TS, TUBB3, VHL |
| Drug associated targets | ABL1, AKT1, ALK, APC, AR, ATM, BRAF, BRAF, BRCA1, BRCA2, CDH1, cKIT, cMET, CSF1R, CTNNB1, EGFR, EGFR (H-score), EGFRvIII, ER, ERBB2 (HER2), ERBB4, ERCC1, FBXW7, FGFR1, FGFR2, FLT3, GNA11, GNAQ, GNAS, HER2, HNF1A, HRAS, IDH1, IDH2, JAK2, JAK3, KDR (VEGFR2), KRAS, MGMT, MGMT Promoter Methylation, microsatellite instability (MSI), MLH1, MPL, MSH2, MSH6, NOTCH1, NPM1, NRAS, PD-1, PDGFRA, PD-L1, Pgp, PIK3CA, PMS2, PR, PTEN, PTPN11, RB1, RET, ROS1, RRM1, SMAD4, SMARCB1, SMO, SPARC, STK11, TLE3, TOP2A, TOPO1, TP53, TS, TUBB3, VHL |
| Drug associated targets | 1p19q co-deletion, ABL1, AKT1, ALK, APC, AR, ARAF, ATM, BAP1, BRAF, BRCA1, BRCA2, CDH1, CHEK1, CHEK2, cKIT, cMET, CSF1R, CTNNB1, DDR2, EGFR, EGFRvIII, ER, ERBB2 (HER2), ERBB3, ERBB4, ERCC1, FBXW7, FGFR1, FGFR2, FLT3, GNA11, GNAQ, GNAS, H3K36me3, HER2, HNF1A, HRAS, IDH1, IDH2, JAK2, JAK3, KDR (VEGFR2), KRAS, MDMT, MGMT, MGMT Methylation, Microsatellite instability, MLH1, MPL, MSH2, MSH6, NF1, NOTCH1, NPM1, NRAS, NY-ESO-1, PD-1, PDGFRA, PD-L1, Pgp, PIK3CA, PMS2, PR, PTEN, PTPN11, RAF1, RB1, RET, ROS1, ROS1, RRM1, SMAD4, SMARCB1, SMO, SPARC, STK11, TLE3, TOP2A, TOPO1, TP53, TRKA, TS, TUBB3, VHL, WT1 |
| Drug associated targets | ABL1, AKT1, ALK, APC, AR, ATM, BRAF, BRAF, BRCA1, BRCA2, CDH1, cKIT, cMET, CSF1R, CTNNB1, EGFR, EGFR (H-score), EGFRvIII, ER, ERBB2 (HER2), ERBB4, ERCC1, FBXW7, FGFR1, FGFR2, FLT3, GNA11, GNAQ, GNAS, HER2, HNF1A, HRAS, IDH1, IDH2, JAK2, JAK3, KDR (VEGFR2), KRAS, MGMT, MGMT Promoter Methylation, microsatellite instability (MSI), MLH1, MPL, MSH2, MSH6, NOTCH1, NPM1, NRAS, PD-1, PDGFRA, PD-L1, Pgp, PIK3CA, PMS2, PR, PTEN, PTPN11, RB1, RET, ROS1, RRM1, SMAD4, SMARCB1, SMO, SPARC, STK11, TLE3, TOP2A, TOPO1, TP53, TS, TUBB3, VHL |

TABLE 4-continued

Illustrative Biomarkers

| Illustrative Class | Biomarkers |
|---|---|
| Drug associated targets | 1p19q, ALK, ALK (2p23), Androgen Receptor, BRCA, cMET, EGFR, EGFR, EGFRvIII, ER, ERCC1, Her2, Her2/Neu, MGMT, MGMT Promoter Methylation, microsatellite instability (MSI), MLH1, MSH2, MSH6, PD-1, PD-L1, PMS2, PR, PTEN, ROS1, RRM1, TLE3, TOP2A, TOP2A, TOPO1, TS, TUBB3 |
| Drug associated targets | TOP2A, Chromosome 17 alteration, PBRM1 (PB1/BAF180), BAP1, SETD2 (ANTI-HISTONE H3), MDM2, Chromosome 12 alteration, ALK, CTLA4, CD3, NY-ESO-1, MAGE-A, TP, EGFR |
| 5-aminosalicyclic acid (5-ASA) efficacy | µ-protocadherin, KLF4, CEBPα |
| Cancer treatment associated markers | AR, AREG (Amphiregulin), BRAF, BRCA1, cKIT, cMET, EGFR, EGFR w/T790M, EML4-ALK, ER, ERBB3, ERBB4, ERCC1, EREG, GNA11, GNAQ, hENT-1, Her2, Her2 Exon 20 insert, IGF1R, Ki67, KRAS, MGMT, MGMT methylation, MSH2, MSI, NRAS, PGP (MDR1), PIK3CA, PR, PTEN, ROS1, ROS1 translocation, RRM1, SPARC, TLE3, TOPO1, TOPO2A, TS, TUBB3, VEGFR2 |
| Cancer treatment associated markers | AR, AREG, BRAF, BRCA1, cKIT, cMET, EGFR, EGFR w/T790M, EML4-ALK, ER, ERBB3, ERBB4, ERCC1, EREG, GNA11, GNAQ, Her2, Her2 Exon 20 insert, IGFR1, Ki67, KRAS, MGMT-Me, MSH2, MSI, NRAS, PGP (MDR-1), PIK3CA, PR, PTEN, ROS1 translocation, RRM1, SPARC, TLE3, TOPO1, TOPO2A, TS, TUBB3, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Colon cancer treatment associated markers | AREG, BRAF, EGFR, EML4-ALK, ERCC1, EREG, KRAS, MSI, NRAS, PIK3CA, PTEN, TS, VEGFR2 |
| Melanoma treatment associated markers | BRAF, cKIT, ERBB3, ERBB4, ERCC1, GNA11, GNAQ, MGMT, MGMT methylation, NRAS, PIK3CA, TUBB3, VEGFR2 |
| Melanoma treatment associated markers | BRAF, cKIT, ERBB3, ERBB4, ERCC1, GNA11, GNAQ, MGMT-Me, NRAS, PIK3CA, TUBB3, VEGFR2 |
| Ovarian cancer treatment associated markers | BRCA1, cMET, EML4-ALK, ER, ERBB3, ERCC1, hENT-1, HER2, IGF1R, PGP(MDR1), PIK3CA, PR, PTEN, RRM1, TLE3, TOPO1, TOPO2A, TS |
| Ovarian cancer treatment associated markers | BRCA1, cMET, EML4-ALK (translocation), ER, ERBB3, ERCC1, HER2, PIK3CA, PR, PTEN, RRM1, TLE3, TS |
| Breast cancer treatment associated markers | BRAF, BRCA1, EGFR, EGFR T790M, EML4-ALK, ER, ERBB3, ERCC1, HER2, Ki67, PGP (MDR1), PIK3CA, PR, PTEN, ROS1, ROS1 translocation, RRM1, TLE3, TOPO1, TOPO2A, TS |
| Breast cancer treatment associated markers | BRAF, BRCA1, EGFR w/T790M, EML4-ALK, ER, ERBB3, ERCC1, HER2, Ki67, KRAS, PIK3CA, PR, PTEN, ROS1 translocation, RRM1, TLE3, TOPO1, TOPO2A, TS |
| NSCLC cancer treatment associated markers | BRAF, BRCA1, cMET, EGFR, EGFR w/T790M, EML4-ALK, ERCC1, Her2 Exon 20 insert, KRAS, MSH2, PIK3CA, PTEN, ROS1 (trans), RRM1, TLE3, TS, VEGFR2 |
| NSCLC cancer treatment associated markers | BRAF, cMET, EGFR, EGFR w/T790M, EML4-ALK, ERCC1, Her2 Exon 20 insert, KRAS, MSH2, PIK3CA, PTEN, ROS1 translocation, RRM1, TLE3, TS |
| Mutated in cancers | AKT1, ALK, APC, ATM, BRAF, CDH1, CDKN2A, c-Kit, C-Met, CSF1R, CTNNB1, EGFR, ERBB2, ERBB4, FBXW7, FGFR1, FGFR2, FGFR3, FLT3, GNA11, GNAQ, GNAS, HNF1A, HRAS, IDH1, JAK2, JAK3, KDR, KRAS, MLH1, MPL, NOTCH1, NPM1, NRAS, PDGFRA, PIK3CA, PTEN, PTPN11, RB1, RET, SMAD4, SMARCB1, SMO, SRC, STK11, TP53, VHL |
| Mutated in cancers | ALK, BRAF, BRCA1, BRCA2, EGFR, ERRB2, GNA11, GNAQ, IDH1, IDH2, KIT, KRAS, MET, NRAS, PDGFRA, PIK3CA, PTEN, RET, SRC, TP53 |
| Mutated in cancers | AKT1, HRAS, GNAS, MEK1, MEK2, ERK1, ERK2, ERBB3, CDKN2A, PDGFRB, IFG1R, FGFR1, FGFR2, FGFR3, ERBB4, SMO, DDR2, GRB1, PTCH, SHH, PD1, UGT1A1, BIM, ESR1, MLL, AR, CDK4, SMAD4 |
| Mutated in cancers | ABL, APC, ATM, CDH1, CSFR1, CTNNB1, FBXW7, FLT3, HNF1A, JAK2, JAK3, KDR, MLH1, MPL, NOTCH1, NPM1, PTPN11, RB1, SMARCB1, STK11, VHL |

TABLE 4-continued

Illustrative Biomarkers

| Illustrative Class | Biomarkers |
|---|---|
| Mutated in cancers | ABL1, AKT1, AKT2, AKT3, ALK, APC, AR, ARAF, ARFRP1, ARID1A, ARID2, ASXL1, ATM, ATR, ATRX, AURKA, AURKB, AXL, BAP1, BARD1, BCL2, BCL2L2, BCL6, BCOR, BCORL1, BLM, BRAF, BRCA1, BRCA2, BRIP1, BTK, CARD11, CBFB, CBL, CCND1, CCND2, CCND3, CCNE1, CD79A, CD79B, CDC73, CDH1, CDK12, CDK4, CDK6, CDK8, CDKN1B, CDKN2A, CDKN2B, CDKN2C, CEBPA, CHEK1, CHEK2, CIC, CREBBP, CRKL, CRLF2, CSF1R, CTCF, CTNNA1, CTNNB1, DAXX, DDR2, DNMT3A, DOT1L, EGFR, EMSY (C11orf30), EP300, EPHA3, EPHA5, EPHB1, ERBB2, ERBB3, ERBB4, ERG, ESR1, EZH2, FAM123B (WTX), FAM46C, FANCA, FANCC, FANCD2, FANCE, FANCF, FANCG, FANCL, FBXW7, FGF10, FGF14, FGF19, FGF23, FGF3, FGF4, FGF6, FGFR1, FGFR2, FGFR3, FGFR4, FLT1, FLT3, FLT4, FOXL2, GATA1, GATA2, GATA3, GID4 (C17orf39), GNA11, GNA13, GNAQ, GNAS, GPR124, GRIN2A, GSK3B, HGF, HRAS, IDH1, IDH2, IGF1R, IKBKE, IKZF1, IL7R, INHBA, IRF4, IRS2, JAK1, JAK2, JAK3, JUN, KAT6A (MYST3), KDM5A, KDM5C, KDM6A, KDR, KEAP1, KIT, KLHL6, KRAS, LRP1B, MAP2K1, MAP2K2, MAP2K4, MAP3K1, MCL1, MDM2, MDM4, MED12, MEF2B, MEN1, MET, MITF, MLH1, MLL, MLL2, MPL, MRE11A, MSH2, MSH6, MTOR, MUTYH, MYC, MYCL1, MYCN, MYD88, NF1, NF2, NFE2L2, NFKBIA, NKX2-1, NOTCH1, NOTCH2, NPM1, NRAS, NTRK1, NTRK2, NTRK3, NUP93, PAK3, PALB2, PAX5, PBRM1, PDGFRA, PDGFRB, PDK1, PIK3CA, PIK3CG, PIK3R1, PIK3R2, PPP2R1A, PRDM1, PRKAR1A, PRKDC, PTCH1, PTEN, PTPN11, RAD50, RAD51, RAF1, RARA, RB1, RET, RICTOR, RNF43, RPTOR, RUNX1, SETD2, SF3B1, SMAD2, SMAD4, SMARCA4, SMARCB1, SMO, SOCS1, SOX10, SOX2, SPEN, SPOP, SRC, STAG2, STAT4, STK11, SUFU, TET2, TGFBR2, TNFAIP3, TNFRSF14, TOP1, TP53, TSC1, TSC2, TSHR, VHL, WISP3, WT1, XPO1, ZNF217, ZNF703 |
| Gene rearrangement in cancer | ALK, BCR, BCL2, BRAF, EGFR, ETV1, ETV4, ETV5, ETV6, EWSR1, MLL, MYC, NTRK1, PDGFRA, RAF1, RARA, RET, ROS1, TMPRSS2 |
| Cancer Related | ABL1, ACE2, ADA, ADH1C, ADH4, AGT, AKT1, AKT2, AKT3, ALK, APC, AR, ARAF, AREG, ARFRP1, ARID1A, ARID2, ASNS, ASXL1, ATM, ATR, ATRX, AURKA, AURKB, AXL, BAP1, BARD1, BCL2, BCL2L2, BCL6, BCOR, BCORL1, BCR, BIRC5 (survivin), BLM, BRAF, BRCA1, BRCA2, BRIP1, BTK, CA2, CARD11, CAV, CBFB, CBL, CCND1, CCND2, CCND3, CCNE1, CD33, CD52 (CDW52), CD79A, CD79B, CDC73, CDH1, CDK12, CDK2, CDK4, CDK6, CDK8, CDKN1B, CDKN2A, CDKN2B, CDKN2C, CEBPA, CES2, CHEK1, CHEK2, CIC, CREBBP, CRKL, CRLF2, CSF1R, CTCF, CTNNA1, CTNNB1, DAXX, DCK, DDR2, DHFR, DNMT1, DNMT3A, DNMT3B, DOT1L, EGFR, EMSY (C11orf30), EP300, EPHA2, EPHA3, EPHA5, EPHB1, ERBB2, ERBB3, ERBB4, ERBR2 (typo?), ERCC3, EREG, ERG, ESR1, ETV1, ETV4, ETV5, ETV6, EWSR1, EZH2, FAM123B (WTX), FAM46C, FANCA, FANCC, FANCD2, FANCE, FANCF, FANCG, FANCL, FBXW7, FGF10, FGF14, FGF19, FGF23, FGF3, FGF4, FGF6, FGFR1, FGFR2, FGFR3, FGFR4, FLT1, FLT3, FLT4, FOLR1, FOLR2, FOXL2, FSHB, FSHPRH1, FSHR, GART, GATA1, GATA2, GATA3, GID4 (C17orf39), GNA11, GNA13, GNAQ, GNAS, GNRH1, GNRHR1, GPR124, GRIN2A, GSK3B, GSTP1, HDAC1, HGF, HIG1, HNF1A, HRAS, HSPCA (HSP90), IDH1, IDH2, IGF1R, IKBKE, IKZF1, IL13RA1, IL2, IL2RA (CD25), IL7R, INHBA, IRF4, IRS2, JAK1, JAK2, JAK3, JUN, KAT6A (MYST3), KDM5A, KDM5C, KDM6A, KDR (VEGFR2), KEAP1, KIT, KLHL6, KRAS, LCK, LRP1B, LTB, LTBR, MAP2K1, MAP2K2, MAP2K4, MAP3K1, MAPK, MCL1, MDM2, MDM4, MED12, MEF2B, MEN1, MET, MGMT, MITF, MLH1, MLL, MLL2, MPL, MRE11A, MS4A1 (CD20), MSH2, MSH6, MTAP, MTOR, MUTYH, MYC, MYCL1, MYCN, MYD88, NF1, NF2, NFE2L2, NFKB1, NFKB2, NFKBIA, NGF, NKX2-1, NOTCH1, NOTCH2, NPM1, NRAS, NTRK1, NTRK2, NTRK3, NUP93, ODC1, OGFR, PAK3, PALB2, PAX5, PBRM1, PDGFC, PDGFRA, PDGFRB, PDK1, PGP, PGR (PR), PIK3CA, PIK3CG, PIK3R1, PIK3R2, POLA, PPARG, PPARGC1, PPP2R1A, PRDM1, PRKAR1A, PRKDC, PTCH1, PTEN, PTPN11, RAD50, RAD51, RAF1, RARA, RB1, RET, RICTOR, RNF43, ROS1, RPTOR, RRM1, RRM2, RRM2B, RUNX1, RXR, RXRB, RXRG, SETD2, SF3B1, SMAD2, SMAD4, SMARCA4, SMARCB1, SMO, SOCS1, SOX10, SOX2, SPARC, SPEN, SPOP, SRC, SST, SSTR1, SSTR2, SSTR3, SSTR4, SSTR5, STAG2, STAT4, STK11, SUFU, TET2, TGFBR2, TK1, TLE3, TMPRSS2, TNF, TNFAIP3, TNFRSF14, TOP1, TOP2, TOP2A, TOP2B, TP53, TS, TSC1, TSC2, TSHR, TUBB3, TXN, TYMP, VDR, VEGF (VEGFA), VEGFC, VHL, WISP3, WT1, XDH, XPO1, YES1, ZAP70, ZNF217, ZNF703 |
| Cancer Related | 5T4, ABl1, ABL1, ABL2, ACKR3, ACSL3, ACSL6, ACVR1B, ACVR2A, AFF1, AFF3, AFF4, AKAP9, AKT1, AKT2, AKT3, ALDH2, ALK, AMER1, ANG1/ANGPT1/TM7SF2, ANG2/ANGPT2/VPS51, APC, AR, ARAF, ARFRP1, ARHGAP26, ARHGEF12, ARID1A, ARID1B, ARID2, ARNT, ASPSCR1, ASXL1, ATF1, ATIC, ATM, ATP1A1, ATP2B3, ATR, ATRX, AURKA, AURKB, AXIN1, AXL, BAP1, BARD1, BBC3, BCL10, BCL11A, BCL11B, BCL2, BCL2L1, BCL2L11, BCL2L2, BCL3, BCL6, BCL7A, BCL9, BCOR, BCORL1, BCR, BIRC3, BLM, BMPR1A, BRAF, BRCA1, BRCA2, BRD3, BRD4, BRIP1, BTG1, BTK, BUB1B, c-KIT, C11orf30, c15orf21, C15orf65, C2orf44, CA6, CACNA1D, CALR, CAMTA1, CANT1, CARD11, CARS, CASC5, CASP8, CBFA2T3, CBFB, |

TABLE 4-continued

Illustrative Biomarkers

| Illustrative Class | Biomarkers |
|---|---|
| | CBL, CBLB, CBLC, CCDC6, CCNB1IP1, CCND1, CCND2, CCND3, CCNE1, CD110, CD123, CD137, CD19, CD20, CD274, CD27L, CD38, CD4, CD74, CD79A, CD79B, CDC73, CDH1, CDH11, CDK12, CDK4, CDK6, CDK7, CDK8, CDK9, CDKN1A, CDKN1B, CDKN2A, CDKN2B, CDKN2C, CDX2, CEBPA, CHCHD7, CHD2, CHD4, CHEK1, CHEK2, CHIC2, Chk1, CHN1, CIC, CIITA, CLP1, CLTC, CLTCL1, CNBP, CNOT3, CNTRL, COL1A1, COPB1, CoREST, COX6C, CRAF, CREB1, CREB3L1, CREB3L2, CREBBP, CRKL, CRLF2, CRTC1, CRTC3, CSF1R, CSF3R, CTCF, CTLA4, CTNNA1, CTNNB1, CUL3, CXCR4, CYLD, CYP17A1, CYP2D6, DAXX, DDB2, DDIT3, DDR1, DDR2, DDX10, DDX5, DDX6, DEK, DICER1, DLL-4, DNAPK, DNM2, DNMT3A, DOT1L, EBF1, ECT2L, EGFR, EIF4A2, ELF4, ELK4, ELL, ELN, EML4, EP300, EPHA3, EPHA5, EPHA7, EPHA8, EPHB1, EPHB2, EPS15, ERBB2, ERBB3, ERBB4, ERC1, ERCC1, ERCC2, ERCC3, ERCC4, ERCC5, ERG, ERRFI1, ESR1, ETBR, ETV1, ETV4, ETV5, ETV6, EWSR1, EXT1, EXT2, EZH2, EZR, FAK, FAM46C, FANCA, FANCC, FANCD2, FANCE, FANCF, FANCG, FANCL, FAS, FAT1, FBXO11, FBXW7, FCRL4, FEV, FGF10, FGF14, FGF19, FGF2, FGF23, FGF3, FGF4, FGF6, FGFR1, FGFR1OP, FGFR2, FGFR3, FGFR4, FH, FHIT, FIP1L1, FKBP12, FLCN, FLI1, FLT1, FLT3, FLT4, FNBP1, FOXA1, FOXL2, FOXO1, FOXO3, FOXO4, FOXP1, FRS2, FSTL3, FUBP1, FUS, GABRA6, GAS7, GATA1, GATA2, GATA3, GATA4, GATA6, GID4, GITR, GLI1, GMPS, GNA11, GNA13, GNAQ, GNAS, GNRH1, GOLGA5, GOPC, GPC3, GPHN, GPR124, GRIN2A, GRM3, GSK3B, GUCY2C, H3F3A, H3F3B, HCK, HERPUD1, HEY1, HGF, HIP1, HIST1H3B, HIST1H4I, HLF, HMGA1, HMGA2, HMT, HNF1A, HNRNPA2B1, HOOK3, HOXA11, HOXA13, HOXA9, HOXC11, HOXC13, HOXD11, HOXD13, HRAS, HSD3B1, HSP90AA1, HSP90AB1, IAP, IDH1, IDH2, IGF1R, IGF2, IKBKE, IKZF1, IL2, IL21R, IL6, IL6ST, IL7R, INHBA, INPP4B, IRF2, IRF4, IRS2, ITGAV, ITGB1, ITK, JAK1, JAK2, JAK3, JAZF1, JUN, KAT6A, KAT6B, KCNJ5, KDM5A, KDM5C, KDM6A, KDR, KDSR, KEAP1, KEL, KIAA1549, KIF5B, KIR3DL1, KLF4, KLHL6, KLK2, KMT2A, KMT2C, KMT2D, KRAS, KTN1, LASP1, LCK, LCP1, LGALS3, LGR5, LHFP, LIFR, LMO1, LMO2, LOXL2, LPP, LRIG3, LRP1B, LSD1, LYL1, LYN, LZTR1, MAF, MAFB, MAGI2, MALT1, MAML2, MAP2K1, MAP2K2, MAP2K4, MAP3K1, MAPK1, MAPK11, MAX, MCL1, MDM2, MDM4, MDS2, MECOM, MED12, MEF2B, MEK1, MEK2, MEN1, MET, MITF, MKL1, MLF1, MLH1, MLLT1, MLLT10, MLLT11, MLLT3, MLLT4, MLLT6, MMP9, MN1, MNX1, MPL, MPS1, MRE11A, MS4A1, MSH2, MSH6, MSI2, MSN, MST1R, MTCP1, MTOR, MUC1, MUC16, MUTYH, MYB, MYC, MYCL, MYCN, MYD88, MYH11, MYH9, NACA, NAE1, NBN, NCKIPSD, NCOA1, NCOA2, NCOA4, NDRG1, NF1, NF2, NFE2L2, NFIB, NFKB2, NFKBIA, NIN, NKX2-1, NONO, NOTCH1, NOTCH2, NOTCH3, NPM1, NR4A3, NRAS, NSD1, NT5C2, NTRK1, NTRK2, NTRK3, NUMA1, NUP214, NUP93, NUP98, NUTM1, NUTM2B, OLIG2, OMD, P2RY8, PAFAH1B2, PAK3, PALB2, PARK2, PARP1, PATZ1, PAX3, PAX5, PAX7, PAX8, PBRM1, PBX1, PCM1, PCSK7, PDCD1, PDCD1LG2, PDE4DIP, PDGFB, PDGFRA, PDGFRB, PDK1, PER1, PHF6, PHOX2B, PICALM, PIK3C2B, PIK3CA, PIK3CB, PIK3CD, PIK3CG, PIK3R1, PIK3R2, PIM1, PKC, PLAG1, PLCG2, PML, PMS1, PMS2, POLD1, POLE, POT1, POU2AF1, POU5F1, PPARG, PPP2R1A, PRCC, PRDM1, PRDM16, PREX2, PRF1, PRKAR1A, PRKCI, PRKDC, PRLR, PRRX1, PRSS8, PSIP1, PTCH1, PTEN, PTK2, PTPN11, PTPRC, PTPRD, QKI, RABEP1, RAC1, RAD21, RAD50, RAD51, RAD51B, RAF1, RALGDS, RANBP17, RANBP2, RANKL, RAP1GDS1, RARA, RB1, RBM10, RBM15, RECQL4, REL, RET, RHOH, RICTOR, RMI2, RNF213, RNF43, ROS1, RPL10, RPL20, RPL5, RPN1, RPS6KB1, RPTOR, RUNX1, RUNx1T1, SBDS, SDC4, SDHA, SDHAF2, SDHB, SDHC, SDHD, SEPT5, SEPT6, SEPT9, SET, SETBP1, SETD2, SF3B1, SFPQ, SH2B3, SH3GL1, SLAMF7, SLC34A2, SLC45A3, SLIT2, SMAD2, SMAD3, SMAD4, SMARCA4, SMARCB1, SMARCE1, SMO, SNCAIP, SNX29, SOCS1, SOX10, SOX2, SOX9, SPECC1, SPEN, SPOP, SPTA1, SRC, SRGAP3, SRSF2, SRSF3, SS18, SS18L1, SSX1, SSX2, SSX4, STAG2, STAT3, STAT4, STAT5B, STEAP1, STIL, STK11, SUFU, SUZ12, SYK, TAF1, TAF15, TAL1, TAL2, TBL1XR1, TBX3, TCEA1, TCF12, TCF3, TCF7L2, TCL1A, TERC, TERT, TET1, TET2, TFE3, TFEB, TFG, TFPT, TFRC, TGFB1, TGFBR2, THRAP3, TIE2, TLX1, TLX3, TMPRSS2, TNFAIP3, TNFRSF14, TNFRSF17, TOP1, TOP2A, TP53, TPM3, TPM4, TPR, TRAF7, TRIM26, TRIM27, TRIM33, TRIP11, TRRAP, TSC1, TSC2, TSHR, TTL, U2AF1, UBA1, UBR5, USP6, VEGFA, VEGFB, VEGFR, VHL, VTI1A, WAS, WEE1, WHSC1, WHSC1L1, WIF1, WISP3, WNT11, WNT2B, WNT3, WNT3A, WNT4, WNT5A, WNT6, WNT7B, WRN, WT1, WWTR1, XPA, XPC, XPO1, YWHAE, ZAK, ZBTB16, ZBTB2, ZMYM2, ZNF217, ZNF331, ZNF384, ZNF521, ZNF703, ZRSR2 |
| Cancer Related | ABL2, ACSL3, ACSL6, AFF1, AFF3, AFF4, AKAP9, AKT3, ALDH2, APC, ARFRP1, ARHGAP26, ARHGEF12, ARID2, ARNT, ASPSCR1, ASXL1, ATF1, ATIC, ATM, ATP1A1, ATR, AURKA, AXIN1, AXL, BAP1, BARD1, BCL10, BCL11A, BCL2L11, BCL3, BCL6, BCL7A, BCL9, BCR, BIRC3, BLM, BMPR1A, BRAF, BRCA1, BRCA2, BRIP1, BUB1B, C11orf30, C2orf44, CACNA1D, CALR, CAMTA1, CANT1, CARD11, CARS, CASC5, CASP8, CBFA2T3, CBFB, CBL, CBLB, CCDC6, CCNB1IP1, CCND2, CD274, CD74, CD79A, CDC73, CDH11, CDKN1B, CDX2, CHEK1, CHEK2, CHIC2, CHN1, CIC, CIITA, CLP1, CLTC, |

TABLE 4-continued

Illustrative Biomarkers

| Illustrative Class | Biomarkers |
|---|---|
| | CLTCL1, CNBP, CNTRL, COPB1, CREB1, CREB3L1, CREB3L2, CRTC1, CRTC3, CSF1R, CSF3R, CTCF, CTLA4, CTNNA1, CTNNB1, CYLD, CYP2D6, DAXX, DDR2, DDX10, DDX5, DDX6, DEK, DICER1, DOT1L, EBF1, ECT2L, ELK4, ELL, EML4, EPHA3, EPHA5, EPHB1, EPS15, ERBB3, ERBB4, ERC1, ERCC2, ERCC3, ERCC4, ERCC5, ERG, ESR1, ETV1, ETV5, ETV6, EWSR1, EXT1, EXT2, EZR, FANCA, FANCC, FANCD2, FANCE, FANCG, FANCL, FAS, FBXO11, FBXW7, FCRL4, FGF14, FGF19, FGF23, FGF6, FGFR1OP, FGFR4, FH, FHIT, FIP1L1, FLCN, FLI1, FLT1, FLT3, FLT4, FNBP1, FOXA1, FOXO1, FOXP1, FUBP1, FUS, GAS7, GID4, GMPS, GNA13, GNAQ, GNAS, GOLGA5, GOPC, GPHN, GPR124, GRIN2A, GSK3B, H3F3A, H3F3B, HERPUD1, HGF, HIP1, HMGA1, HMGA2, HNRNPA2B1, HOOK3, HSP90AA1, HSP90AB1, IDH1, IDH2, IGF1R, IKZF1, IL2, IL21R, IL6ST, IL7R, IRF4, ITK, JAK1, JAK2, JAK3, JAZF1, KDM5A, KEAP1, KIAA1549, KIF5B, KIT, KLHL6, KMT2A, KMT2C, KMT2D, KRAS, KTN1, LCK, LCP1, LGR5, LHFP, LIFR, LPP, LRIG3, LRP1B, LYL1, MAF, MALT1, MAML2, MAP2K2, MAP2K4, MAP3K1, MDM4, MDS2, MEF2B, MEN1, MITF, MLF1, MLH1, MLLT1, MLLT10, MLLT3, MLLT4, MLLT6, MNX1, MRE11A, MSH2, MSH6, MSI2, MTOR, MYB, MYCN, MYD88, MYH11, MYH9, NACA, NCKIPSD, NCOA1, NCOA2, NCOA4, NF1, NFE2L2, NFIB, NFKB2, NIN, NOTCH2, NPM1, NR4A3, NSD1, NT5C2, NTRK2, NTRK3, NUP214, NUP93, NUP98, NUTM1, PALB2, PAX3, PAX5, PAX7, PBRM1, PBX1, PCM1, PCSK7, PDCD1, PDCD1LG2, PDGFB, PDGFRA, PDGFRB, PDK1, PER1, PICALM, PIK3CA, PIK3R1, PIK3R2, PIM1, PML, PMS2, POLE, POT1, POU2AF1, PPARG, PRCC, PRDM1, PRDM16, PRKAR1A, PRRX1, PSIP1, PTCH1, PTEN, PTPN11, PTPRC, RABEP1, RAC1, RAD50, RAD51, RAD51B, RAF1, RALGDS, RANBP17, RAP1GDS1, RARA, RBM15, REL, RET, RMI2, RNF43, RPL20, RPL5, RPN1, RPTOR, RUNX1, RUNX1T1, SBDS, SDC4, SDHAF2, SDHB, SDHC, SDHD, 8-Sep, SET, SETBP1, SETD2, SF3B1, SH2B3, SH3GL1, SLC34A2, SMAD2, SMAD4, SMARCB1, SMARCE1, SMO, SNX29, SOX10, SPECC1, SPEN, SRGAP3, SRSF2, SRSF3, SS18, SS18L1, STAT3, STAT4, STAT5B, STIL, STK11, SUFU, SUZ12, SYK, TAF15, TCF12, TCF3, TCF7L2, TET1, TET2, TFEB, TFG, TFRC, TGFBR2, TLX1, TNFAIP3, TNFRSF14, TNFRSF17, TP53, TPM3, TPM4, TPR, TRAF7, TRIM26, TRIM27, TRIM33, TRIP11, TRRAP, TSC1, TSC2, TSHR, TTL, U2AF1, USP6, VEGFA, VEGFB, VTI1A, WHSC1, WHSC1L1, WIF1, WISP3, WRN, WWTR1, XPA, XPC, XPO1, YWHAE, ZMYM2, ZNF217, ZNF331, ZNF384, ZNF521, ZNF703 |
| Gene fusions and mutations in cancer | AKT3, ALK, ARHGAP26, AXL, BRAF, BRD3/4, EGFR, ERG, ESR1, ETV1/4/5/6, EWSR1, FGFR1, FGFR2, FGFR3, FGR, INSR, MAML2, MAST1/2, MET, MSMB, MUSK, MYB, NOTCH1/2, NRG1, NTRK1/2/3, NUMBL, NUTM1, PDGFRA/B, PIK3CA, PKN1, PPARG, PRKCA/B, RAF1, RELA, RET, ROS1, RSPO2/3, TERT, TFE3, TFEB, THADA, TMPRSS2 |
| Gene fusions and mutations in cancer | ABL1 fusion to (ETV6, NUP214, RCSD1, RANBP2, SNX2, or ZMIZ1); ABL2 fusion to (PAG1 or RCSD1); CSF1R fusion to (SSBP2); PDGFRB fusion to (EBF1, SSBP2, TNIP1 or ZEB2); CRLF2 fusion to (P2RY8); JAK2 fusion to (ATF7IP, BCR, ETV6, PAX5, PPFIBP1, SSBP2, STRN3, TERF2, or TPR); EPOR fusion to (IGH or IGK); IL2RB fusion to (MYH9); NTRK3 fusion to (ETV6); PTK2B fusion to (KDM6A or STAG2); TSLP fusion to (IQGAP2); TYK2 fusion to (MYB) |
| Cytohesions | cytohesin-1 (CYTH1), cytohesin-2 (CYTH2; ARNO), cytohesin-3 (CYTH3; Grp1; ARNO3), cytohesin-4 (CYTH4) |
| Cancer/Angio | Erb 2, Erb 3, Erb 4, UNC93a, B7H3, MUC1, MUC2, MUC16, MUC17, 5T4, RAGE, VEGF A, VEGFR2, FLT1, DLL4, Epcam |
| Tissue (Breast) | BIG H3, GCDFP-15, PR(B), GPR 30, CYFRA 21, BRCA 1, BRCA 2, ESR 1, ESR2 |
| Tissue (Prostate) | PSMA, PCSA, PSCA, PSA, TMPRSS2 |
| Inflammation/Immune | MFG-E8, IFNAR, CD40, CD80, MICB, HLA-DRb, IL-17-Ra |

Examples of additional biomarkers that can be incorporated into the methods and compositions of the invention include without limitation those disclosed in International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety.

In various embodiments of the invention, the biomarkers or biosignature used to detect or assess any of the conditions or diseases disclosed herein can comprise one or more biomarkers in one of several different categories of markers, wherein the categories include without limitation one or more of: 1) disease specific biomarkers; 2) cell- or tissue-specific biomarkers; 3) vesicle-specific markers (e.g., general vesicle biomarkers); 4) angiogenesis-specific biomarkers; and 5) immunomodulatory biomarkers. Examples of all such markers are disclosed herein and known to a person having ordinary skill in the art. Furthermore, a biomarker known in the art that is characterized to have a role in a particular disease or condition can be adapted for use as a target in compositions and methods of the invention. In further embodiments, such biomarkers of interest may be cellular or vesicular surface markers, or a combination of surface markers and soluble or payload markers (e.g., molecules enclosed by a microvesicle). The biomarkers assessed can be from a combination of sources. For example, a disease or disorder may be detected or characterized by assessing a combination of proteins, nucleic acids, vesicles, circulating biomarkers, biomarkers from a tissue sample, and the like. In addition, as noted herein, the biological sample assessed can be any biological fluid, or can comprise individual components present within such biological fluid (e.g., vesicles, nucleic acids, proteins, or complexes thereof).

Biomarker Detection

The compositions and methods of the invention can be used to assess any useful biomarkers in a biological sample for characterizing a phenotype associated with the sample. Such biomarkers include all sorts of biological entities such as proteins, nucleic acids, lipids, carbohydrates, complexes of any thereof, and microvesicles.

The aptamers of the invention can be used to provide a biosignature in tissue or bodily fluids, e.g., by assessing various biomarkers therein. See, e.g., FIGS. 10B-C. The aptamers of the invention can also be used to assess levels or presence of their specific target molecule. See, e.g., FIG. 10A. In addition, aptamers of the invention are used to capture or isolated a component present in a biological sample that has the aptamer's target molecule present. For example, if a given surface antigen is present on a cell, cell fragment or cell-derived extracellular vesicle, a binding agent to the biomarker, including without limitation an aptamer provided by the invention, may be used to capture or isolate the cell, cell fragment or cell-derived extracellular vesicles. See, e.g., FIGS. 1A-B, 10A. Such captured or isolated entities may be further characterized to assess additional surface antigens or internal "payload" molecules, e.g., nucleic acid molecules, lipids, sugars, polypeptides or functional fragments thereof, or anything else present in the cellular milieu that may be used as a biomarker. Therefore, aptamers of the invention are used not only to assess one or more surface antigen of interest but are also used to separate a component present in a biological sample, where the components themselves can be comprised within the biosignature.

The methods of the invention can comprise multiplex analysis of at least 2, 3, 4, 5, 6, 7, 8, 9, 10, 11, 12, 13, 14, 15, 16, 17, 18, 19, 20, 25, 50, 75, 100, 200, 300, 400, 500, 600, 700, 800, 900, 1000, or more different biomarkers. For example, an oligonucleotide pool may contain any number of individual aptamers that can target different biomarkers. As another example, an assay can be performed with a plurality of particles that are differentially labeled. There can be at least 2, 3, 4, 5, 6, 7, 8, 9, 10, 11, 12, 13, 14, 15, 16, 17, 18, 19, 20, 25, 50, 75 or 100 differentially labeled particles. The particles may be externally labeled, such as with a tag, or they may be intrinsically labeled. Each differentially labeled particle can be coupled to a capture agent, such as a antibody or aptamer, and can be used to capture its target. The multiple capture agents can be selected to characterize a phenotype of interest, including capture agents against general vesicle biomarkers, cell-of-origin specific biomarkers, and disease biomarkers. One or more captured biomarkers can be detected by a plurality of binding agents. The binding agent can be directly labeled to facilitate detection. Alternatively, the binding agent is labeled by a secondary agent. For example, the binding agent may be an antibody or aptamer for a biomarker, wherein the binding agent is linked to biotin. A secondary agent comprises streptavidin linked to a reporter and can be added to detect the biomarker. In some embodiments, the captured vesicle is assayed for at least 2, 3, 4, 5, 6, 7, 8, 9, 10, 11, 12, 13, 14, 15, 16, 17, 18, 19, 20, 25, 50, 75 or 100 different biomarkers. For example, multiple detectors, i.e., detection of multiple biomarkers of a captured vesicle or population of vesicles, can increase the signal obtained, permitted increased sensitivity, specificity, or both, and the use of smaller amounts of samples. Detection can be with more than one biomarker, including without limitation more than one vesicle marker such as in any of Tables 3-4, and Tables 10-17.

An immunoassay based method (e.g., sandwich assay) can be used to detect a biomarker of interest. An example includes ELISA. A binding agent can be bound to a well. For example, a binding agent such as an aptamer or antibody to biomarker of interest can be attached to a well. A captured biomarker can be detected based on the methods described herein. FIG. 1A shows an illustrative schematic for a sandwich-type of immunoassay. The capture agent can be against a cellular or vesicular antigen of. In the figure, the captured entities are detected using fluorescently labeled binding agent (detection agent) against antigens of interest. Multiple capture binding agents can be used, e.g., in distinguishable addresses on an array or different wells of an immunoassay plate. The detection binding agents can be against the same antigen as the capture binding agent, or can be directed against other markers. The capture binding agent can be any useful binding agent, e.g., tethered aptamers, antibodies or lectins, and/or the detector antibodies can be similarly substituted, e.g., with detectable (e.g., labeled) aptamers, antibodies, lectins or other binding proteins or entities.

In an embodiment, one or more capture agents to a general vesicle biomarker, a cell-of-origin marker, and/or a disease marker are used along with detection agents against general vesicle biomarker, such as tetraspanin molecules including without limitation one or more of CD9, CD63 and CD81, or other markers in Table 3 herein. Examples of microvesicle surface antigens are disclosed herein, e.g. in Tables 3-4 and 10-17. Further biomarkers and detection techniques are disclosed in International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety.

Techniques of detecting biomarkers or capturing sample components using an aptamer of the invention include the use of a planar substrate such as an array (e.g., biochip or microarray), with molecules immobilized to the substrate as capture agents that facilitate the detection of a particular biosignature. The array can be provided as part of a kit for assaying one or more biomarkers. Aptamers of the invention can be included in an array for detection and diagnosis of diseases including presymptomatic diseases. In some embodiments, an array comprises a custom array comprising biomolecules selected to specifically identify biomarkers of interest. Customized arrays can be modified to detect biomarkers that increase statistical performance, e.g., additional biomolecules that identifies a biosignature which lead to improved cross-validated error rates in multivariate prediction models (e.g., logistic regression, discriminant analysis, or regression tree models). In some embodiments, customized array(s) are constructed to study the biology of a disease, condition or syndrome and profile biosignatures in defined physiological states. Markers for inclusion on the customized array be chosen based upon statistical criteria, e.g., having a desired level of statistical significance in differentiating between phenotypes or physiological states. In some embodiments, standard significance of p-value=0.05 is chosen to exclude or include biomolecules on the microarray. The p-values can be corrected for multiple comparisons. As an illustrative example, nucleic acids extracted from samples from a subject with or without a disease can be hybridized to a high density microarray that binds to thousands of gene sequences. Nucleic acids whose levels are significantly different between the samples with or without the disease can be selected as biomarkers to distinguish samples as having the disease or not. A customized array can be constructed to detect the selected biomarkers. In some embodiments, customized arrays comprise low density microarrays, which refer to arrays with lower number of addressable binding agents, e.g., tens or hundreds instead of thousands. Low density arrays can be formed on a substrate. In some embodiments, customizable low density arrays use PCR amplification in plate wells, e.g., TaqMan® Gene Expression Assays (Applied Biosystems by Life Technologies Corporation, Carlsbad, Calif.).

An aptamer of the invention or other useful binding agent may be linked directly or indirectly to a solid surface or substrate. A solid surface or substrate can be any physically separable solid to which a binding agent can be directly or indirectly attached including, but not limited to, surfaces provided by microarrays and wells, particles such as beads, columns, optical fibers, wipes, glass and modified or functionalized glass, quartz, mica, diazotized membranes (paper or nylon), polyfbrmaldehyde, cellulose, cellulose acetate, paper, ceramics, metals, metalloids, semiconductive materials, quantum dots, coated beads or particles, other chromatographic materials, magnetic particles; plastics (including acrylics, polystyrene, copolymers of styrene or other materials, polypropylene, polyethylene, polybutylene, polyurethanes, Teflon material, etc.), polysaccharides, nylon or nitrocellulose, resins, silica or silica-based materials including silicon and modified silicon, carbon, metals, inorganic glasses, plastics, ceramics, conducting polymers (including polymers such as polypyrole and polyindole); micro or nanostructured surfaces such as nucleic acid tiling arrays, nanotube, nanowire, or nanoparticulate decorated surfaces; or porous surfaces or gels such as methacrylates, acrylamides, sugar polymers, cellulose, silicates, or other fibrous or stranded polymers. In addition, as is known the art, the substrate may be coated using passive or chemically-derivatized coatings with any number of materials, including polymers, such as dextrans, acrylamides, gelatins or agarose. Such coatings can facilitate the use of the array with a biological sample.

An aptamer or other useful binding agent can be conjugated to a detectable entity or label. Appropriate labels include without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, semiconductor nanocrystal or other nanoparticles including quantum dots or gold particles, fluorophores, quantum dots, or radioactive labels. Protein labels include green fluorescent protein (GFP) and variants thereof (e.g., cyan fluorescent protein and yellow fluorescent protein); and luminescent proteins such as luciferase, as described below. Radioactive labels include without limitation radioisotopes (radionuclides), such as $^{3}$H, $^{11}$C, $^{14}$C, $^{18}$F, $^{32}$P, $^{35}$S, $^{64}$Cu, $^{68}$Ga, $^{86}$Y, $^{99m}$Tc, $^{111}$In, $^{123}$I, $^{124}$I, $^{125}$I, $^{131}$I, $^{133}$Xe, $^{177}$Lu, $^{211}$At, or $^{213}$Bi. Fluorescent labels include without limitation a rare earth chelate (e.g., europium chelate), rhodamine; fluorescein types including without limitation FITC, 5-carboxyfluorescein, 6-carboxy fluorescein; a rhodamine type including without limitation TAMRA; dansyl; Lissamine; cyanines; phycoerythrins; Texas Red; Cy3, Cy5, dapoxyl, NBD, Cascade Yellow, dansyl, PyMPO, pyrene, 7-diethylaminocoumarin-3-carboxylic acid and other coumarin derivatives, Marina Blue™, Pacific Blue™, Cascade Blue™, 2-anthracenesulfonyl, PyMPO, 3,4,9,10-perylene-tetracarboxylic acid, 2,7-difluorofluorescein (Oregon Green™488-X), 5-carboxyfluorescein, Texas Red™-X, Alexa Fluor 430, 5-carboxytetramethylrhodamine (5-TAMRA), 6-carboxytetramethylrhodamine (6-TAMRA), BODIPY FL, bimane, and Alexa Fluor 350, 405, 488, 500, 514, 532, 546, 555, 568, 594, 610, 633, 647, 660, 680, 700, and 750, and derivatives thereof, among many others. See, e.g., "The Handbook-A Guide to Fluorescent Probes and Labeling Technologies," Tenth Edition, available on the internet at probes (dot) invitrogen (dot) corn/handbook. The fluorescent label can be one or more of FAM, dRHO, 5-FAM, 6FAM, dR6G, JOE, HEX, VIC, TET, dTAMRA, TAMRA, NED, dROX, PET, BHQ, Gold540 and LIZ.

Using conventional techniques, an aptamer can be directly or indirectly labeled. In a non-limiting example, the label is attached to the aptamer through biotin-streptavidin/avidin chemistry. For example, synthesize a biotinylated aptamer, which is then capable of binding a streptavidin molecule that is itself conjugated to a detectable label; non-limiting example is streptavidin, phycoerythrin conjugated (SAPE)). Methods for chemical coupling using multiple step procedures include biotinylation, coupling of trinitrophenol (TNP) or digoxigenin using for example succinimide esters of these compounds. Biotinylation can be accomplished by, for example, the use of D-biotinyl-N-hydroxysuccinimide. Succinimide groups react effectively with amino groups at pH values above 7, and preferentially between about pH 8.0 and about pH 8.5. The labeling may comprise a secondary labeling system. As a non-limiting example, the aptamer can be conjugated to biotin or digoxigenin. Target bound aptamer can be detected using streptavidin/avidin or anti-digoxigenin antibodies, respectively.

Various enzyme-substrate labels may also be used in conjunction with a composition or method of the invention. Such enzyme-substrate labels are available commercially (e.g., U.S. Pat. No. 4,275,149). The enzyme generally catalyzes a chemical alteration of a chromogenic substrate that can be measured using various techniques. For example, the enzyme may catalyze a color change in a substrate, which can be measured spectrophotometrically. Alternatively, the enzyme may alter the fluorescence or chemiluminescence of the substrate. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRP), alkaline phosphatase (AP), β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Examples of enzyme-substrate combinations include, but are not limited to, horseradish peroxidase (HRP) with hydrogen peroxidase as a substrate, wherein the hydrogen peroxidase oxidizes a dye precursor (e.g., orthophenylene diamine (OPD) or 3,3',5,5'-tetramethylbenzidine hydrochloride (TMB)); alkaline phosphatase (AP) with para-nitrophenyl phosphate as chromogenic substrate; and β-D-galactosidase (β-D-Gal) with a chromogenic substrate (e.g., p-nitrophenyl-3-D-galactosidase) or fluorogenic substrate 4-methylumbelliferyl-o-D-galactosidase.

Aptamer(s) can be linked to a substrate such as a planar substrate. A planar array generally contains addressable locations (e.g., pads, addresses, or micro-locations) of biomolecules in an array format. The size of the array will depend on the composition and end use of the array. Arrays can be made containing from 2 different molecules to many thousands. Generally, the array comprises from two to as many as 100,000 or more molecules, depending on the end use of the array and the method of manufacture. A microarray for use with the invention comprises at least one biomolecule that identifies or captures a biomarker present in a biosignature of interest, e.g., a cell, microRNA or other biomolecule or vesicle that makes up the biosignature. In some arrays, multiple substrates are used, either of different or identical compositions. Accordingly, planar arrays may comprise a plurality of smaller substrates.

The present invention can make use of many types of arrays for detecting a biomarker, e.g., a biomarker associated with a biosignature of interest. Useful arrays or microarrays include without limitation DNA microarrays, such as cDNA microarrays, oligonucleotide microarrays and SNP microarrays, microRNA arrays, protein microarrays, antibody microarrays, tissue microarrays, cellular microarrays (also called transfection microarrays), chemical compound microarrays, and carbohydrate arrays (glycoarrays). These arrays are described in more detail above. In some embodiments, microarrays comprise biochips that provide high-density immobilized arrays of recognition molecules (e.g., aptamers or antibodies), where biomarker binding is monitored indirectly (e.g., via fluorescence).

An array or microarray that can be used to detect a biosignature comprising one or more aptamers of the invention can be made according to the methods described in U.S. Pat. Nos. 6,329,209; 6,365,418; 6,406,921; 6,475,808; and 6,475,809, and U.S. patent application Ser. No. 10/884,269, each of which is herein incorporated by reference in its entirety. Custom arrays to detect specific can be made using the methods described in these patents. Commercially available microarrays can also be used to carry out the methods of the invention, including without limitation those from Affymetrix (Santa Clara, Calif.), Illumina (San Diego, Calif.), Agilent (Santa Clara, Calif.), Exiqon (Denmark), or Invitrogen (Carlsbad, Calif.). Custom and/or commercial arrays include arrays for detection proteins, nucleic acids, and other biological molecules and entities (e.g., cells, vesicles, virii) as described herein.

In some embodiments, multiple capture molecules are disposed on an array, e.g., proteins, peptides or additional nucleic acid molecules. In certain embodiments, the proteins are immobilized using methods and materials that minimize the denaturing of the proteins, that minimize alterations in the activity of the proteins, or that minimize interactions between the protein and the surface on which they are immobilized. The capture molecules can comprise one or more aptamer of the invention. In one embodiment, an array is constructed for the hybridization of a pool of aptamers. The array can then be used to identify pool members that bind a sample, thereby facilitating characterization of a phenotype. See FIGS. 10B-10C and related disclosure for further details.

Array surfaces useful may be of any desired shape, form, or size. Non-limiting examples of surfaces include chips, continuous surfaces, curved surfaces, flexible surfaces, films, plates, sheets, or tubes. Surfaces can have areas ranging from approximately a square micron to approximately 500 cm$^2$. The area, length, and width of surfaces may be varied according to the requirements of the assay to be performed. Considerations may include, for example, ease of handling, limitations of the material(s) of which the surface is formed, requirements of detection systems, requirements of deposition systems (e.g., arrayers), or the like.

In certain embodiments, it is desirable to employ a physical means for separating groups or arrays of binding islands or immobilized biomolecules: such physical separation facilitates exposure of different groups or arrays to different solutions of interest. Therefore, in certain embodiments, arrays are situated within microwell plates having any number of wells. In such embodiments, the bottoms of the wells may serve as surfaces for the formation of arrays, or arrays may be formed on other surfaces and then placed into wells. In certain embodiments, such as where a surface without wells is used, binding islands may be formed or molecules may be immobilized on a surface and a gasket having holes spatially arranged so that they correspond to the islands or biomolecules may be placed on the surface. Such a gasket is preferably liquid tight. A gasket may be placed on a surface at any time during the process of making the array and may be removed if separation of groups or arrays is no longer desired.

In some embodiments, the immobilized molecules can bind to one or more biomarkers present in a biological sample contacting the immobilized molecules. Contacting the sample typically comprises overlaying the sample upon the array.

Modifications or binding of molecules in solution or immobilized on an array can be detected using detection techniques known in the art. Examples of such techniques include immunological techniques such as competitive binding assays and sandwich assays; fluorescence detection using instruments such as confocal scanners, confocal microscopes, or CCD-based systems and techniques such as fluorescence, fluorescence polarization (FP), fluorescence resonant energy transfer (FREIT), total internal reflection fluorescence (TIRF), fluorescence correlation spectroscopy (FCS); colorimetric/spectrometric techniques; surface plasmon resonance, by which changes in mass of materials adsorbed at surfaces are measured; techniques using radioisotopes, including conventional radioisotope binding and scintillation proximity assays (SPA); mass spectroscopy, such as matrix-assisted laser desorption/ionization mass spectroscopy (MALDI) and MALDI-time of flight (TOF) mass spectroscopy; ellipsometry, which is an optical method of measuring thickness of protein films; quartz crystal microbalance (QCM), a very sensitive method for measuring mass of materials adsorbing to surfaces; scanning probe microscopies, such as atomic force microscopy (AFM), scanning force microscopy (SFM) or scanning electron microscopy (SEM); and techniques such as electrochemical, impedance, acoustic, microwave, and IR/Raman detection. See, e.g., Mere L, et al., "*Miniaturized FRET assays and microfluidics: key components for ultra-high-throughput screening.*" *Drug Discovery Today* 4(8):363-369 (1999), and references cited therein; Lakowicz J R, *Principles of Fluorescence Spectroscopy.* 2nd Edition. Plenum Press (1999), or Jain K K: *Integrative Omics, Pharmacoproteomics, and Human Body Fluids. In: Thongboonkerd V*, ed., ed. *Proteomics of Human Body Fluids: Principles, Methods and Applications.* Volume 1: Totowa, N.J.: Humana Press, 2007, each of which is herein incorporated by reference in its entirety.

Microarray technology can be combined with mass spectroscopy (MS) analysis and other tools. Electrospray interface to a mass spectrometer can be integrated with a capillary in a microfluidics device. For example, one commercially available system contains eTag reporters that are fluorescent labels with unique and well-defined electrophoretic mobilities; each label is coupled to biological or chemical probes via cleavable linkages. The distinct mobility address of each eTag reporter allows mixtures of these tags to be rapidly deconvoluted and quantitated by capillary electrophoresis. This system allows concurrent gene expression, protein expression, and protein function analyses from the same sample Jain K K: *Integrative Omics, Pharmacoproteomics, and Human Body Fluids. In: Thongboonkerd V*, ed., ed. *Proteomics of Human Body Fluids: Principles, Methods and Applications.* Volume 1: Totowa, N.J.: Humana Press, 2007, which is herein incorporated by reference in its entirety.

A biochip can include components for a microfluidic or nanofluidic assay. A microfluidic device can be used for isolating or analyzing biomarkers, such as determining a biosignature. Microfluidic systems allow for the miniaturization and compartmentalization of one or more processes for detecting a biosignature, and other processes. The microfluidic devices can use one or more detection reagents in at least one aspect of the system, and such a detection reagent can be used to detect one or more biomarkers. Various probes, antibodies, proteins, or other binding agents can be used to detect a biomarker within the microfluidic system. The detection agents, e.g., oligonucleotide probes of the invention, may be immobilized in different compartments of the microfluidic device or be entered into a hybridization or detection reaction through various channels of the device.

Nanofabrication techniques are opening up the possibilities for biosensing applications that rely on fabrication of high-density, precision arrays, e.g., nucleotide-based chips and protein arrays otherwise known as heterogeneous nanoarrays. Nanofluidics allows a further reduction in the quantity of fluid analyte in a microchip to nanoliter levels, and the chips used here are referred to as nanochips. See, e.g., Unger M et al., *Biotechniques* 1999; 27(5):1008-14, Kartalov E P et al., *Biotechniques* 2006; 40(1):85-90, each of which are herein incorporated by reference in their entireties. Commercially available nanochips currently provide simple one step assays such as total cholesterol, total protein or glucose assays that can be run by combining sample and reagents, mixing and monitoring of the reaction. Gel-free analytical approaches based on liquid chromatography (LC) and nanoLC separations (Cutillas et al. *Proteomics*, 2005; 5:101-112 and Cutillas et al., *Mol Cell Proteomics* 2005; 4:1038-1051, each of which is herein incorporated by reference in its entirety) can be used in combination with the nanochips.

An array suitable for identifying a disease, condition, syndrome or physiological status can be included in a kit. A kit can include, an aptamer of the invention, including as non-limiting examples, one or more reagents useful for preparing molecules for immobilization onto binding islands or areas of an array, reagents useful for detecting binding of biomarkers to immobilized molecules, e.g., aptamers, and instructions for use.

Further provided herein is a rapid detection device that facilitates the detection of a particular biosignature in a biological sample. The device can integrate biological sample preparation with polymerase chain reaction (PCR) on a chip. The device can facilitate the detection of a particular biosignature of a vesicle in a biological sample, and an example is provided as described in Pipper et al., *Angewandte Chemie*, 47(21), p. 3900-3904 (2008), which is herein incorporated by reference in its entirety. A biosignature can be incorporated using micro-/nano-electrochemical system (MEMS/NEMS) sensors and oral fluid for diagnostic applications as described in Li et al., *Adv Dent Res* 18(1): 3-5 (2005), which is herein incorporated by reference in its entirety.

As an alternative to planar arrays, assays using particles, such as bead based assays are also capable of use with an aptamer of the invention. Aptamers are easily conjugated with commercially available beads. See, e.g., Srinivas et al. Anal. Chem. 2011 Oct. 21, *Aptamer functionalized Microgel Particles for Protein Detection*; See also, review article on aptamers as therapeutic and diagnostic agents, Brody and Gold, Rev. Mol. Biotech. 2000, 74:5-13.

Figure 1B:
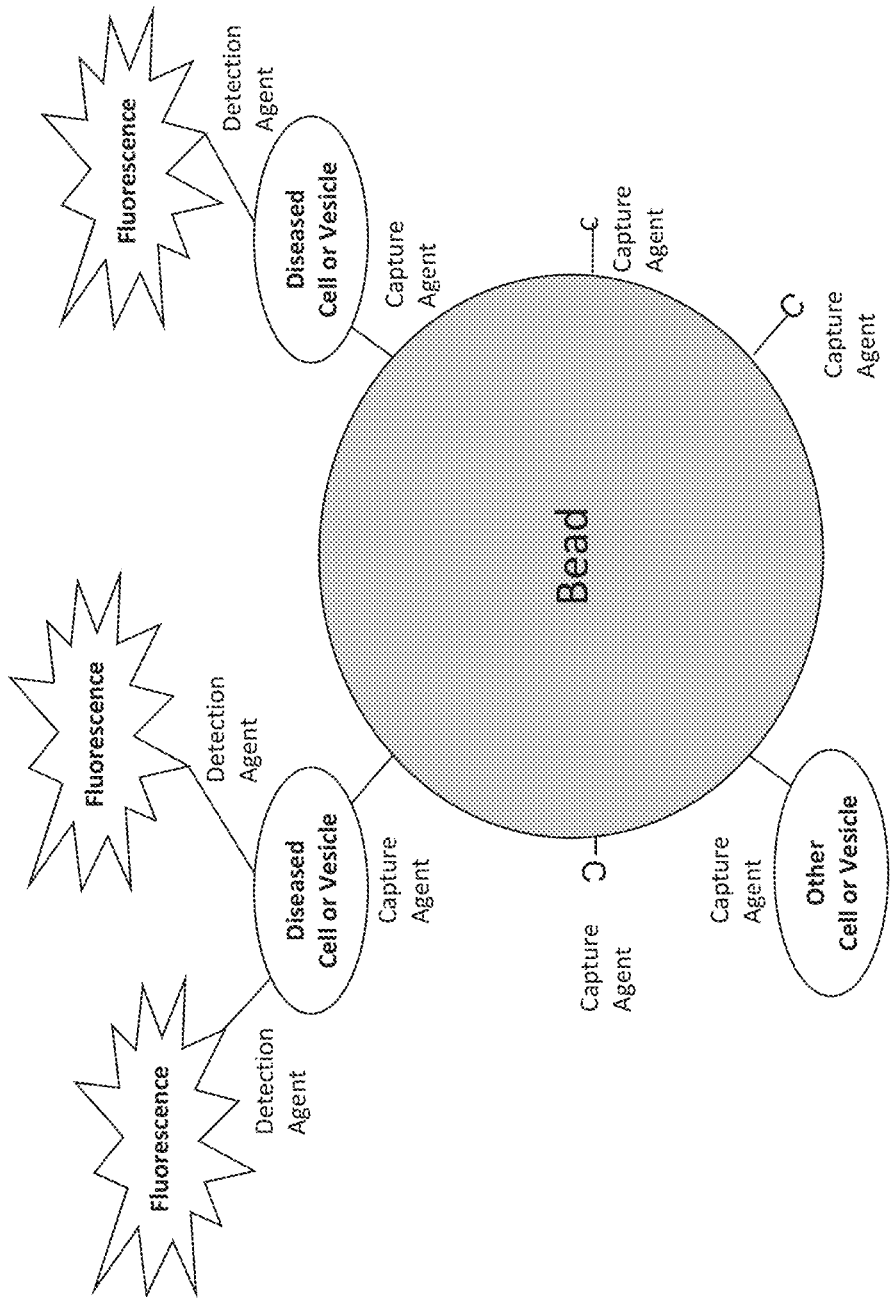

Multiparametric assays or other high throughput detection assays using bead coatings with cognate ligands and reporter molecules with specific activities consistent with high sensitivity automation can be used. In a bead based assay system, a binding agent such as an antibody or aptamer can be immobilized on an addressable microsphere. Each binding agent for each individual binding assay can be coupled to a distinct type of microsphere (i.e., microbead) and the assay reaction takes place on the surface of the microsphere, such as depicted in FIG. 1B. In a non-limiting example, a binding agent for a cell or microvesicle can be a capture antibody or aptamer coupled to a bead. Dyed microspheres with discrete fluorescence intensities are loaded separately with their appropriate binding agent or capture probes. The different bead sets carrying different binding agents can be pooled as desired to generate custom bead arrays. Bead arrays are then incubated with the sample in a single reaction vessel to perform the assay.

Bead-based assays can be used with one or more aptamers of the invention. A bead substrate can provide a platform for attaching one or more binding agents, including aptamer(s). For multiplexing, multiple different bead sets (e.g., Illumina, Luminex) can have different binding agents (specific to different target molecules). For example, a bead can be conjugated to an aptamer of the invention used to detect the presence (quantitatively or qualitatively) of an antigen of interest, or it can also be used to isolate a component present in a selected biological sample (e.g., cell, cell-fragment or vesicle comprising the target molecule to which the aptamer is configured to bind or associate). Any molecule of organic origin can be successfully conjugated to a polystyrene bead through use of commercially available kits.

One or more aptamers of the invention can be used with any bead based substrate, including but not limited to magnetic capture method, fluorescence activated cell sorting (FACS) or laser cytometry. Magnetic capture methods can include, but are not limited to, the use of magnetically activated cell sorter (MACS) microbeads or magnetic columns. Examples of bead or particle based methods that can be modified to use an aptamer of the invention include methods and bead systems described in U.S. Pat. Nos. 4,551,435, 4,795,698, 4,925,788, 5,108,933, 5,186,827, 5,200,084 or 5,158,871; 7,399,632; 8,124,015; 8,008,019; 7,955,802; 7,445,844; 7,274,316; 6,773,812; 6,623,526; 6,599,331; 6,057,107; 5,736,330; International Patent Publication No. WO/2012/174282; WO/1993/022684.

Isolation or detection of circulating biomarkers, e.g., protein antigens, from a biological sample, or of the biomarker-comprising cells, cell fragments or vesicles may also be achieved using an aptamer of the invention in a cytometry process. As a non-limiting example, aptamers of the invention can be used in an assay comprising using a particle such as a bead or microsphere. The invention provides aptamers as binding agents, which may be conjugated to the particle. Flow cytometry can be used for sorting microscopic particles suspended in a stream of fluid. As particles pass through they can be selectively charged and on their exit can be deflected into separate paths of flow. It is therefore possible to separate populations from an original mix, such as a biological sample, with a high degree of accuracy and speed. Flow cytometry allows simultaneous multiparametric analysis of the physical and/or chemical characteristics of single cells flowing through an optical/electronic detection apparatus. A beam of light, usually laser light, of a single frequency (color) is directed onto a hydrodynamically focused stream of fluid. A number of detectors are aimed at the point where the stream passes through the light beam; one in line with the light beam (Forward Scatter or FSC) and several perpendicular to it (Side Scatter or SSC) and one or more fluorescent detectors.

Each suspended particle passing through the beam scatters the light in some way, and fluorescent chemicals in the particle may be excited into emitting light at a lower frequency than the light source. This combination of scattered and fluorescent light is picked up by the detectors, and by analyzing fluctuations in brightness at each detector (one for each fluorescent emission peak), it is possible to deduce various facts about the physical and chemical structure of each individual particle. FSC correlates with the cell size and SSC depends on the inner complexity of the particle, such as shape of the nucleus, the amount and type of cytoplasmic granules or the membrane roughness. Some flow cytometers have eliminated the need for fluorescence and use only light scatter for measurement.

Flow cytometers can analyze several thousand particles every second in "real time" and can actively separate out and isolate particles having specified properties. They offer high-throughput automated quantification, and separation, of the set parameters for a high number of single cells during each analysis session. Flow cytometers can have multiple lasers and fluorescence detectors, allowing multiple labels to be used to more precisely specify a target population by their phenotype. Thus, a flow cytometer, such as a multicolor flow cytometer, can be used to detect targets of interest using multiple fluorescent labels or colors. In some embodiments, the flow cytometer can also sort or isolate different targets of interest, such as by size or by different markers.

The flow cytometer may have one or more lasers, such as 1, 2, 3, 4, 5, 6, 7, 8, 9, 10 or more lasers. In some embodiments, the flow cytometer can detect more than one color or fluorescent label, such as at least 2, 3, 4, 5, 6, 7, 8, 9, 10, 11, 12, 13, 14, 15, 16, 17, 18, 19, or 20 different colors or fluorescent labels. For example, the flow cytometer can have at least 2, 3, 4, 5, 6, 7, 8, 9, 10, 11, 12, 13, 14, 15, 16, 17, 18, 19, or 20 fluorescence detectors.

Examples of commercially available flow cytometers include, but are not limited to the MoFlo™ XDP Cell Sorter (Beckman Coulter, Brea, Calif.), MoFlo™ Legacy Cell Sorter (Beckman Coulter, Brea, Calif.), BD FACSAria™ Cell Sorter (BD Biosciences, San Jose, Calif.), BD™ LSRII (BD Biosciences, San Jose, Calif.), and BD FACSCalibur™ (BD Biosciences, San Jose, Calif.). Use of multicolor or multi-fluor cytometers can be used in multiplex analysis. In some embodiments, the flow cytometer can sort, and thereby collect or sort more than one population of cells, microvesicles, or particles, based one or more characteristics. For example, two populations differ in size, such that the populations have a similar size range can be differentially detected or sorted. In another embodiment, two different populations are differentially labeled.

The data resulting from flow-cytometers can be plotted in 1 dimension to produce histograms or seen in 2 dimensions as dot plots or in 3 dimensions with newer software. The regions on these plots can be sequentially separated by a series of subset extractions which are termed gates. Specific gating protocols exist for diagnostic and clinical purposes especially in relation to hematology. The plots are often made on logarithmic scales. Because different fluorescent dye's emission spectra overlap, signals at the detectors have to be compensated electronically as well as computationally. Fluorophores for labeling biomarkers may include those described in Ormerod, Flow Cytometry 2nd ed. Springer-Verlag, New York (1999), and in Nida et al., Gynecologic Oncology 2005; 4 889-894 which is incorporated herein by reference. In a multiplexed assay, including but not limited to a flow cytometry assay, one or more different target molecules can be assessed using an aptamer of the invention.

One or more aptamer of the invention can be disposed on any useful planar or bead substrate. In one aspect of the invention one or more aptamer of the invention is disposed on a microfluidic device, thereby facilitating assessing, characterizing or isolating a component of a biological sample comprising a polypeptide antigen of interest or a functional fragment thereof. For example, the circulating antigen or a cell, cell fragment or cell-derived microvesicles comprising the antigen can be assessed using one or more aptamers of the invention (alternatively along with additional binding agents). Microfluidic devices, which may also be referred to as "lab-on-a-chip" systems, biomedical micro-electro-mechanical systems (bioMEMs), or multicomponent integrated systems, can be used for isolating and analyzing such entities. Such systems miniaturize and compartmentalize processes that allow for detection of biosignatures and other processes.

A microfluidic device can also be used for isolation of a cell, cell fragment or cell-derived microvesicles through size differential or affinity selection. For example, a microfluidic device can use one more channels for isolating entities from a biological sample based on size or by using one or more binding agents. A biological sample can be introduced into one or more microfluidic channels, which selectively allows the passage of the entity. The selection can be based on a property such as the size, shape, deformability, or biosignature.

In one embodiment, a heterogeneous population of cells, cell fragments, microvesicles or other biomarkers (e.g., protein complexes) is introduced into a microfluidic device, and one or more different homogeneous populations of such entities can be obtained. For example, different channels can have different size selections or binding agents to select for different populations of such entities. Thus, a microfluidic device can isolate a plurality of entities wherein at least a subset of the plurality comprises a different biosignature from another subset of the plurality. For example, the microfluidic device can isolate at least 2, 3, 4, 5, 6, 7, 8, 9, 10, 15, 20, 25, 30, 40, 50, 60, 70, 80, 90, or 100 different subsets, wherein each subset comprises a different biosignature.

In some embodiments, the microfluidic device can comprise one or more channels that permit further enrichment or selection of targets of interest. A population that has been enriched after passage through a first channel can be introduced into a second channel, which allows the passage of the desired population to be further enriched, such as through one or more binding agents present in the second channel.

Array-based assays and bead-based assays can be used with a microfluidic device. For example, the binding agent, such as an oligonucleotide probe, can be coupled to beads and the binding reaction between the beads and targets of the binding agent can be performed in a microfluidic device. Multiplexing can also be performed using a microfluidic device. Different compartments can comprise different binding agents for different target populations. In one embodiment, each population has a different biosignature. The hybridization reaction between the microsphere and target can be performed in a microfluidic device and the reaction mixture can be delivered to a detection device. The detection device, such as a dual or multiple laser detection system can be part of the microfluidic system and can use a laser to identify each bead or microsphere by its color-coding, and another laser can detect the hybridization signal associated with each bead.

Any appropriate microfluidic device can be used in the methods of the invention. Examples of microfluidic devices that may be used include but are not limited to those described in U.S. Pat. Nos. 7,591,936, 7,581,429, 7,579,136, 7,575,722, 7,568,399, 7,552,741, 7,544,506, 7,541,578, 7,518,726, 7,488,596, 7,485,214, 7,467,928, 7,452,713, 7,452,509, 7,449,096, 7,431,887, 7,422,725, 7,422,669, 7,419,822, 7,419,639, 7,413,709, 7,411,184, 7,402,229, 7,390,463, 7,381,471, 7,357,864, 7,351,592, 7,351,380, 7,338,637, 7,329,391, 7,323,140, 7,261,824, 7,258,837, 7,253,003, 7,238,324, 7,238,255, 7,233,865, 7,229,538, 7,201,881, 7,195,986, 7,189,581, 7,189,580, 7,189,368, 7,141,978, 7,138,062, 7,135,147, 7,125,711, 7,118,910, 7,118,661, 7,640,947, 7,666,361, 7,704,735; and International Patent Publication WO 2010/072410; each of which patents or applications are incorporated herein by reference in their entirety. Another example for use with methods disclosed herein is described in Chen et al., "Microfluidic isolation and transcriptome analysis of serum vesicles." Lab on a Chip. Dec. 8, 2009 DOI: 10.1039/b916199f.

Other microfluidic devices for use with the invention include devices comprising elastomeric layers, valves and pumps, including without limitation those disclosed in U.S. Pat. Nos. 5,376,252, 6,408,878, 6,645,432, 6,719,868, 6,793,753, 6,899,137, 6,929,030, 7,040,338, 7,118,910, 7,144,616, 7,216,671, 7,250,128, 7,494,555, 7,501,245, 7,601,270, 7,691,333, 7,754,010, 7,837,946; U.S. Patent Application Nos. 2003/0061687, 2005/0084421, 2005/0112882, 2005/0129581, 2005/0145496, 2005/0201901, 2005/0214173, 2005/0252773, 2006/0006067; and EP Patent Nos. 0527905 and 1065378; each of which application is herein incorporated by reference.

The microfluidic device can have one or more binding agents attached to a surface in a channel, or present in a channel. For example, the microchannel can have one or more capture agents, such as an oligonucleotide probe of the invention. The surface of the channel can also be contacted with a blocking aptamer if desired. In one embodiment, a microchannel surface is treated with avidin/streptavidin and a capture agent, such as an antibody or aptamer, that is biotinylated can be injected into the channel to bind the avidin. In other embodiments, the capture agents are present in chambers or other components of a microfluidic device. The capture agents can also be attached to beads that can be manipulated to move through the microfluidic channels. In one embodiment, the capture agents are attached to magnetic beads. The beads can be manipulated using magnets.

A biological sample can be flowed into the microfluidic device, or a microchannel, at rates such as at least about 1, 2, 3, 4, 5, 6, 7, 8, 9, 10, 11, 12, 13, 14, 15, 16, 17, 18, 19, 20, 25, 30, 35, 40, 45, or 50 µl per minute, such as between about 1-50, 5-40, 5-30, 3-20 or 5-15 µl per minute. One or more targets of interest can be captured and directly detected in the microfluidic device. Alternatively, the captured target may be released and exit the microfluidic device prior to analysis. In another embodiment, one or more captured cells or microvesicles are lysed in the microchannel and the lysate can be analyzed. Lysis buffer can be flowed through the channel. The lysate can be collected and analyzed, such as performing RT-PCR, PCR, mass spectrometry, Western blotting, or other assays, to detect one or more biomarkers of the captured cells or microvesicles.

Microvesicles and related biomarkers can be analyzed using the oligonucleotide probes of the invention. Microvesicle isolation can be performed using various techniques as, including without limitation size exclusion chromatography, density gradient centrifugation, differential centrifugation, nanomembrane ultrafiltration, immunoabsorbent capture, affinity purification, affinity capture, immunoassay, immunoprecipitation, microfluidic separation, flow cytometry, polymeric isolation (e.g., using polyethylene glycol (PEG)) or combinations thereof. Methods and techniques for microvesicle and vesicular payload isolation and analysis are disclosed in International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety.

The compositions and methods of the invention can be used in and with various immune assay formats. Immunoaffinity assays can be based on antibodies and aptamers selectively immunoreactive with proteins or other biomarkers of interest. These techniques include without limitation immunoprecipitation, Western blot analysis, molecular binding assays, enzyme-linked immunosorbent assay (ELISA), enzyme-linked immunofiltration assay (ELIFA), fluorescence activated cell sorting (FACS), immunohistochemistry (IHC) and the like. For example, an optional method of detecting the expression of a biomarker in a sample comprises contacting the sample with an antibody or aptamer against the biomarker, or an immunoreactive fragment thereof, or a recombinant protein containing an antigen binding region against the biomarker, and then detecting the binding of the biomarker in the sample. Various methods for producing antibodies and aptamers are known in the art. Such binding agents can be used to immunoprecipitate specific proteins from solution samples or to immunoblot proteins separated by, e.g., polyacrylamide gels. Immunocytochemical methods can also be used in detecting specific protein polymorphisms in tissues or cells. Other well-known immunoassay techniques can also be used including, e.g., ELISA, radioimmunoassay (RIA), immunoradiometric assays (IRMA) and immunoenzymatic assays (IEMA), including sandwich assays. See, e.g., U.S. Pat. Nos. 4,376,110 and 4,486,530, both of which are incorporated herein by reference.

In alternative methods, a sample may be contacted with an antibody or aptamer specific for a biomarker under conditions sufficient for a complex to form, and then detecting such complex. The presence of the biomarker may be detected in a number of ways, such as by Western blotting and ELISA procedures for assaying a wide variety of tissues and samples, including bodily fluids such as plasma or serum. A wide range of immunoassay techniques using such an assay format are available, see, e.g., U.S. Pat. Nos. 4,016,043, 4,424,279 and 4,018,653. These include both single-site and two-site or "sandwich" assays of the non-competitive types, as well as in the traditional competitive binding assays. These assays also include direct binding of a labelled antibody or aptamer to a target biomarker.

There are a number of variations of the sandwich assay technique which can be encompassed within the present invention. In a typical forward assay, an unlabeled binding agent, e.g., an antibody or aptamer, is immobilized on a solid substrate, and the sample to be tested brought into contact with the bound molecule. After a suitable period of of time sufficient to allow formation of an complex, a second binding agent specific to the antigen, labelled with a reporter molecule capable of producing a detectable signal is then added and incubated, allowing time sufficient for the formation of another complex comprising the labelled binding agent. Any unreacted material is washed away, and the presence of the antigen is determined by observation of a signal produced by the reporter molecule. The results may either be qualitative, by simple observation of the visible signal, or may be quantitated by comparing with a control sample containing known amounts of biomarker.

Variations on the above assay include a simultaneous assay, in which both sample and labelled binding agent are added simultaneously to the tethered binding agent. In a typical forward sandwich assay, a first binding agent, e.g., an antibody or aptamer, having specificity for a tissue/cell/biomarker or such target of interest is either covalently or passively bound to a solid surface. The solid surface is typically glass or a polymer, the most commonly used polymers being cellulose, polyacrylamide, nylon, polystyrene, polyvinyl chloride or polypropylene. The solid supports may be in the form of tubes, beads, discs of microplates, or any other surface suitable for conducting an immunoassay. The binding processes generally consist of cross-linking, covalently binding or physically adsorbing, the polymer-antibody complex to the support, which is then washed in preparation for the test sample. An aliquot of the sample to be tested is then added to the solid phase complex and incubated for a period of time sufficient (e.g., 2-40 minutes or overnight) and under suitable conditions (e.g. from room temperature to 40° C. such as between 25° C. and 32° C. inclusive) to allow binding of the target to the support. Following the incubation period, the support is washed and incubated with a second binding agent specific for a portion of the biomarker. The second binding agent is linked to a reporter molecule which is used to indicate the binding of the second binding agent to the molecular marker.

An alternative method involves immobilizing the target biomarkers in the sample and then exposing the immobilized target to specific binding agents, e.g., antibodies or aptamers, which may or may not be labelled with a reporter molecule. Depending on the amount of target and the strength of the reporter molecule signal, a bound target may be detectable by direct labelling with the binding agent. Alternatively, a second labelled binding agent, specific to the first binding agent, is exposed to the first target complex to form a tertiary complex. The complex is detected by the signal emitted by the reporter molecule. A "reporter molecule" includes molecule which, by its chemical nature, provides an analytically identifiable signal which allows the detection of antigen-bound complexes. Some commonly used reporter molecules in this type of assay include enzymes, fluorophores or radionuclide containing molecules (i.e. radioisotopes) and chemiluminescent molecules. Examples of such detectable labels are disclosed herein.

In the case of an enzyme immunoassay, an enzyme is conjugated to the secondary binding agent. Commonly used enzymes include horseradish peroxidase, glucose oxidase, β-galactosidase and alkaline phosphatase, amongst others. The substrates to be used with the specific enzymes are generally chosen for the production, upon hydrolysis by the corresponding enzyme, of a detectable color change. Examples of suitable enzymes include alkaline phosphatase and peroxidase. It is also possible to employ fluorogenic substrates, which yield a fluorescent product rather than the chromogenic substrates noted above. In all cases, the enzyme-labelled binding agent is added to the first bound molecular marker complex, allowed to bind, and then the excess reagent is washed away. A solution containing the appropriate substrate is then added to the tertiary complex comprising primary binding agent, antigen, and secondary binding agent. The substrate will react with the enzyme linked to the secondary binding agent, giving a qualitative visual signal, which may be further quantitated, usually spectrophotometrically, to give an indication of the amount of antigen which was present in the sample. Alternately, fluorescent compounds, such as fluorescein and rhodamine, may be chemically coupled to secondary binding agent without altering their binding capacity. When activated by illumination with light of a particular wavelength, the fluorochrome-labelled secondary binding agent adsorbs the light energy, inducing a state to excitability in the molecule, followed by emission of the light at a characteristic color visually detectable with a light microscope. As in the EIA, the fluorescent labelled secondary binding agent is allowed to bind to antigen complex. After washing off the unbound reagent, the remaining tertiary complex is then exposed to the light of the appropriate wavelength. The fluorescence observed indicates the presence of the molecular marker of interest. Immunofluorescence and EIA techniques are both very well established in the art. However, other reporter molecules, such as radioisotope, chemiluminescent or bioluminescent molecules, may also be employed.

Immunohistorchemistry (IHC) is a process of localizing antigens (e.g., proteins) in cells of a tissue using binding agents (e.g., antibodies or aptamers) specifically to antigens in the tissues. The antigen-binding binding agent can be conjugated or fused to a tag that allows its detection, e.g., via visualization. In some embodiments, the tag is an enzyme that can catalyze a color-producing reaction, such as alkaline phosphatase or horseradish peroxidase. The enzyme can be fused to the binding agent or non-covalently bound, e.g., using a biotin-avadin/streptavidin system. Alternatively, the binding agent can be tagged with a fluorophore, such as fluorescein, rhodamine, DyLight Fluor or Alexa Fluor. The binding agent can be directly tagged or it can itself be recognized by a secondary detection binding agent (antibody or antigen) that carries the tag. Using IHC, one or more proteins may be detected. The expression of a gene product can be related to its staining intensity compared to control levels. In some embodiments, the gene product is considered differentially expressed if its staining varies at least 1.2, 1.3, 1.4, 1.5, 1.6, 1.7, 1.8, 1.9, 2.0, 2.2, 2.5, 2.7, 3.0, 4, 5, 6, 7, 8, 9 or 10-fold in the sample versus the control.

IHC comprises the application of such immunoassay formats to histochemical techniques. In an illustrative example, a tissue section is mounted on a slide and is incubated with a binding agent. The binding agents are typically polyclonal or monoclonal antibodies, and can be aptamers such as oligonucleotide probes of the invention, specific to the antigen. The primary reaction comprises contacting the tissue section with this primary binding agent, forming primary complexes. The antigen-antibody signal is then amplified using a second binding agent conjugated to a complex of that can provide a visible signal, such as enzymes including without limitation peroxidase antiperoxidase (PAP), avidin-biotin-peroxidase (ABC) or avidin-biotin alkaline phosphatase. In the presence of substrate and chromogen, the enzyme forms a colored deposit at the sites of primary complexes. Immunofluorescence is an alternate approach to visualize antigens. In this technique, the primary signal is amplified using a second binding agent conjugated to a fluorochrome. On UV light absorption, the fluorochrome emits its own light at a longer wavelength (fluorescence), thus allowing localization of the primary complexes.

The invention provides methods of performing an IHC assay using an oligonucleotide probe library. This may be referred to as a polyligand histochemistry assay (PHC). As an example of this approach, a tissue section is contacted with an enriched oligonucleotide probe library. Members of the library can be labeled, e.g., with a biotin molecule, digoxigenin, or other label as appropriate. The bound library members are visualized using a secondary labeling system, e.g., streptavidin-horse radish peroxidase (SA-HRP) or anti-digoxigenin horse radish peroxidase. The resulting slides can be read and scored as in typical antibody based IHC methods. See Examples 19-31 herein.

Oligonucleotide Probes/Aptamers

Aptamers have a number of desirable characteristics for use as therapeutics and diagnostics including high specificity and affinity, biological efficacy, and excellent pharmacokinetic properties. In addition, they offer certain advantages over antibodies and other protein biologics. For example, aptamers are produced by an entirely in vitro process, allowing for the rapid synthesis. In vitro selection allows the specificity and affinity of the aptamer to be tightly controlled. In addition, aptamers as a class have demonstrated little or no toxicity or immunogenicity. Whereas the efficacy of many monoclonal antibodies can be severely limited by immune response to antibodies themselves, it is difficult to elicit antibodies to aptamers most likely because aptamers cannot be presented by T-cells via the MHC and the immune response is generally trained not to recognize nucleic acid fragments. Whereas most currently approved antibody therapeutics are administered by intravenous infusion (typically over 2-4 hours), aptamers can be administered by subcutaneous injection. This difference is primarily due to the comparatively low solubility and thus large volumes necessary for most therapeutic mAbs. With good solubility (>150 mg/mL) and comparatively low molecular weight (aptamer: 10-50 kDa; antibody: 150 kDa), a weekly dose of aptamer may be delivered by injection in a volume of less than 0.5 mL. In addition, the small size of aptamers allows them to penetrate into areas of conformational constrictions that do not allow for antibodies or antibody fragments to penetrate, presenting yet another advantage of aptamer-based therapeutics or prophylaxis.

Aptamers are chemically synthesized and are readily scaled as needed to meet production demand for diagnostic or therapeutic applications. In addition, aptamers are chemically robust. They can be adapted to regain activity following exposure to factors such as heat and denaturants and can be stored for extended periods (>1 yr) at room temperature as lyophilized powders.

SELEX

The classical method for generating an aptamer is with the process entitled "Systematic Evolution of Ligands by Exponential Enrichment" ("SELEX") generally described in, e.g., U.S. patent application Ser. No. 07/536,428, filed Jun. 11, 1990, now abandoned, U.S. Pat. No. 5,475,096 entitled "Nucleic Acid Ligands", and U.S. Pat. No. 5,270,163 (see also WO 91/19813) entitled "Nucleic Acid Ligands." Each SELEX-identified nucleic acid ligand, i.e., each aptamer (or oligonucleotide probe), is a specific ligand of a given target compound or molecule. The SELEX process is based on the insight that nucleic acids have sufficient capacity for forming a variety of two- and three-dimensional structures and sufficient chemical versatility available within their monomers to act as ligands (i.e., form specific binding pairs) with any variety of chemical compounds, whether monomeric or polymeric. Molecules of any size or composition can serve as targets.

SELEX relies as a starting point upon a large library or pool of single stranded oligonucleotides comprising randomized sequences. The oligonucleotides can be modified or unmodified DNA, RNA, or DNA/RNA hybrids. In some examples, the pool comprises 100% random or partially random oligonucleotides. In other examples, the pool comprises random or partially random oligonucleotides containing at least one fixed and/or conserved sequence incorporated within randomized sequence. In other examples, the pool comprises random or partially random oligonucleotides containing at least one fixed and/or conserved sequence at its 5' and/or 3' end which may comprise a sequence shared by all the molecules of the oligonucleotide pool. Fixed sequences are sequences such as hybridization sites for PCR primers, promoter sequences for RNA polymerases (e.g., T3, T4, T7, and SP6), restriction sites, or homopolymeric sequences, such as poly A or poly T tracts, catalytic cores, sites for selective binding to affinity columns, and other sequences to facilitate cloning and/or sequencing of an oligonucleotide of interest. Conserved sequences are sequences, other than the previously described fixed sequences, shared by a number of aptamers that bind to the same target.

The oligonucleotides of the pool preferably include a randomized sequence portion as well as fixed sequences necessary for efficient amplification. Typically the oligonucleotides of the starting pool contain fixed 5' and 3' terminal sequences which flank an internal region of 30-50 random nucleotides. The randomized nucleotides can be produced in a number of ways including chemical synthesis and size selection from randomly cleaved cellular nucleic acids. Sequence variation in test nucleic acids can also be introduced or increased by mutagenesis before or during the selection/amplification iterations.

The random sequence portion of the oligonucleotide can be of any appropriate length and can comprise ribonucleotides and/or deoxyribonucleotides and can include modified or non-natural nucleotides or nucleotide analogs. See, e.g. U.S. Pat. Nos. 5,958,691; 5,660,985; 5,958,691; 5,698,687; 5,817,635; 5,672,695, and PCT Publication WO 92/07065. Random oligonucleotides can be synthesized from phosphodiester-linked nucleotides using solid phase oligonucleotide synthesis techniques well known in the art. See, e.g., Froehler et al., Nucl. Acid Res. 14:5399-5467 (1986) and Froehler et al., Tet. Lett. 27:5575-5578 (1986). Random oligonucleotides can also be synthesized using solution phase methods such as triester synthesis methods. See, e.g., Sood et al., Nucl. Acid Res. 4:2557 (1977) and Hirose et al., Tet. Lett., 28:2449 (1978). Typical syntheses carried out on automated DNA synthesis equipment yield $10^{14}$-$10^{16}$ individual molecules, a number sufficient for most SELEX experiments. Sufficiently large regions of random sequence in the sequence design increases the likelihood that each synthesized molecule is likely to represent a unique sequence.

The starting library of oligonucleotides may be generated by automated chemical synthesis on a DNA synthesizer. To synthesize randomized sequences, mixtures of all four nucleotides are added at each nucleotide addition step during the synthesis process, allowing for random incorporation of nucleotides. As stated above, in one embodiment, random oligonucleotides comprise entirely random sequences; however, in other embodiments, random oligonucleotides can comprise stretches of nonrandom or partially random sequences. Partially random sequences can be created by adding the four nucleotides in different molar ratios at each addition step.

The starting library of oligonucleotides may be for example, RNA, DNA, or RNA/DNA hybrid. A starting RNA library can be generated by transcribing a DNA library in vitro using T7 RNA polymerase or modified T7 RNA polymerases and purified. The library is then mixed with the target under conditions favorable for binding and subjected to step-wise iterations of binding, partitioning and amplification, using the same general selection scheme, to achieve virtually any desired criterion of binding affinity and selectivity. More specifically, starting with a mixture containing the starting pool of nucleic acids, the SELEX method includes steps of: (a) contacting the mixture with the target under conditions favorable for binding; (b) partitioning unbound nucleic acids from those nucleic acids which have bound specifically to target molecules; (c) dissociating the nucleic acid-target complexes; (d) amplifying the nucleic acids dissociated from the nucleic acid-target complexes to yield a ligand-enriched mixture of nucleic acids; and (e) reiterating the steps of binding, partitioning, dissociating and amplifying through as many cycles as desired to yield highly specific, high affinity nucleic acid ligands to the target molecule. In those instances where RNA aptamers are being selected, the SELEX method further comprises the steps of: (i) reverse transcribing the nucleic acids dissociated from the nucleic acid-target complexes before amplification in step (d); and (ii) transcribing the amplified nucleic acids from step (d) before restarting the process.

Within a nucleic acid mixture containing a large number of possible sequences and structures, there is a wide range of binding affinities for a given target. A nucleic acid mixture comprising, for example, a 20 nucleotide randomized segment can have $4^{20}$ candidate possibilities. Those which have the higher affinity constants for the target are most likely to bind to the target. After partitioning, dissociation and amplification, a second nucleic acid mixture is generated, enriched for the higher binding affinity candidates. Additional rounds of selection progressively favor better ligands until the resulting nucleic acid mixture is predominantly composed of only one or a few sequences. These can then be cloned, sequenced and individually tested for binding affinity as pure ligands or aptamers.

Cycles of selection and amplification are repeated until a desired goal is achieved. In the most general case, selection/amplification is continued until no significant improvement in binding strength is achieved on repetition of the cycle. The method is typically used to sample approximately $10^{14}$ different nucleic acid species but may be used to sample as many as about $10^{18}$ different nucleic acid species. Generally, nucleic acid aptamer molecules are selected in a 5 to 20 cycle procedure. In one embodiment, heterogeneity is introduced only in the initial selection stages and does not occur throughout the replicating process.

In one embodiment of SELEX, the selection process is so efficient at isolating those nucleic acid ligands that bind most strongly to the selected target, that only one cycle of selection and amplification is required. Such an efficient selection may occur, for example, in a chromatographic-type process wherein the ability of nucleic acids to associate with targets bound on a column operates in such a manner that the column is sufficiently able to allow separation and isolation of the highest affinity nucleic acid ligands.

In many cases, it is not necessarily desirable to perform the iterative steps of SELEX until a single nucleic acid ligand is identified. The target-specific nucleic acid ligand solution may include a family of nucleic acid structures or motifs that have a number of conserved sequences and a number of sequences which can be substituted or added without significantly affecting the affinity of the nucleic acid ligands to the target. By terminating the SELEX process prior to completion, it is possible to determine the sequence of a number of members of the nucleic acid ligand solution family. The invention provides for the identification of aptamer pools and uses thereof that jointly can be used to characterize a test sample. For example, the aptamer pools can be identified through rounds of positive and negative selection to identify cells, tissue or microvesicles indicative of a disease or condition. The invention further provides use of such aptamer pools to stain, detect and/or quantify such cells, tissue or microvesicles in a sample, thereby allowing a diagnosis, prognosis or theranosis to be provided.

A variety of nucleic acid primary, secondary and tertiary structures are known to exist. The structures or motifs that have been shown most commonly to be involved in non-Watson-Crick type interactions are referred to as hairpin loops, symmetric and asymmetric bulges, pseudoknots and myriad combinations of the same. Such motifs can typically be formed in a nucleic acid sequence of no more than 30 nucleotides. For this reason, it is often preferred that SELEX procedures with contiguous randomized segments be initiated with nucleic acid sequences containing a randomized segment of between about 20 to about 50 nucleotides and in some embodiments, about 30 to about 40 nucleotides. In one example, the 5'-fixed:random:3'-fixed sequence comprises a random sequence of about 30 to about 50 nucleotides. The random region may be referred to as the variable region herein.

The core SELEX method has been modified to achieve a number of specific objectives. For example, U.S. Pat. No. 5,707,796 describes the use of SELEX in conjunction with gel electrophoresis to select nucleic acid molecules with specific structural characteristics, such as bent DNA. U.S. Pat. No. 5,763,177 describes SELEX based methods for selecting nucleic acid ligands containing photoreactive groups capable of binding and/or photocrosslinking to and/or photoinactivating a target molecule. U.S. Pat. Nos. 5,567,588 and 5,861,254 describe SELEX based methods which achieve highly efficient partitioning between oligonucleotides having high and low affinity for a target molecule. U.S. Pat. No. 5,496,938 describes methods for obtaining improved nucleic acid ligands after the SELEX process has been performed. U.S. Pat. No. 5,705,337 describes methods for covalently linking a ligand to its target.

SELEX can also be used to obtain nucleic acid ligands that bind to more than one site on the target molecule, and to obtain nucleic acid ligands that include non-nucleic acid species that bind to specific sites on the target. SELEX provides means for isolating and identifying nucleic acid ligands which bind to any envisionable target, including large and small biomolecules such as nucleic acid-binding proteins and proteins not known to bind nucleic acids as part of their biological function as well as lipids, cofactors and other small molecules. For example, U.S. Pat. No. 5,580,737 discloses nucleic acid sequences identified through SELEX which are capable of binding with high affinity to caffeine and the closely related analog, theophylline.

Counter-SELEX is a method for improving the specificity of nucleic acid ligands to a target molecule by eliminating nucleic acid ligand sequences with cross-reactivity to one or more non-target molecules. Counter-SELEX is comprised of the steps of: (a) preparing a candidate mixture of nucleic acids; (b) contacting the candidate mixture with the target, wherein nucleic acids having an increased affinity to the target relative to the candidate mixture may be partitioned from the remainder of the candidate mixture; (c) partitioning the increased affinity nucleic acids from the remainder of the candidate mixture; (d) dissociating the increased affinity nucleic acids from the target; e) contacting the increased affinity nucleic acids with one or more non-target molecules such that nucleic acid ligands with specific affinity for the non-target molecule(s) are removed; and (f) amplifying the nucleic acids with specific affinity only to the target molecule to yield a mixture of nucleic acids enriched for nucleic acid sequences with a relatively higher affinity and specificity for binding to the target molecule. As described above for SELEX, cycles of selection and amplification are repeated until a desired goal is achieved.

A potential problem encountered in the use of nucleic acids as therapeutics and vaccines is that oligonucleotides in their phosphodiester form may be quickly degraded in body fluids by intracellular and extracellular enzymes such as endonucleases and exonucleases before the desired effect is manifest. The SELEX method thus encompasses the identification of high-affinity nucleic acid ligands containing modified nucleotides conferring improved characteristics on the ligand, such as improved in vivo stability or improved delivery characteristics. Examples of such modifications include chemical substitutions at the ribose and/or phosphate and/or base positions. SELEX identified nucleic acid ligands containing modified nucleotides are described, e.g., in U.S. Pat. No. 5,660,985, which describes oligonucleotides containing nucleotide derivatives chemically modified at the 2' position of ribose, 5' position of pyrimidines, and 8' position of purines, U.S. Pat. No. 5,756,703 which describes oligonucleotides containing various 2'-modified pyrimidines, and U.S. Pat. No. 5,580,737 which describes highly specific nucleic acid ligands containing one or more nucleotides modified with 2'-amino (2'-$NH_2$), 2'-fluoro (2'-F), and/or 2'-O-methyl (2'-OMe) substituents.

Modifications of the nucleic acid ligands contemplated in this invention include, but are not limited to, those which provide other chemical groups that incorporate additional charge, polarizability, hydrophobicity, hydrogen bonding, electrostatic interaction, and fluxionality to the nucleic acid ligand bases or to the nucleic acid ligand as a whole. Modifications to generate oligonucleotide populations which are resistant to nucleases can also include one or more substitute internucleotide linkages, altered sugars, altered bases, or combinations thereof. Such modifications include, but are not limited to, 2'-position sugar modifications, 5-position pyrimidine modifications, 8-position purine modifications, modifications at exocyclic amines, substitution of 4-thiouridine, substitution of 5-bromo or 5-iodo-uracil; backbone modifications, phosphorothioate or allyl phosphate modifications, methylations, and unusual base-pairing combinations such as the isobases isocytidine and isoguanosine. Modifications can also include 3' and 5' modifications such as capping.

In one embodiment, oligonucleotides are provided in which the P(O)O group is replaced by P(O)S ("thioate"), P(S)S ("dithioate"), P(O)$NR_2$ ("amidate"), P(O)R, P(O)OR', CO or $CH_2$ ("formacetal") or 3'-amine (—NH—$CH_2$—$CH_2$—), wherein each R or R' is independently H or substituted or unsubstituted alkyl. Linkage groups can be attached to adjacent nucleotides through an —O—, —N—, or —S— linkage. Not all linkages in the oligonucleotide are required to be identical. As used herein, the term phosphorothioate encompasses one or more non-bridging oxygen atoms in a phosphodiester bond replaced by one or more sulfur atoms.

In further embodiments, the oligonucleotides comprise modified sugar groups, for example, one or more of the hydroxyl groups is replaced with halogen, aliphatic groups, or functionalized as ethers or amines. In one embodiment, the 2'-position of the furanose residue is substituted by any of an O-methyl, O-alkyl, O-allyl, S-alkyl, S-allyl, or halo group. Methods of synthesis of 2-modified sugars are described, e.g., in Sproat, et al., Nucl. Acid Res. 19:733-738 (1991); Cotten, et al., Nucl. Acid Res. 19:2629-2635 (1991); and Hobbs, et al., Biochemistry 12:5138-5145 (1973). Other modifications are known to one of ordinary skill in the art. Such modifications may be pre-SELEX process modifications or post-SELEX process modifications (modification of previously identified unmodified ligands) or may be made by incorporation into the SELEX process.

Pre-SELEX process modifications or those made by incorporation into the SELEX process yield nucleic acid ligands with both specificity for their SELEX target and improved stability, e.g., in vivo stability. Post-SELEX process modifications made to nucleic acid ligands may result in improved stability, e.g., in vivo stability without adversely affecting the binding capacity of the nucleic acid ligand.

The SELEX method encompasses combining selected oligonucleotides with other selected oligonucleotides and non-oligonucleotide functional units as described in U.S. Pat. Nos. 5,637,459 and 5,683,867. The SELEX method further encompasses combining selected nucleic acid ligands with lipophilic or non-immunogenic high molecular weight compounds in a diagnostic or therapeutic complex, as described, e.g., in U.S. Pat. Nos. 6,011,020, 6,051,698, and PCT Publication No. WO 98/18480. These patents and applications teach the combination of a broad array of shapes and other properties, with the efficient amplification and replication properties of oligonucleotides, and with the desirable properties of other molecules.

The identification of nucleic acid ligands to small, flexible peptides via the SELEX method has also been explored. U.S. Pat. No. 5,648,214 identified high affinity RNA nucleic acid ligands to an 11 amino acid.

Aptamers/oligonucleotide probes with desired specificity and binding affinity to the target(s) of interest to the present invention can be selected by the SELEX N process as described herein. As part of the SELEX process, the sequences selected to bind to the target are then optionally minimized to determine the minimal sequence having the desired binding affinity. The selected sequences and/or the minimized sequences are optionally optimized by performing random or directed mutagenesis of the sequence to increase binding affinity or alternatively to determine which positions in the sequence are essential for binding activity. Additionally, selections can be performed with sequences incorporating modified nucleotides to stabilize the aptamer molecules against degradation in vivo.

For an aptamer to be suitable for use as a therapeutic, it is preferably inexpensive to synthesize, and safe and stable in vivo. Wild-type RNA and DNA aptamers are typically not stable is vivo because of their susceptibility to degradation by nucleases. Resistance to nuclease degradation can be greatly increased by the incorporation of modifying groups at the 2'-position.

Fluoro and amino groups have been successfully incorporated into oligonucleotide pools from which aptamers have been subsequently selected. However, these modifications greatly increase the cost of synthesis of the resultant aptamer, and may introduce safety concerns in some cases because of the possibility that the modified nucleotides could be recycled into host DNA by degradation of the modified oligonucleotides and subsequent use of the nucleotides as substrates for DNA synthesis.

Aptamers that contain 2'-O-methyl ("2'-OMe") nucleotides, as provided herein, may overcome one or more potential drawbacks. Oligonucleotides containing 2'-OMe nucleotides are nuclease-resistant and inexpensive to synthesize. Although 2'-OMe nucleotides are ubiquitous in biological systems, natural polymerases do not accept 2'-OMe NTPs as substrates under physiological conditions, thus there are no safety concerns over the recycling of 2'-OMe nucleotides into host DNA. The SELEX method used to generate 2'-modified aptamers is described, e.g., in U.S. Provisional Patent Application Ser. No. 60/430,761, filed Dec. 3, 2002, U.S. Provisional Patent Application Ser. No. 60/487,474, filed Jul. 15, 2003, U.S. Provisional Patent Application Ser. No. 60/517,039, filed Nov. 4, 2003, U.S. patent application Ser. No. 10/729,581, filed Dec. 3, 2003, and U.S. patent application Ser. No. 10/873,856, filed Jun. 21, 2004, entitled "Method for in vitro Selection of 2'-O-methyl substituted Nucleic Acids," each of which is herein incorporated by reference in its entirety.

Therapeutics

As used herein "therapeutically effective amount" refers to an amount of a composition that relieves (to some extent, as judged by a skilled medical practitioner) one or more symptoms of a medical condition such as a disease or disorder in a subject. Additionally, by "therapeutically effective amount" of a composition is meant an amount that returns to normal, either partially or completely, physiological or biochemical parameters associated with or causative of a disease or condition. A clinician skilled in the art can determine the therapeutically effective amount of a composition in order to treat or prevent a particular disease condition, or disorder when it is administered, such as intravenously, subcutaneously, intraperitoneally, orally, or through inhalation. The precise amount of the composition required to be therapeutically effective will depend upon numerous factors, e.g., such as the specific activity of the active agent, the delivery device employed, physical characteristics of the agent, purpose for the administration, in addition to many patient specific considerations. But a determination of a therapeutically effective amount is within the skill of an ordinarily skilled clinician upon the appreciation of the disclosure set forth herein.

The terms "treating," "treatment," "therapy," and "therapeutic treatment" as used herein refer to curative therapy, prophylactic therapy, or preventative therapy. An example of "preventative therapy" is the prevention or lessening the chance of a targeted disease (e.g., cancer or other proliferative disease) or related condition thereto. Those in need of treatment include those already with the disease or condition as well as those prone to have the disease or condition to be prevented. The terms "treating," "treatment," "therapy," and "therapeutic treatment" as used herein also describe the management and care of a mammal for the purpose of combating a disease, or related condition, and includes the administration of a composition to alleviate the symptoms, side effects, or other complications of the disease, condition. Therapeutic treatment for cancer includes, but is not limited to, surgery, chemotherapy, radiation therapy, gene therapy, and immunotherapy.

As used herein, the term "agent" or "drug" or "therapeutic agent" refers to a chemical compound, a mixture of chemical compounds, a biological macromolecule, or an extract made from biological materials such as bacteria, plants, fungi, or animal (particularly mammalian) cells or tissues that are suspected of having therapeutic properties. The agent or drug can be purified, substantially purified or partially purified. An "agent" according to the present invention, also includes a radiation therapy agent or a "chemotherapuetic agent."

As used herein, the term "diagnostic agent" refers to any chemical used in the imaging of diseased tissue, such as, e.g., a tumor.

As used herein, the term "chemotherapuetic agent" refers to an agent with activity against cancer, neoplastic, and/or proliferative diseases, or that has ability to kill cancerous cells directly.

As used herein, "pharmaceutical formulations" include formulations for human and veterinary use with no significant adverse toxicological effect. "Pharmaceutically acceptable formulation" as used herein refers to a composition or formulation that allows for the effective distribution of the nucleic acid molecules of the instant invention in the physical location most suitable for their desired activity.

As used herein the term "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated.

Aptamer-Taxin Conjugates as a Cancer Therapeutic

Previous work has developed the concept of antibody-toxin conjugates ("immunoconjugates") as potential therapies for a range of indications, mostly directed at the treatment of cancer with a primary focus on hematological tumors. A variety of different payloads for targeted delivery have been tested in pre-clinical and clinical studies, including protein toxins, high potency small molecule cytotoxics, radioisotopes, and liposome-encapsulated drugs. While these efforts have successfully yielded several FDA-approved therapies for hematological tumors, immunoconjugates as a class (especially for solid tumors) face challenges that have been attributable to multiple different properties of antibodies, including tendencies to develop neutralizing antibody responses to non-humanized antibodies, limited penetration in solid tumors, loss of target binding affinity as a result of toxin conjugation, and imbalances between antibody half-life and toxin conjugate half-life that limit the overall therapeutic index (reviewed by Reff and Heard, Critical Reviews in Oncology/Hematology, 40 (2001):25-35).

Aptamers are functionally similar to antibodies in target recognition, although their absorption, distribution, metabolism, and excretion ("ADME") properties are intrinsically different and they generally lack many of the immune effector functions generally associated with antibodies (e.g., antibody-dependent cellular cytotoxicity, complement-dependent cytotoxicity). In comparing many of the properties of aptamers and antibodies previously described, several factors suggest that toxin-delivery via aptamers offers several concrete advantages over delivery with antibodies, ultimately affording them better potential as therapeutics. Several examples of the advantages of toxin-delivery via aptamers over antibodies are as follows:

1) Aptamer-toxin conjugates are entirely chemically synthesized. Chemical synthesis provides more control over the nature of the conjugate. For example, the stoichiometry (ratio of toxins per aptamer) and site of attachment can be precisely defined. Different linker chemistries can be readily tested. The reversibility of aptamer folding means that loss of activity during conjugation is unlikely and provides more flexibility in adjusting conjugation conditions to maximize yields.

2) Smaller size allows better tumor penetration. Poor penetration of antibodies into solid tumors is often cited as a factor limiting the efficacy of conjugate approaches. See Colcher, D., Goel, A., Pavlinkova, G., Beresford, G., Booth, B., Batra, S. K. (1999) "Effects of genetic engineering on the pharmacokinetics of antibodies," Q. J. Nucl. Med., 43: 132-139. Studies comparing the properties of unPEGylated anti-tenascin C aptamers with corresponding antibodies demonstrate efficient uptake into tumors (as defined by the tumor:blood ratio) and evidence that aptamer localized to the tumor is unexpectedly long-lived ($t_{1/2}>12$ hours) (Hicke, B. J., Stephens, A. W., "Escort aptamers: a delivery service for diagnosis and therapy", J. Clin. Invest., 106:923-928 (2000)).

3) Tunable PK. Aptamer half-life/metabolism can be more easily tuned to match properties of payload, optimizing the ability to deliver toxin to the tumor while minimizing systemic exposure. Appropriate modifications to the aptamer backbone and addition of high molecular weight PEGs should make it possible to match the half-life of the aptamer to the intrinsic half-life of the conjugated toxin/linker, minimizing systemic exposure to non-functional toxin-bearing metabolites (expected if $t_{1/2}(aptamer)<<t_{1/2}(toxin)$) and reducing the likelihood that persisting unconjugated aptamer will functionally block uptake of conjugated aptamer (expected if $t_{1/2}(aptamer)>>t_{1/2}$ (toxin)).

4) Relatively low material requirements. It is likely that dosing levels will be limited by toxicity intrinsic to the cytotoxic payload. As such, a single course of treatment will likely entail relatively small (<100 mg) quantities of aptamer, reducing the likelihood that the cost of oligonucleotide synthesis will be a barrier for aptamer-based therapies.

5) Parenteral administration is preferred for this indication. There will be no special need to develop alternative formulations to drive patient/physician acceptance.

The invention provides a pharmaceutical composition comprising a therapeutically effective amount of an aptamer provided by the invention or a salt thereof, and a pharmaceutically acceptable carrier or diluent. The invention also provides a pharmaceutical composition comprising a therapeutically effective amount of the aptamer or a salt thereof, and a pharmaceutically acceptable carrier or diluent. Relatedly, the invention provides a method of treating or ameliorating a disease or disorder, comprising administering the pharmaceutical composition to a subject in need thereof. Administering a therapeutically effective amount of the composition to the subject may result in: (a) an enhancement of the delivery of the active agent to a disease site relative to delivery of the active agent alone; or (b) an enhancement of microvesicles clearance resulting in a decrease of at least 10%, 20%, 30%, 40%, 50%, 60%, 70%, 80%, or 90% in a blood level of microvesicles targeted by the aptamer; or (c) an decrease in biological activity of microvesicles targeted by the aptamer of at least 10%, 20%, 30%, 40%, 50%, 60%, 70%, 80%, or 90%. In an embodiment, the biological activity of microvesicles comprises immune suppression or transfer of genetic information. The disease or disorder can include without limitation those disclosed herein. For example, the disease or disorder may comprise a neoplastic, proliferative, or inflammatory, metabolic, cardiovascular, or neurological disease or disorder. See, e.g., section "Phenotypes."

Anti-Target and Multivalent Oligonucleotides

As described herein, the target of oligonucleotide probes can be identified. For example, when the target comprises a protein or protein complex (e.g., a nucleoprotein or lipoprotein), identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, or immunoassay. Such approaches can be applied to identify a number of targets recognized by an oligonucleotide probe library. For example, an oligonucleotide probe library can be incubated with a sample of interest, bound members of the library captured, and the targets bound to the captured members identified. See Example 9 herein for an example of such target identification using mass spectrometry.

The oligonucleotide aptamers to the various targets can be used for multiple purposes. In some embodiments, the aptamers are used as therapeutic agents. Immunotherapeutic approaches using antibodies that recognize foreign/misfolded antigens (e.g., anti-CD20, anti-CD30, anti-CD33, anti-CD52, anti-EGFR, anti-nucleolin, anti-nucleophosmin, etc.) can selectively kill target cells via linked therapeutic agents or by stimulating the immune system through activation of cell-mediated cytotoxicity. Aptamers or oligonucleotides are an attractive immunotherapeutic alternative for various reasons such as low cost, small size, ease and speed of synthesis, stability and low immunogenicity. In an embodiment, immunotherapeutic agents are conjugated to disease specific target oligonucleotide or antibody (Ab) for targeted cell killing via recruitment of complement proteins and the downstream membrane attack complex. See. e.g., Zhou and Rossi, Cell-type-specific, Aptamer-functionalized Agents for Targeted Disease Therapy, Mol Ther Nucleic Acids. 2014 Jun. 17; 3:e169. doi: 10.1038/mtna.2014.21; Pei et al., Clinical applications of nucleic acid aptamers in cancer, Mol Clin Oncol. 2014 May; 2(3):341-348. Epub 2014 Feb. 10. This approach can be applied to target diseased host cells such as cancer cells, gram negative bacteria, viral and/or parasitic infections, and the like.

In some embodiments, the invention provides a multipartite construct comprising a binding agent specific to a biological target with another binding agent specific to immunomodulatory entity. Examples of such constructs are shown in FIG. 8. In Design 1 in the figure, the horizontal line indicates an oligonucleotide construct, which construct comprises a 5' primer 801 (Primer 1), a variable region 802 that can be an aptamer to a target of interest, a 3' primer 803 (Primer 2), and an immunomodulatory domain region ("IMD") 804. The complete Design 1 construct can be used to bring a target of interest in proximity with an immunomodulatory agent. The primers can be designed for any desired purpose, e.g., amplification, capture, modification, direct or indirect labeling, and the like. In some embodiments, the target of the variable region is a disease marker and thus the construct is targeted to a diseased tissue, cell or microvesicle. The immunomodulatory domain region can act as an immune stimulator or suppressor. Any appropriate immune stimulator or suppressor can be used, e.g., a small molecule, antibody or an aptamer. Thus, the construct can modulate the immune response at a target of interest, e.g., at a cell or microvesicle carrying the target. The basic construct can be modified as desired. For example, Design 2 in FIG. 8 shows the construct carrying a linker 805 between Primer 2 803 and the IMD 804. Such linkers are explained further below and can be inserted between any components of the construct as desired. Linkers can provide a desired space between the regions of the construct and can be manipulated to influence other properties such as stability. Design 3 in FIG. 8 shows another example wherein the IMD 804 is an oligonucleotide and the variable region 802 and IMD 804 lie between the primers 801 and 803. One of skill will appreciate that one or more linker, such as 805 of Design 2, can also be inserted into Design 3, e.g., between the variable region 802 and IMD 804. One of skill will further appreciate that the ordering of the oligonucleotide segments from 5' to 3' can be modified, e.g., reversed.

As noted, the multipartite constructs may be synthesized and/or modified as desired. In some embodiments of the invention, the multipartite oligonucleotide construct is synthesized directly with or without a linker in between the oligonucleotide segments. See. e.g., FIG. 8 Design 3, which can be generated directly via amplification by Primer 1 801 and Primer 2 803. One or more linker can act as a spacer to create a desired spacing between the target of the variable region segment 802 and the target of the IMD segment 804. The spacing can be determined via computer modeling or via experimentation due to steric hindrance or other considerations.

The multipartite constructs can be generated against any appropriate target. The targets can include without limitation tumors or diseased tissues, cells, cancer cells, circulating tumor cells (CTCs), immune cells (e.g., B-cells, T-cells, macrophages, dendritic cells), microvesicles, bacteria, viruses or other parasites. The target can be large biological complexes, e.g., protein complexes, ribonucleoprotein complexes, lipid complexes, or a combination thereof. It will be understood that the specific target of the multipartite constructs can be a certain member of the foregoing macromolecular targets. For example, consider that the desired target of the multipartite construct is a cell or microvesicle. In such case, the multipartite construct can be directed to a specific case, the multipartite construct can be directed to a specific biomarker, e.g., a surface antigen, of the cell or microvesicle. As a non-limiting example, the target of interest can be B-cells and the specifc target of the variable region of the multipartite construct can be CD20. CD20 is a cellular marker of B-cells targeted by the monoclonal antibodies (mAb) rituximab, obinutuzumab, ofatumumab, ibritumomab tiuxetan, and tositumomab, which are used as agents in the treatment of B-cell lymphomas and leukemias. As another non-limiting example, the target of interest can be cancer cells and the specifc target of the variable region of the multipartite construct can be c-MET. MET is a membrane receptor that is essential for embryonic development and wound healing. Abnormal MET activation in cancer correlates with poor prognosis, where aberrantly active MET triggers tumor growth, formation of new blood vessels (angiogenesis), and cancer spread to other organs (metastasis). MET has been observed to be deregulated in many types of human malignancies, including cancers of kidney, liver, stomach, breast, and brain. Other biomarkers can be used as the specific target as desired. For example, the biomarker can be selected from any of Tables 3-4, or 10-17 herein, or Table 4 of International Patent Application PCT/US2016/040157, filed Jun. 29, 2016.

As noted above, the IDM domain can be constructed to illicit a complement mediated immune response that can induce apoptosis. Such IDM can include but are not limited to C1q, C1r, C1s, C1, C3a, C3b, C3d, C5a, C2, C4, and cytokines. The IDM region may comprise an oligonucleotide sequence including without limitation Toll-Like Receptor (TLR) agonists like CpG sequences which are immunostimulatory and/or polyG sequences which can be anti-proliferative or pro-apoptotic. The moiety can be vaccine like moiety or antigen that stimulates an immune response. In an embodiment, the immune stimulating moiety comprises a superantigen. In some embodiments, the superantigen can be selected from the group consisting of staphylococcal enterotoxins (SEs), a *Streptococcus pyogenes* exotoxin (SPE), a *Staphylococcus aureus* toxic shock-syndrome toxin (TSST-1), a streptococcal mitogenic exotoxin (SME), a streptococcal superantigen (SSA), a hepatitis surface antigen, or a combination thereof. Other bacterial antigens that can be used with the invention comprise bacterial antigens such as Freund's complete adjuvant, Freund's incomplete adjuvant, monophosphoryl-lipid A/trehalose dicorynomycolate (Ribi's adjuvant), BCG (Calmette-Guerin *Bacillus; Mycobacterium bovis*), and *Corynebacterium parvum*. The immune stimulating moiety can also be a non-specific immunostimulant, such as an adjuvant or other non-specific immunostimulator. Useful adjuvants comprise without limitation aluminium salts, alum, aluminium phosphate, aluminium hydroxide, squalene, oils, MF59, and AS03 ("Adjuvant System 03"). The adjuvant can be selected from the group consisting of Cationic liposome-DNA complex JVRS-100, aluminum hydroxide vaccine adjuvant, aluminum phosphate vaccine adjuvant, aluminum potassium sulfate adjuvant, Alhydrogel, ISCOM(s)™, Freund's Complete Adjuvant, Freund's Incomplete Adjuvant, CpG DNA Vaccine Adjuvant, Cholera toxin, Cholera toxin B subunit, Liposomes, Saponin Vaccine Adjuvant, DDA Adjuvant, Squalene-based Adjuvants, Etx B subunit Adjuvant, IL-12

Vaccine Adjuvant, LTK63 Vaccine Mutant Adjuvant, TiterMax Gold Adjuvant, Ribi Vaccine Adjuvant, Montanide ISA 720 Adjuvant, *Corynebacterium*-derived P40 Vaccine Adjuvant, MPL™ Adjuvant, AS04, AS02, Lipopolysaccharide Vaccine Adjuvant, Muramyl Dipeptide Adjuvant, CRL1005, Killed *Corynebacterium parvum* Vaccine Adjuvant, Montanide ISA 51, *Bordetella pertussis* component Vaccine Adjuvant, Cationic Liposomal Vaccine Adjuvant, Adamantylamide Dipeptide Vaccine Adjuvant, Arlacel A, VSA-3 Adjuvant, Aluminum vaccine adjuvant, Polygen Vaccine Adjuvant, Adjumer™, Algal Glucan, Bay R1005, Theramide®, Stearyl Tyrosine, Specol, Algammulin, Avridine®, Calcium Phosphate Gel, CTA1-DD gene fusion protein, DOC/Alum Complex, Gamma Inulin, Gerbu Adjuvant, GM-CSF, GMDP, Recombinant hIFN-gamma/Interferon-g, Interleukin-1β, Interleukin-2, Interleukin-7, Sclavo peptide, Rehydragel LV, Rehydragel HPA, Loxoribine, MF59, MTP-PE Liposomes, Murametide, Murapalmitine, D-Murapalmitine, NAGO, Non-Ionic Surfactant Vesicles, PMMA, Protein Cochleates, QS-21, SPT (Antigen Formulation), nanoemulsion vaccine adjuvant, AS03, Quil-A vaccine adjuvant, RC529 vaccine adjuvant, LTR192G Vaccine Adjuvant, *E. coli* heat-labile toxin, LT, amorphous aluminum hydroxyphosphate sulfate adjuvant, Calcium phosphate vaccine adjuvant, Montanide Incomplete Seppic Adjuvant, Imiquimod, Resiquimod, AF03, Flagellin, Poly(I:C), ISCOMATRIX®, Abisco-100 vaccine adjuvant, Albumin-heparin microparticles vaccine adjuvant, AS-2 vaccine adjuvant, B7-2 vaccine adjuvant, DHEA vaccine adjuvant, Immunoliposomes Containing Antibodies to Costimulatory Molecules, SAF-1, Sendai Proteoliposomes, Sendai-containing Lipid Matrices, Threonyl muramyl dipeptide (TMDP), Ty Particles vaccine adjuvant, Bupivacaine vaccine adjuvant, DL-PGL (Polyester poly (DL-lactide-co-glycolide)) vaccine adjuvant, IL-15 vaccine adjuvant, LTK72 vaccine adjuvant, MPL-SE vaccine adjuvant, non-toxic mutant E112K of Cholera Toxin mCT-E112K, and Matrix-S. Additional adjuvants that can be used with the multipartite constructs of the invention can be identified using the Vaxjo database. See Sayers S, Ulysse G, Giang Z, and He Y. Vaxjo: a web-based vaccine adjuvant database and its application for analysis of vaccine adjuvants and their uses in vaccine development. Journal of Biomedicine and Biotechnology. 2012; 2012: 831486. Epub 2012 Mar. 13. PMID: 22505817; www.violinet.org/vaxjo/. Other useful non-specific immunostimulators comprise histamine, interferon, transfer factor, tuftsin, interleukin-1, female sex hormones, prolactin, growth hormone vitamin D, deoxycholic acid (DCA), tetrachlorodecaoxide (TCDO), and imiquimod or resiquimod, which are drugs that activate immune cells through the toll-like receptor 7. A multipartite construct can be created that comprises more than one immunomodulating moiety, e.g., using segments that span CpG sequences which are immunostimulatory with complement directed segments that can stimulate apoptosis.

Modifications

Modifications to the one or more oligonucleotide of the invention can be made to alter desired characteristics, including without limitation in vivo stability, specificity, affinity, avidity or nuclease susceptibility. Alterations to the half life may improve stability in vivo or may reduce stability to limit in vive toxicity. Such alterations can include mutations, truncations or extensions. The 5' and/or 3' ends of the multipartite oligonucleotide constructs can be protected or deprotected to modulate stability as well. Modifications to improve in vive stability, specificity, affinity, avidity or nuclease susceptibility or alter the half life to influence in vivo toxicity may be at the 5' or 3' end and include but are not limited to the following: locked nucleic acid (LNA) incorporation, unlocked nucleic acid (UNA) incorporation, phosphorothioate backbone instead of phosphodiester backbone, amino modifiers (i.e. C6-dT), dye conjugates (Cy dues, Fluorophores, etc), Biotinylation, PEG linkers, Click chemistry linkers, dideoxynucleotide end blockers, inverted end bases, cholesterol TEG or other lipid based labels.

Linkage options for segments of the oligonucleotide of the invention can be on the 5' or 3' end of an oligonucleotide or to a primary amine, sulfhydryl or carboxyl group of an antibody and include but are not limited to the following: Biotin-target oligonucleotide/Ab, streptavidin-complement oligonucleotide or vice versa, amino modified-target Ab/oligonucleotide, thiol/carboxy-complement oligonucleotide or vice versa, Click chemistry-target Ab/oligonucleotide, corresponding Click chemistry partner-complement oligonucleotide or vice versa. The linkages may be covalent or non-covalent and may include but are not limited to monovalent, multivalent (i.e. bi, tri or tetra-valent) assembly, to a DNA scaffold (i.e. DNA origami structure), drug/chemotherapeutic agent, nanoparticle, microparticle or a micelle or liposome.

A linker region can comprise a spacer with homo- or multifunctional reactive groups that can vary in length and type. These include but are not limited to the following: spacer C18, PEG4, PEG6, PEG8, and PEG12.

The multipartite oligonucleotide of the invention can further comprise additional elements to add desired biological effects. For example, the oligonucleotide of the invention may comprise a membrane disruptive moiety. The oligonucleotide of the invention may also be conjugated to one or more chemical moiety that provides such effects. For example, the oligonucleotide of the invention may be conjugated to a detergent-like moiety to disrupt the membrane of a target cell or microvesicle. Useful ionic detergents include sodium dodecyl sulfate (SDS, sodium lauryl sulfate (SLS)), sodium laureth sulfate (SLS, sodium lauryl ether sulfate (SLES)), ammonium lauryl sulfate (ALS), cetrimonium bromide, cetrimonium chloride, cetrimonium stearate, and the like. Useful non-ionic (zwitterionic) detergents include polyoxyethylene glycols, polysorbate 20 (also known as Tween 20), other polysorbates (e.g., 40, 60, 65, 80, etc), Triton-X (e.g., X100, X114), 3-[(3-cholamidopropyl) dimethylammonio]-1-propanesulfonate (CHAPS), CHAPSO, deoxycholic acid, sodium deoxycholate, NP-40, glycosides, octyl-thio-glucosides, maltosides, and the like. One of skill will appreciate that functional fragments, such as membrane disruptive moieties, can be covalently or non-covalently attached to the oligonucleotide of the invention.

Oligonucleotide segments, including those of a multipartite construct, can include any desireable base modification known in the art. In certain embodiments, oligonucleotide segments are 10 to 50 nucleotides in length. One having ordinary skill in the art will appreciate that this embodies oligonucleotides of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range derivable there within.

In certain embodiments, a multipartite construct comprises a chimeric oligonucleotide that contains two or more chemically distinct regions, each made up of at least one nucleotide. Such chimeras can be referred to using terms such as multipartite, multivalent, or the like. The oligonucleotides portions may contain at least one region of modified nucleotides that confers one or more beneficial properties, e.g., increased nuclease resistance, bioavailability, increased binding affinity for the target. Chimeric nucleic acids of the invention may be formed as composite structures of two or more oligonucleotides, two or more types of oligonucleotides (e.g., both DNA and RNA segments), modified oligonucleotides, oligonucleosides and/or oligonucleotide mimetics. Such compounds have also been referred to in the art as hybrids. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

In certain embodiments, an oligonucleotide of the invention comprises at least one nucleotide modified at the 2' position of the sugar, including without limitation a 2'-O-alkyl, 2'-O-alkyl-O-alkyl or 2'-fluoro-modified nucleotide. In other embodiments, RNA modifications include 2'-fluoro, 2'-amino and 2' O-methyl modifications on the ribose of pyrimidines, a basic residue or an inverted base at the 3' end of the RNA. Such modifications are routinely incorporated into oligonucleotides and these oligonucleotides have been shown to have higher target binding affinity in some cases than 2'-deoxyoligonucleotides against a given target.

A number of nucleotide and nucleoside modifications have been shown to make an oligonucleotide more resistant to nuclease digestion, thereby prolonging in vivo half-life. Specific examples of modified oligonucleotides include those comprising backbones comprising, for example, phosphorothioates, phosphotriesters, methyl phosphonates, short chain alkyl or cycloalkyl intersugar linkages or short chain heteroatomic or heterocyclic intersugar linkages. The constructs of the invention can comprise oligonucleotides with phosphorothioate backbones and/or heteroatom backbones, e.g., CH2 —NH—O—CH2, CH, ~N(CH3)~O~CH2 (known as a methylene(methylimino) or MMI backbone], CH2 —O—N (CH3)-CH2, CH2 —N(CH3)-N(CH3)-CH2 and O—N(CH3)-CH2-CH2 backbones, wherein the native phosphodiester backbone is represented as O—P—O—CH); amide backbones (De Mesmaeker et ah, 1995); morpholino backbone structures (Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone (Nielsen, et al., 1991), each of which is herein incorporated by reference in its entirety. Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3*-5* to 5*-3* or 2*-5* to 5*-2*; see U.S. Pat. Nos. 3,687,808; 4,469,863; 4,476,301; 5,023,243; 5,177,196; 5,188,897; 5,264,423; 5,276,019; 5,278,302; 5,286,717; 5,321, 131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050, each of which is herein incorporated by reference in its entirety. Morpholino-based oligomeric compounds are known in the art described in Braasch & Corey, Biochemistry vol. 41, no. 14, 2002, pages 4503-4510; Genesis vol. 30, 2001, page 3; Heasman, J. Dev. Biol. vol. 243, 2002, pages 209-214; Nasevicius et al. Nat. Genet. vol. 26, 2000, pages 216-220; Lacerra et al. Proc. Natl. Acad. Sci. vol. 97, 2000, pages 9591-9596 and U.S. Pat. No. 5,034,506, issued Jul. 23, 1991, each of which is herein incorporated by reference in its entirety. Cyclohexenyl nucleic acid oligonucleotide mimetics are described in Wang et al., J. Am. Chem. Soc. Vol. 122, 2000, pages 8595-8602, the contents of which is incorporated herein in its entirety. An oligonucleotide of the invention can comprise at least such modification as desired.

Modified oligonucleotide backbones that do not include a phosphorus atom therein have backbones that can be formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference in its entirety. An oligonucleotide of the invention can comprise at least such modification as desired.

In certain embodiments, an oligonucleotide of the invention comprises one or more substituted sugar moieties, e.g., one of the following at the 2' position: OH, SH, $SCH_3$, F, OCN, $OCH_3$ $OCH_3$, $OCH_3$ $O(CH_2)n$ $CH_3$, $O(CH_2)n$ $NH_2$ or $O(CH_2)n$ $CH_3$ where n is from 1 to about 10; Ci to CIO lower alkyl, alkoxyalkoxy, substituted lower alkyl, alkaryl or aralkyl; CI; Br; CN; $CF_3$; $OCF_3$; O-, S-, or N-alkyl; O-, S-, or N-alkenyl; $SOCH_3$; $SO_2$ $CH_3$; $ONO_2$; N $O_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacokinetic/pharmacodynamic properties of an oligonucleotide and other substituents having similar properties. A preferred modification includes 2'-methoxyethoxy [2'-O—CH2CH2OCH3, also known as 2'-O-(2-methoxyethyl)]. Other preferred modifications include 2*-methoxy (2*-O—CH3), 2*-propoxy (2*'-OCH2 CH2CH3) and 2*-fiuoro (2*-F). Similar modifications may also be made at other positions on the oligonucleotide, e.g., the 3' position of the sugar on the 3' terminal nucleotide and the 5' position of 5' terminal nucleotide. Oligonucleotides may also have sugar mimetics such as cyclobutyls in place of the pentofuranosyl group.

In certain embodiments, an oligonucleotide of the invention comprises one or more base modifications and/or substitutions. As used herein, "unmodified" or "natural" bases include adenine (A), guanine (G), thymine (T), cytosine (C) and uracil (U). Modified bases include, without limitation, bases found only infrequently or transiently in natural nucleic acids, e.g., hypoxanthine, 6-methyladenine, 5-Me pyrimidines, particularly 5-methylcytosine (also referred to as 5-methyl-2' deoxy cytosine and often referred to in the art as 5-Me-C), 5-hydroxymethylcytosine (HMC), glycosyl HMC and gentobiosyl HMC, as well as synthetic bases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine and 2,6-diaminopurine (Komberg, 1980; Gebeyehu, et al, 1987). A "universal" base known in the art, e.g., inosine, can also be included. 5-Me-C substitutions can also be included. These have been shown to increase nucleic acid duplex stability by 0.6-1.20 C. See, e.g., Sanghvi et al., 'Antisense Research & Applications', 1993, CRC PRESS pages 276-278. Further suitable modified bases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

It is not necessary for all positions in a given oligonucleotide to be uniformly modified, and in fact more than one of the aforementioned modifications may be incorporated in a single oligonucleotide or even at within a single nucleoside within an oligonucleotide.

In certain embodiments, both a sugar and an internucleoside linkage, i.e., the backbone, of one or more nucleotide units within an oligonucleotide of the invention are replaced with novel groups. The base can be maintained for hybridization with an appropriate nucleic acid target compound. One such oligomeric compound, an oligonucleotide mimetic that has been shown to retain hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative patents that teach the preparation of PNA compounds comprise, but are not limited to, U.S. Pat. Nos. 5,539,082; 5,714,331; and 5,719,262, each of which is herein incorporated by reference. Further teaching of PNA compounds can be found in Nielsen et al. Science vol. 254, 1991, page 1497, which is herein incorporated by reference.

In certain embodiments, the oligonucleotide of the invention is linked (covalently or non-covalently) to one or more moieties or conjugates that enhance activity, cellular distribution, or localization. Such moieties include, without limitation, lipid moieties such as a cholesterol moiety (Letsinger et al. Proc. Natl. Acad. Sci. Usa. vol. 86, 1989, pages 6553-6556), cholic acid (Manoharan et al. Bioorg. Med. Chem. Let. vol. 4, 1994, pages 1053-1060), a thioether, e.g., hexyl-S-tritylthiol (Manoharan et al. Ann. N. Y. Acad. Sci. Vol. 660, 1992, pages 306-309; Manoharan et al. Bioorg. Med. Chem. Let. vol. 3, 1993, pages 2765-2770), a thiocholesterol (Oberhauser et al. Nucl. Acids Res. vol. 20, 1992, pages 533-538), an aliphatic chain, e.g., dodecandiol or undecyl residues (Kabanov et al. Febs Lett. vol. 259, 1990, pages 327-330; Svinarchuk et al. Biochimie. vol. 75, 1993, pages 49-54), a phospholipid, e.g., di-hexadecyl-rac-glycerol or triethylammonium 1,2-di-O-hexadecyl-rac-glycero-3-H-phosphonate (Manoharan et al. Tetrahedron Lett. vol. 36, 1995, pages 3651-3654; Shea et al. Nucl. Acids Res. vol. 18, 1990, pages 3777-3783), a polyamine or a polyethylene glycol chain (Mancharan et al. Nucleosides & Nucleotides vol. 14, 1995, pages 969-973), or adamantane acetic acid (Manoharan et al. Tetrahedron Lett. vol. 36, 1995, pages 3651-3654), a palmityl moiety (Mishra et al. Biochim. Biophys. Acta vol. 1264, 1995, pages 229-237), or an octadecylamine or hexylamino-carbonyl-t oxycholesterol moiety (Crooke et al. J. Pharmacol. Exp. Ther. vol. 277, 1996, pages 923-937), each of which is herein incorporated by reference in its entirety. See also U.S. Pat. Nos. 4,828, 979; 4,948,882; 5,218,105; 5,525,465; 5,541,313; 5,545, 730; 5,552,538; 5,578,717; 5,580,731; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203, 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928 and 5,688,941, each of which is herein incorporated by reference in its entirety.

The oligonucleotide of the invention can be modified to incorporate a wide variety of modified nucleotides as desired. For example, the construct may be synthesized entirely of modified nucleotides or with a subset of modified nucleotides. The modifications can be the same or different. Some or all nucleotides may be modified, and those that are modified may contain the same modification. For example, all nucleotides containing the same base may have one type of modification, while nucleotides containing other bases may have different types of modification. All purine nucleotides may have one type of modification (or are unmodified), while all pyrimidine nucleotides have another, different type of modification (or are unmodified). Thus, the construct may comprise any combination of desired modifications, including for example, ribonucleotides (2'-OH), deoxyribonucleotides (2'-deoxy), 2'-amino nucleotides (2'-NH2), 2'-fluoro nucleotides (2'-F) and 2'-O-methyl (2'-OMe) nucleotides.

In some embodiments, the oligonucleotide of the invention is synthesized using a transcription mixture containing modified nucleotides in order to generate a modified construct. For example, a transcription mixture may contain only 2'-OMe A, G, C and U and/or T triphosphates (2'-OMe ATP, 2'-OMe UTP and/or 2*-OMe TTP, 2*-OMe CTP and 2*-OMe GTP), referred to as an MNA or mRmY mixture. Oligonucleotides generated therefrom are referred to as MNA oligonucleotides or mRmY oligonucleotides and contain only 2'-O-methyl nucleotides. A transcription mixture containing all 2'-OH nucleotides is referred to as an "rN" mixture, and oligonucleotides generated therefrom are referred to as "rN", "rRrY" or RNA oligonucleotides. A transcription mixture containing all deoxy nucleotides is referred to as a "dN" mixture, and oligonucleotides generated therefrom are referred to as "dN", "dRdY" or DNA oligonucleotides. Aternatively, a subset ofnucleotides (e.g., C, U and/or T) may comprise a first modified nucleotides (e.g, 2'-OMe) nucleotides and the remainder (e.g., A and G) comprise a second modified nucleotide (e.g., 2'-OH or 2'-F). For example, a transcription mixture containing 2'-F U and 2'-OMe A, G and C is referred to as a "fUmV" mixture, and oligonucleotides generated therefrom are referred to as "fUmV" oligonucleotides. A transcription mixture containing 2'-F A and G, and 2'-OMe C and U and/or T is referred to as an "fRmY" mixture, and oligonucleotides generated therefrom are referred to as "fRmY" oligonucleotides. A transcription mixture containing 2'-F A and 2'-OMe C, G and U and/or T is referred to as "fAmB" mixture, and oligonucleotides generated therefrom are referred to as "fAmB" oligonucleotides.

One of skill in the art can improve pre-identified aptamer segments (e.g., variable regions or immunomodulatory regions that comprise an aptamer to a biomarker target or other entity) using various process modifications. Examples of such process modifications include, but are not limited to, truncation, deletion, substitution, or modification of a sugar or base or internucleotide linkage, capping, and PEGylation. In addition, the sequence requirements of an aptamer may be explored through doped reselections or aptamer medicinal chemistry. Doped reselections are carried out using a synthetic, degenerate pool that has been designed based on the aptamer of interest. The level of degeneracy usually varies from about 70-85% from the aptamer of interest. In general, sequences with neutral mutations are identified through the doped reselection process. Aptamer medicinal chemistry is an aptamer improvement technique in which sets of variant aptamers are chemically synthesized. These variants are then compared to each other and to the parent aptamer. Aptamer medicinal chemistry is used to explore the local, rather than global, introduction of substituents. For example, the following modifications may be introduced: modifications at a sugar, base, and/or internucleotide linkage, such as 2'-deoxy, 2'-ribo, or 2'-O-methyl purines or pyrimidines, phosphorothioate linkages may be introduced between nucleotides, a cap may be introduced at the 5' or 3' end of the aptamer (such as 3' inverted dT cap) to block degradation by exonucleases, or a polyethylene glycol (PEG) element may be added to the aptamer to increase the half-life of the aptamer in the subject.

Additional compositions comprising an oligonucleotide of the invention and uses thereof are further described below. As the invention provides methods to identify oligonucleotide probes that bind to specific tissues, cells, microvesicles or other biological entities of interest, the oligonucleotide probes of the invention target such entities and are inherently drug candidates, agents that can be used for targeted drug delivery, or both.

Pharmaceutical Compositions

In an aspect, the invention provides pharmaceutical compositions comprising one or more oligonucleotide of the invention, e.g., as a standalone drug, as a drug delivery agent, as a multipartite construct as described above, or any combination thereof. The invention further provides methods of administering such compositions.

The term "condition," as used herein means an interruption, cessation, or disorder of a bodily function, system, or organ. Representative conditions include, but are not limited to, diseases such as cancer, inflammation, diabetes, and organ failure.

The phrase "treating," "treatment of," and the like include the amelioration or cessation of a specified condition.

The phrase "preventing," "prevention of," and the like include the avoidance of the onset of a condition.

The term "salt," as used herein, means two compounds that are not covalently bound but are chemically bound by ionic interactions.

The term "pharmaceutically acceptable," as used herein, when referring to a component of a pharmaceutical composition means that the component, when administered to an animal, does not have undue adverse effects such as excessive toxicity, irritation, or allergic response commensurate with a reasonable benefit/risk ratio. Accordingly, the term "pharmaceutically acceptable organic solvent," as used herein, means an organic solvent that when administered to an animal does not have undue adverse effects such as excessive toxicity, irritation, or allergic response commensurate with a reasonable benefit/risk ratio. Preferably, the pharmaceutically acceptable organic solvent is a solvent that is generally recognized as safe ("GRAS") by the United States Food and Drug Administration ("FDA"). Similarly, the term "pharmaceutically acceptable organic base," as used herein, means an organic base that when administered to an animal does not have undue adverse effects such as excessive toxicity, irritation, or allergic response commensurate with a reasonable benefit/risk ratio.

The phrase "injectable" or "injectable composition," as used herein, means a composition that can be drawn into a syringe and injected subcutaneously, intraperitoneally, or intramuscularly into an animal without causing adverse effects due to the presence of solid material in the composition. Solid materials include, but are not limited to, crystals, gummy masses, and gels. Typically, a formulation or composition is considered to be injectable when no more than about 15%, preferably no more than about 10%, more preferably no more than about 5%, even more preferably no more than about 2%, and most preferably no more than about 1% of the formulation is retained on a 0.22 µm filter when the formulation is filtered through the filter at 98° F. There are, however, some compositions of the invention, which are gels, that can be easily dispensed from a syringe but will be retained on a 0.22 µm filter. In one embodiment, the term "injectable," as used herein, includes these gel compositions. In one embodiment, the term "injectable," as used herein, further includes compositions that when warmed to a temperature of up to about 40° C. and then filtered through a 0.22 pmun filter, no more than about 15%, preferably no more than about 10%, more preferably no more than about 5%, even more preferably no more than about 2%, and most preferably no more than about 1% of the formulation is retained on the filter. In one embodiment, an example of an injectable pharmaceutical composition is a solution of a pharmaceutically active compound (for example, one or more oligonucleotide of the invention, e.g., a multipartite construct, an anti-C1Q oligonucleotide, a 10.36 oligonucleotide, as described above, or any combination thereof) in a pharmaceutically acceptable solvent. One of skill will appreciate that injectable solutions have inherent properties, e.g., sterility, pharmaceutically acceptable excipients and free of harmful measures of pyrogens or similar contaminants.

The term "solution," as used herein, means a uniformly dispersed mixture at the molecular or ionic level of one or more substances (solute), in one or more other substances (solvent), typically a liquid.

The term "suspension," as used herein, means solid particles that are evenly dispersed in a solvent, which can be aqueous or non-aqueous.

The term "animal," as used herein, includes, but is not limited to, humans, canines, felines, equines, bovines, ovines, porcines, amphibians, reptiles, and avians. Representative animals include, but are not limited to a cow, a horse, a sheep, a pig, an ungulate, a chimpanzee, a monkey, a baboon, a chicken, a turkey, a mouse, a rabbit, a rat, a guinea pig, a dog, a cat, and a human. In one embodiment, the animal is a mammal. In one embodiment, the animal is a human. In one embodiment, the animal is a non-human. In one embodiment, the animal is a canine, a feline, an equine, a bovine, an ovine, or a porcine.

The phrase "drug depot," as used herein means a precipitate, which includes one or more oligonucleotide of the invention, e.g., a multipartite construct, an anti-C1Q oligonucleotide, a 10.36 oligonucleotide, as described above, or any combination thereof, formed within the body of a treated animal that releases the oligonucleotide over time to provide a pharmaceutically effective amount of the oligonucleotide.

The phrase "substantially free of," as used herein, means less than about 2 percent by weight. For example, the phrase "a pharmaceutical composition substantially free of water" means that the amount of water in the pharmaceutical composition is less than about 2 percent by weight of the pharmaceutical composition.

The term "effective amount," as used herein, means an amount sufficient to treat or prevent a condition in an animal.

The nucleotides that make up the oligonucleotide of the invention can be modified to, for example, improve their stability, i.e., improve their in vivo half-life, and/or to reduce their rate of excretion when administered to an animal. The term "modified" encompasses nucleotides with a covalently modified base and/or sugar. For example, modified nucleotides include nucleotides having sugars which are covalently attached to low molecular weight organic groups other than a hydroxyl group at the 3' position and other than a phosphate group at the 5' position. Modified nucleotides may also include 2' substituted sugars such as 2'-O-methyl-; 2'-O-alkyl; 2'-O-allyl; 2'-S-alkyl; 2'-S-allyl; 2'-fluoro-; 2'-halo or 2'-azido-ribose; carbocyclic sugar analogues; α-anomeric sugars; and epimeric sugars such as arabinose, xyloses or lyxoses, pyranose sugars, furanose sugars, and sedoheptulose.

Modified nucleotides are known in the art and include, but are not limited to, alkylated purines and/or pyrimidines; acylated purines and/or pyrimidines; or other heterocycles. These classes of pyrimidines and purines are known in the art and include, pseudoisocytosine; N4,N4-ethanocytosine; 8-hydroxy-N6-methyladenine; 4-acetylcytosine, 5-(carboxyhydroxylmethyl) uracil; 5-fluorouracil; 5-bromouracil; 5-carboxymethylaminomethyl-2-thiouracil; 5-carboxymethylaminomethyl uracil; dihydrouracil; inosine; N6-isopentyladenine; 1-methyladenine; 1-methylpseudouracil; 1-methylguanine; 2,2-dimethylguanine; 2-methyladenine; 2-methylguanine; 3-methylcytosine; 5-methylcytosine; N6-methyladenine; 7-methylguanine; 5-methylaminomethyl uracil; 5-methoxy amino methyl-2-thiouracil; β-D-mannosylqueosine; 5-methoxycarbonylmethyluracil; 5-methoxyuracil; 2 methylthio-N6-isopentenyladenine; uracil-5-oxyacetic acid methyl ester, psueouracil; 2-thiocytosine; 5-methyl-2 thiouracil, 2-thiouracil; 4-thiouracil; 5-methyluracil; N-uracil-5-oxyacetic acid methylester; uracil 5-oxyacetic acid; queosine; 2-thiocytosine; 5-propyluracil; 5-propylcytosine; 5-ethyluracil; 5-ethylcytosine; 5-butyluracil; 5-pentyluracil; 5-pentylcytosine; and 2,6-diaminopurine; methylpsuedouracil; 1-methylguanine; and 1-methylcytosine.

An oligonucleotide of the invention can also be modified by replacing one or more phosphodiester linkages with alternative linking groups. Alternative linking groups include, but are not limited to embodiments wherein P(O)O is replaced by P(O)S, P(S)S, P(O)NR2, P(O)R, P(O)OR', CO, or CH2, wherein each R or R' is independently H or a substituted or unsubstituted C1-C20 alkyl. A preferred set of R substitutions for the P(O)NR2 group are hydrogen and methoxyethyl. Linking groups are typically attached to each adjacent nucleotide through an —O— bond, but may be modified to include —N— or —S— bonds. Not all linkages in an oligomer need to be identical.

The oligonucleotide of the invention can also be modified by conjugation to a polymer, for example, to reduce the rate of excretion when administered to an animal. For example, the oligonucleotide can be "PEGylated," i.e., conjugated to polyethylene glycol ("PEG"). In one embodiment, the PEG has an average molecular weight ranging from about 20 kD to 80 kD. Methods to conjugate an oligonucleotide with a polymer, such PEG, are known to those skilled in the art (See, e.g., Greg T. Hermanson, Bioconjugate Techniques, Academic Press, 1966).

The oligonucleotide of the invention, e.g., a multipartite construct, an anti-C1Q oligonucleotide, a 10.36 oligonucleotide, as described above, or any combination thereof, can be used in the pharmaceutical compositions disclosed herein or known in the art.

In one embodiment, the pharmaceutical composition further comprises a solvent.

In one embodiment, the solvent comprises water.

In one embodiment, the solvent comprises a pharmaceutically acceptable organic solvent. Any useful and pharmaceutically acceptable organic solvents can be used in the compositions of the invention.

In one embodiment, the pharmaceutical composition is a solution of the salt in the pharmaceutically acceptable organic solvent.

In one embodiment, the pharmaceutical composition comprises a pharmaceutically acceptable organic solvent and further comprises a phospholipid, a sphingomyelin, or phosphatidyl choline. Without wishing to be bound by theory, it is believed that the phospholipid, sphingomyelin, or phosphatidyl choline facilitates formation of a precipitate when the pharmaceutical composition is injected into water and can also facilitate controlled release of the oligonucleotide from the resulting precipitate. Typically, the phospholipid, sphingomyelin, or phosphatidyl choline is present in an amount ranging from greater than 0 to 10 percent by weight of the pharmaceutical composition. In one embodiment, the phospholipid, sphingomyelin, or phosphatidyl choline is present in an amount ranging from about 0.1 to 10 percent by weight of the pharmaceutical composition. In one embodiment, the phospholipid, sphingomyelin, or phosphatidyl choline is present in an amount ranging from about 1 to 7.5 percent by weight of the pharmaceutical composition. In one embodiment, the phospholipid, sphingomyelin, or phosphatidyl choline is present in an amount ranging from about 1.5 to 5 percent by weight of the pharmaceutical composition. In one embodiment, the phospholipid, sphingomyelin, or phosphatidyl choline is present in an amount ranging from about 2 to 4 percent by weight of the pharmaceutical composition.

The pharmaceutical compositions can optionally comprise one or more additional excipients or additives to provide a dosage form suitable for administration to an animal. When administered to an animal, the oligonucleotide containing pharmaceutical compositions are typically administered as a component of a composition that comprises a pharmaceutically acceptable carrier or excipient so as to provide the form for proper administration to the animal. Suitable pharmaceutical excipients are described in Remington's Pharmaceutical Sciences 1447-1676 (Alfonso R. Gennaro ed., 19th ed. 1995), incorporated herein by reference. The pharmaceutical compositions can take the form of solutions, suspensions, emulsion, tablets, pills, pellets, capsules, capsules containing liquids, powders, suppositories, emulsions, aerosols, sprays, suspensions, or any other form suitable for use.

In one embodiment, the pharmaceutical compositions are formulated for intravenous or parenteral administration. Typically, compositions for intravenous or parenteral administration comprise a suitable sterile solvent, which may be an isotonic aqueous buffer or pharmaceutically acceptable organic solvent. Where necessary, the compositions can also include a solubilizing agent. Compositions for intravenous administration can optionally include a local anesthetic such as lidocaine to lessen pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where oligonucleotide-containing pharmaceutical compositions are to be administered by infusion, they can be dispensed, for example, with an infusion bottle containing, for example, sterile pharmaceutical grade water or saline. Where the pharmaceutical compositions are administered by injection, an ampoule of sterile water for injection, saline, or other solvent such as a pharmaceutically acceptable organic solvent can be provided so that the ingredients can be mixed prior to administration.

In another embodiment, the pharmaceutical compositions are formulated in accordance with routine procedures as a composition adapted for oral administration. Compositions for oral delivery can be in the form of tablets, lozenges, aqueous or oily suspensions, granules, powders, emulsions, capsules, syrups, or elixirs, for example. Oral compositions can include standard excipients such as mannitol, lactose, starch, magnesium stearate, sodium saccharin, cellulose, and magnesium carbonate. Typically, the excipients are of pharmaceutical grade. Orally administered compositions can also contain one or more agents, for example, sweetening agents such as fructose, aspartame or saccharin; flavoring agents such as peppermint, oil of wintergreen, or cherry; coloring agents; and preserving agents, to provide a pharmaceutically palatable preparation. Moreover, when in tablet or pill form, the compositions can be coated to delay disintegration and absorption in the gastrointestinal tract thereby providing a sustained action over an extended period of time. Selectively permeable membranes surrounding an osmotically active driving compound are also suitable for orally administered compositions. A time-delay material such as glycerol monostearate or glycerol stearate can also be used.

The pharmaceutical compositions further comprising a solvent can optionally comprise a suitable amount of a pharmaceutically acceptable preservative, if desired, so as to provide additional protection against microbial growth. Examples of preservatives useful in the pharmaceutical compositions of the invention include, but are not limited to, potassium sorbate, methylparaben, propylparaben, benzoic acid and its salts, other esters of parahydroxybenzoic acid such as butylparaben, alcohols such as ethyl or benzyl alcohol, phenolic compounds such as phenol, or quaternary compounds such as benzalkonium chlorides (e.g., benzethonium chloride).

In one embodiment, the pharmaceutical compositions of the invention optionally contain a suitable amount of a pharmaceutically acceptable polymer. The polymer can increase the viscosity of the pharmaceutical composition. Suitable polymers for use in the compositions and methods of the invention include, but are not limited to, hydroxypropylcellulose, hydoxypropylmethylcellulose (HPMC), chitosan, polyacrylic acid, and polymethacrylic acid.

Typically, the polymer is present in an amount ranging from greater than 0 to 10 percent by weight of the pharmaceutical composition. In one embodiment, the polymer is present in an amount ranging from about 0.1 to 10 percent by weight of the pharmaceutical composition. In one embodiment, the polymer is present in an amount ranging from about 1 to 7.5 percent by weight of the pharmaceutical composition. In one embodiment, the polymer is present in an amount ranging from about 1.5 to 5 percent by weight of the pharmaceutical composition. In one embodiment, the polymer is present in an amount ranging from about 2 to 4 percent by weight of the pharmaceutical composition. In one embodiment, the pharmaceutical compositions of the invention are substantially free of polymers.

In one embodiment, any additional components added to the pharmaceutical compositions of the invention are designated as GRAS by the FDA for use or consumption by animals. In one embodiment, any additional components added to the pharmaceutical compositions of the invention are designated as GRAS by the FDA for use or consumption by humans.

The components of the pharmaceutical composition (the solvents and any other optional components) are preferably biocompatible and non-toxic and, over time, are simply absorbed and/or metabolized by the body.

As described above, the pharmaceutical compositions of the invention can further comprise a solvent.

In one embodiment, the solvent comprises water.

In one embodiment, the solvent comprises a pharmaceutically acceptable organic solvent.

In an embodiment, the oligonucleotide of the invention, e.g., a multipartite construct, an anti-C1Q oligonucleotide, a 10.36 oligonucleotide, as described above, or any combination thereof, are available as the salt of a metal cation, for example, as the potassium or sodium salt. These salts, however, may have low solubility in aqueous solvents and/or organic solvents, typically, less than about 25 mg/mL. The pharmaceutical compositions of the invention comprising (i) an amino acid ester or amino acid amide and (ii) a protonated oligonucleotide, however, may be significantly more soluble in aqueous solvents and/or organic solvents. Without wishing to be bound by theory, it is believed that the amino acid ester or amino acid amide and the protonated oligonucleotide form a salt, such as illustrated above, and the salt is soluble in aqueous and/or organic solvents.

Similarly, without wishing to be bound by theory, it is believed that the pharmaceutical compositions comprising (i) an oligonucleotide of the invention; (ii) a divalent metal cation; and (iii) optionally a carboxylate, a phospholipid, a phosphatidyl choline, or a sphingomyelin form a salt, such as illustrated above, and the salt is soluble in aqueous and/or organic solvents.

In one embodiment, the concentration of the oligonucleotide of the invention in the solvent is greater than about 2 percent by weight of the pharmaceutical composition. In one embodiment, the concentration of the oligonucleotide of the invention in the solvent is greater than about 5 percent by weight of the pharmaceutical composition. In one embodiment, the concentration of the oligonucleotide in the solvent is greater than about 7.5 percent by weight of the pharmaceutical composition. In one embodiment, the concentration of the oligonucleotide in the solvent is greater than about 10 percent by weight of the pharmaceutical composition. In one embodiment, the concentration of the oligonucleotide in the solvent is greater than about 12 percent by weight of the pharmaceutical composition. In one embodiment, the concentration of the oligonucleotide in the solvent is greater than about 15 percent by weight of the pharmaceutical composition. In one embodiment, the concentration of the oligonucleotide in the solvent is ranges from about 2 percent to 5 percent by weight of the pharmaceutical composition. In one embodiment, the concentration of the oligonucleotide in the solvent is ranges from about 2 percent to 7.5 percent by weight of the pharmaceutical composition. In one embodiment, the concentration of the oligonucleotide in the solvent ranges from about 2 percent to 10 percent by weight of the pharmaceutical composition. In one embodiment, the concentration of the oligonucleotide in the solvent is ranges from about 2 percent to 12 percent by weight of the pharmaceutical composition. In one embodiment, the concentration of the oligonucleotide in the solvent is ranges from about 2 percent to 15 percent by weight of the pharmaceutical composition. In one embodiment, the concentration of the oligonucleotide in the solvent is ranges from about 2 percent to 20 percent by weight of the pharmaceutical composition.

Any pharmaceutically acceptable organic solvent can be used in the pharmaceutical compositions of the invention. Representative, pharmaceutically acceptable organic solvents include, but are not limited to, pyrrolidone, N-methyl-2-pyrrolidone, polyethylene glycol, propylene glycol (i.e., 1,3-propylene glycol), glycerol formal, isosorbid dimethyl ether, ethanol, dimethyl sulfoxide, tetraglycol, tetrahydrofurfuryl alcohol, triacetin, propylene carbonate, dimethyl acetamide, dimethyl formamide, dimethyl sulfoxide, and combinations thereof.

In one embodiment, the pharmaceutically acceptable organic solvent is a water soluble solvent. A representative pharmaceutically acceptable water soluble organic solvents is triacetin.

In one embodiment, the pharmaceutically acceptable organic solvent is a water miscible solvent. Representative pharmaceutically acceptable water miscible organic solvents include, but are not limited to, glycerol formal, polyethylene glycol, and propylene glycol.

In one embodiment, the pharmaceutically acceptable organic solvent comprises pyrrolidone. In one embodiment, the pharmaceutically acceptable organic solvent is pyrrolidone substantially free of another organic solvent.

In one embodiment, the pharmaceutically acceptable organic solvent comprises N-methyl-2-pyrrolidone. In one embodiment, the pharmaceutically acceptable organic solvent is N-methyl-2-pyrrolidone substantially free of another organic solvent.

In one embodiment, the pharmaceutically acceptable organic solvent comprises polyethylene glycol. In one embodiment, the pharmaceutically acceptable organic solvent is polyethylene glycol substantially free of another organic solvent.

In one embodiment, the pharmaceutically acceptable organic solvent comprises propylene glycol. In one embodiment, the pharmaceutically acceptable organic solvent is propylene glycol substantially free of another organic solvent.

In one embodiment, the pharmaceutically acceptable organic solvent comprises glycerol formal. In one embodiment, the pharmaceutically acceptable organic solvent is glycerol formal substantially free of another organic solvent.

In one embodiment, the pharmaceutically acceptable organic solvent comprises isosorbid dimethyl ether. In one embodiment, the pharmaceutically acceptable organic solvent is isosorbid dimethyl ether substantially free of another organic solvent.

In one embodiment, the pharmaceutically acceptable organic solvent comprises ethanol. In one embodiment, the pharmaceutically acceptable organic solvent is ethanol substantially free of another organic solvent.

In one embodiment, the pharmaceutically acceptable organic solvent comprises dimethyl sulfoxide. In one embodiment, the pharmaceutically acceptable organic solvent is dimethyl sulfoxide substantially free of another organic solvent.

In one embodiment, the pharmaceutically acceptable organic solvent comprises tetraglycol. In one embodiment, the pharmaceutically acceptable organic solvent is tetraglycol substantially free of another organic solvent.

In one embodiment, the pharmaceutically acceptable organic solvent comprises tetrahydrofurfuryl alcohol. In one embodiment, the pharmaceutically acceptable organic solvent is tetrahydrofurfuryl alcohol substantially free of another organic solvent.

In one embodiment, the pharmaceutically acceptable organic solvent comprises triacetin. In one embodiment, the pharmaceutically acceptable organic solvent is triacetin substantially free of another organic solvent.

In one embodiment, the pharmaceutically acceptable organic solvent comprises propylene carbonate. In one embodiment, the pharmaceutically acceptable organic solvent is propylene carbonate substantially free of another organic solvent.

In one embodiment, the pharmaceutically acceptable organic solvent comprises dimethyl acetamide. In one embodiment, the pharmaceutically acceptable organic solvent is dimethyl acetamide substantially free of another organic solvent.

In one embodiment, the pharmaceutically acceptable organic solvent comprises dimethyl formamide. In one embodiment, the pharmaceutically acceptable organic solvent is dimethyl formamide substantially free of another organic solvent.

In one embodiment, the pharmaceutically acceptable organic solvent comprises at least two pharmaceutically acceptable organic solvents.

In one embodiment, the pharmaceutically acceptable organic solvent comprises N-methyl-2-pyrrolidone and glycerol formal. In one embodiment, the pharmaceutically acceptable organic solvent is N-methyl-2-pyrrolidone and glycerol formal. In one embodiment, the ratio of N-methyl-2-pyrrolidone to glycerol formal ranges from about 90:10 to 10:90.

In one embodiment, the pharmaceutically acceptable organic solvent comprises propylene glycol and glycerol formal. In one embodiment, the pharmaceutically acceptable organic solvent is propylene glycol and glycerol formal. In one embodiment, the ratio of propylene glycol to glycerol formal ranges from about 90:10 to 10:90.

In one embodiment, the pharmaceutically acceptable organic solvent is a solvent that is recognized as GRAS by the FDA for administration or consumption by animals. In one embodiment, the pharmaceutically acceptable organic solvent is a solvent that is recognized as GRAS by the FDA for administration or consumption by humans.

In one embodiment, the pharmaceutically acceptable organic solvent is substantially free of water. In one embodiment, the pharmaceutically acceptable organic solvent contains less than about 1 percent by weight of water. In one embodiment, the pharmaceutically acceptable organic solvent contains less about 0.5 percent by weight of water. In one embodiment, the pharmaceutically acceptable organic solvent contains less about 0.2 percent by weight of water. Pharmaceutically acceptable organic solvents that are substantially free of water are advantageous since they are not conducive to bacterial growth. Accordingly, it is typically not necessary to include a preservative in pharmaceutical compositions that are substantially free of water. Another advantage of pharmaceutical compositions that use a pharmaceutically acceptable organic solvent, preferably substantially free of water, as the solvent is that hydrolysis of the oligonucleotide is minimized. Typically, the more water present in the solvent the more readily the oligonucleotide can be hydrolyzed. Accordingly, oligonucleotide containing pharmaceutical compositions that use a pharmaceutically acceptable organic solvent as the solvent can be more stable than oligonucleotide containing pharmaceutical compositions that use water as the solvent.

In one embodiment, comprising a pharmaceutically acceptable organic solvent, the pharmaceutical composition is injectable.

In one embodiment, the injectable pharmaceutical compositions are of sufficiently low viscosity that they can be easily drawn into a 20 gauge and needle and then easily expelled from the 20 gauge needle. Typically, the viscosity of the injectable pharmaceutical compositions are less than about 1,200 cps. In one embodiment, the viscosity of the injectable pharmaceutical compositions are less than about 1,000 cps. In one embodiment, the viscosity of the injectable pharmaceutical compositions are less than about 800 cps. In one embodiment, the viscosity of the injectable pharmaceutical compositions are less than about 500 cps. Injectable pharmaceutical compositions having a viscosity greater than about 1,200 cps and even greater than about 2,000 cps (for example gels) are also within the scope of the invention provided that the compositions can be expelled through an 18 to 24 gauge needle.

In one embodiment, comprising a pharmaceutically acceptable organic solvent, the pharmaceutical composition is injectable and does not form a precipitate when injected into water.

In one embodiment, comprising a pharmaceutically acceptable organic solvent, the pharmaceutical composition is injectable and forms a precipitate when injected into water. Without wishing to be bound by theory, it is believed, for pharmaceutical compositions that comprise a protonated oligonucleotide and an amino acid ester or amide, that the α-amino group of the amino acid ester or amino acid amide is protonated by the oligonucleotide to form a salt, such as illustrated above, which is soluble in the pharmaceutically acceptable organic solvent but insoluble in water. Similarly, when the pharmaceutical composition comprises (i) an oligonucleotide; (ii) a divalent metal cation; and (iii) optionally a carboxylate, a phospholipid, a phosphatidyl choline, or a sphingomyelin, it is believed that the components of the composition form a salt, such as illustrated above, which is soluble in the pharmaceutically acceptable organic solvent but insoluble in water. Accordingly, when the pharmaceutical compositions are injected into an animal, at least a portion of the pharmaceutical composition precipitates at the injection site to provide a drug depot. Without wishing to be bound by theory, it is believed that when the pharmaceutically compositions are injected into an animal, the pharmaceutically acceptable organic solvent diffuses away from the injection site and aqueous bodily fluids diffuse towards the injection site, resulting in an increase in concentration of water at the injection site, that causes at least a portion of the composition to precipitate and form a drug depot. The precipitate can take the form of a solid, a crystal, a gummy mass, or a gel. The precipitate, however, provides a depot of the oligonucleotide at the injection site that releases the oligonucleotide over time. The components of the pharmaceutical composition, i.e., the amino acid ester or amino acid amide, the pharmaceutically acceptable organic solvent, and any other components are biocompatible and non-toxic and, over time, are simply absorbed and/or metabolized by the body.

In one embodiment, comprising a pharmaceutically acceptable organic solvent, the pharmaceutical composition is injectable and forms liposomal or micellar structures when injected into water (typically about 500 μL are injected into about 4 mL of water). The formation of liposomal or micellar structures are most often formed when the pharmaceutical composition includes a phospholipid. Without wishing to be bound by theory, it is believed that the oligonucleotide in the form of a salt, which can be a salt formed with an amino acid ester or amide or can be a salt with a divalent metal cation and optionally a carboxylate, a phospholipid, a phosphatidyl choline, or a sphingomyelin, that is trapped within the liposomal or micellar structure. Without wishing to be bound by theory, it is believed that when these pharmaceutically compositions are injected into an animal, the liposomal or micellar structures release the oligonucleotide over time.

In one embodiment, the pharmaceutical composition further comprising a pharmaceutically acceptable organic solvent is a suspension of solid particles in the pharmaceutically acceptable organic solvent. Without wishing to be bound by theory, it is believed that the solid particles comprise a salt formed between the amino acid ester or amino acid amide and the protonated oligonucleotide wherein the acidic phosphate groups of the oligonucleotide protonates the amino group of the amino acid ester or amino acid amide, such as illustrated above, or comprises a salt formed between the oligonucleotide; divalent metal cation; and optional carboxylate, phospholipid, phosphatidyl choline, or sphingomyelin, as illustrated above. Pharmaceutical compositions that are suspensions can also form drug depots when injected into an animal.

By varying the lipophilicity and/or molecular weight of the amino acid ester or amino acid amide it is possible to vary the properties of pharmaceutical compositions that include these components and further comprise an organic solvent. The lipophilicity and/or molecular weight of the amino acid ester or amino acid amide can be varied by varying the amino acid and/or the alcohol (or amine) used to form the amino acid ester (or amino acid amide). For example, the lipophilicity and/or molecular weight of the amino acid ester can be varied by varying the R1 hydrocarbon group of the amino acid ester. Typically, increasing the molecular weight of R1 increase the lipophilicity of the amino acid ester. Similarly, the lipophilicity and/or molecular weight of the amino acid amide can be varied by varying the R3 or R4 groups of the amino acid amide.

For example, by varying the lipophilicity and/or molecular weight of the amino acid ester or amino acid amide it is possible to vary the solubility of the oligonucleotide of the invention in water, to vary the solubility of the oligonucleotide in the organic solvent, vary the viscosity of the pharmaceutical composition comprising a solvent, and vary the ease at which the pharmaceutical composition can be drawn into a 20 gauge needle and then expelled from the 20 gauge needle.

Furthermore, by varying the lipophilicity and/or molecular weight of the amino acid ester or amino acid amide (i.e., by varying R1 of the amino acid ester or R3 and R4 of the amino acid amide) it is possible to control whether the pharmaceutical composition that further comprises an organic solvent will form a precipitate when injected into water. Although different oligonucleotides exhibit different solubility and behavior, generally the higher the molecular weight of the amino acid ester or amino acid amide, the more likely it is that the salt of the protonated oligonucleotide and the amino acid ester of the amide will form a precipitate when injected into water. Typically, when R1 of the amino acid ester is a hydrocarbon of about C16 or higher the pharmaceutical composition will form a precipitate when injected into water and when R1 of the amino acid ester is a hydrocarbon of about C12 or less the pharmaceutical composition will not form a precipitate when injected into water. Indeed, with amino acid esters wherein R1 is a hydrocarbon of about C12 or less, the salt of the protonated oligonucleotide and the amino acid ester is, in many cases, soluble in water. Similarly, with amino acid amides, if the combined number of carbons in R3 and R4 is 16 or more the pharmaceutical composition will typically form a precipitate when injected into water and if the combined number of carbons in R3 and R4 is 12 or less the pharmaceutical composition will not form a precipitate when injected into water. Whether or not a pharmaceutical composition that further comprises a pharmaceutically acceptable organic solvent will form a precipitate when injected into water can readily be determined by injecting about 0.05 mL of the pharmaceutical composition into about 4 mL of water at about 98° F. and determining how much material is retained on a 0.22 µm filter after the composition is mixed with water and filtered. Typically, a formulation or composition is considered to be injectable when no more than 10% of the formulation is retained on the filter. In one embodiment, no more than 5% of the formulation is retained on the filter. In one embodiment, no more than 2% of the formulation is retained on the filter. In one embodiment, no more than 1% of the formulation is retained on the filter.

Similarly, in pharmaceutical compositions that comprise a protonated oligonucleotide and a diester or diamide of aspartic or glutamic acid, it is possible to vary the properties of pharmaceutical compositions by varying the amount and/or lipophilicity and/or molecular weight of the diester or diamide of aspartic or glutamic acid. Similarly, in pharmaceutical compositions that comprise an oligonucleotide; a divalent metal cation; and a carboxylate, a phospholipid, a phosphatidyl choline, or a sphingomyelin, it is possible to vary the properties of pharmaceutical compositions by varying the amount and/or lipophilicity and/or molecular weight of the carboxylate, phospholipid, phosphatidyl choline, or sphingomyelin.

Further, when the pharmaceutical compositions that further comprises an organic solvent form a depot when administered to an animal, it is also possible to vary the rate at which the oligonucleotide is released from the drug depot by varying the lipophilicity and/or molecular weight of the amino acid ester or amino acid amide. Generally, the more lipophilic the amino acid ester or amino acid amide, the more slowly the oligonucleotide is released from the depot. Similarly, when the pharmaceutical compositions that further comprises an organic solvent and also further comprise a carboxylate, phospholipid, phosphatidyl choline, sphingomyelin, or a diester or diamide of aspartic or glutamic acid and form a depot when administered to an animal, it is possible to vary the rate at which the oligonucleotide is released from the drug depot by varying the amount and/or lipophilicity and/or molecular weight of the carboxylate, phospholipid, phosphatidyl choline, sphingomyelin, or the diester or diamide of aspartic or glutamic acid.

Release rates from a precipitate can be measured injecting about 50 µL of the pharmaceutical composition into about 4 mL of deionized water in a centrifuge tube. The time that the pharmaceutical composition is injected into the water is recorded as T=0. After a specified amount of time, T, the sample is cooled to about −9° C. and spun on a centrifuge at about 13,000 rpm for about 20 min. The resulting supernatant is then analyzed by HPLC to determine the amount of oligonucleotide present in the aqueous solution. The amount of oligonucleotide in the pellet resulting from the centrifugation can also be determined by collecting the pellet, dissolving the pellet in about 10 µL of methanol, and analyzing the methanol solution by HPLC to determine the amount of oligonucleotide in the precipitate. The amount of oligonucleotide in the aqueous solution and the amount of oligonucleotide in the precipitate are determined by comparing the peak area for the HPLC peak corresponding to the oligonucleotide against a standard curve of oligonucleotide peak area against concentration of oligonucleotide. Suitable HPLC conditions can be readily determined by one of ordinary skill in the art.

Methods of Treatment

The pharmaceutical compositions of the invention are useful in human medicine and veterinary medicine. Accordingly, the invention further relates to a method of treating or preventing a condition in an animal comprising administering to the animal an effective amount of the pharmaceutical composition of the invention.

In one embodiment, the invention relates to methods of treating a condition in an animal comprising administering to an animal in need thereof an effective amount of a pharmaceutical composition of the invention.

In one embodiment, the invention relates to methods of preventing a condition in an animal comprising administering to an animal in need thereof an effective amount of a pharmaceutical composition of the invention.

Methods of administration include, but are not limited to, intradermal, intramuscular, intraperitoneal, intravenous, subcutaneous, intranasal, epidural, oral, sublingual, intracerebral, intravaginal, transdermal, rectal, by inhalation, or topical. The mode of administration is left to the discretion of the practitioner. In some embodiments, administration will result in the release of the oligonucleotide of the invention, e.g., an aptamer, an drug targeting aptamer, a multipartite construct, or any combination thereof, into the bloodstream.

In one embodiment, the method of treating or preventing a condition in an animal comprises administering to the animal in need thereof an effective amount of an oligonucleotide by parenterally administering the pharmaceutical composition of the invention. In one embodiment, the pharmaceutical compositions are administered by infusion or bolus injection. In one embodiment, the pharmaceutical composition is administered subcutaneously.

In one embodiment, the method of treating or preventing a condition in an animal comprises administering to the animal in need thereof an effective amount of an oligonucleotide by orally administering the pharmaceutical composition of the invention. In one embodiment, the composition is in the form of a capsule or tablet.

The pharmaceutical compositions can also be administered by any other convenient route, for example, topically, by absorption through epithelial or mucocutaneous linings (e.g., oral, rectal, and intestinal mucosa, etc.).

The pharmaceutical compositions can be administered systemically or locally.

The pharmaceutical compositions can be administered together with another biologically active agent.

In one embodiment, the animal is a mammal.

In one embodiment the animal is a human.

In one embodiment, the animal is a non-human animal.

In one embodiment, the animal is a canine, a feline, an equine, a bovine, an ovine, or a porcine.

The effective amount administered to the animal depends on a variety of factors including, but not limited to the type of animal being treated, the condition being treated, the severity of the condition, and the specific multipartite construct being administered. A treating physician can determine an effective amount of the pharmaceutical composition to treat a condition in an animal.

In one embodiment, the multipartite construct can inhibit angiogenesis. In one embodiment, the multipartite construct can inhibit angiogenesis and the disease being treated is cancer. In one embodiment, the aptamer can inhibit angiogenesis and the disease being treated is a solid tumor.

The multipartite construct can be a multipartite construct that inhibits a neoplastic growth or a cancer. In embodiments, the cancer comprises an acute lymphoblastic leukemia; acute myeloid leukemia; adrenocortical carcinoma; AIDS-related cancers; AIDS-related lymphoma; anal cancer; appendix cancer, astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer; gallbladder cancer, gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer, malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer, nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer, ovarian epithelial cancer; ovarian germ cell tumor; ovarian low malignant potential tumor, pancreatic cancer; papillomatosis; paranasal sinus cancer; parathyroid cancer; pelvic cancer, penile cancer; pharyngeal cancer; pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer; respiratory tract cancer, retinoblastoma; rhabdomyosarcoma; salivary gland cancer; Sdzary syndrome; small cell lung cancer, small intestine cancer; soft tissue sarcoma; squamous cell carcinoma; squamous neck cancer, stomach (gastric) cancer; supratentorial primitive neuroectodermal tumors; T-cell lymphoma; testicular cancer; throat cancer; thymic carcinoma; thymoma; thyroid cancer; transitional cell cancer; transitional cell cancer of the renal pelvis and ureter, trophoblastic tumor; ureter cancer; urethral cancer; uterine cancer; uterine sarcoma; vaginal cancer, vulvar cancer; Waldenström macroglobulinemia; or Wilm's tumor. The compositions and methods of the invention can be used to treat these and other cancers.

Oligonucleotide Probe Methods

Nucleic acid sequences fold into secondary and tertiary motifs particular to their nucleotide sequence. These motifs position the positive and negative charges on the nucleic acid sequences in locations that enable the sequences to bind to specific locations on target molecules, including without limitation proteins and other amino acid sequences. These binding sequences are known in the field as aptamers. Due to the trillions of possible unique nucleotide sequences in even a relatively short stretch of nucleotides (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides), a large variety of motifs can be generated, resulting in aptamers for almost any desired protein or other target.

As described above, aptamers can be created by randomly generating oligonucleotides of a specific length, typically 20-80 base pairs long, e.g., 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 base pairs. These random oligonucleotides are then incubated with the target of interest (e.g., tissue, cell, microvesicle, protein, etc). After several wash steps, the oligonucleotides that bind to the target are collected and amplified. The amplified aptamers are iteratively added to the target and the process is repeated, often 15-20 times. A common version of this process known to those of skill in the art as the SELEX method.

The end result comprises one or more oligonucleotide probes/aptamers with high affinity to the target. The invention provides further processing of such resulting aptamers that can be use to provide desirable characteristics: 1) competitive binding assays to identify aptamers to a desired epitope; 2) motif analysis to identify high affinity binding aptamers in silico; and 3) aptamer selection assays to identify aptamers that can be used to detect a particular disease. The methods are described in more detail below and further in the Examples.

The invention further contemplates aptamer sequences that are highly homologous to the sequences that are discovered by the methods of the invention. "High homology" typically refers to a homology of 40% or higher, preferably 60% or higher, 70% or higher, more preferably 80% or higher, even more preferably 85%, 90%, 91%, 92%, 93%, 94%, 95%, 96%, 97%, 98%, 99% or higher between a polynucleotide sequence sequence and a reference sequence. In an embodiment, the reference sequence comprises the sequence of one or more aptamer provided herein. Percent homologies (also referred to as percent identity) are typically carried out between two optimally aligned sequences. Methods of alignment of sequences for comparison are well-known in the art. Optimal alignment of sequences and comparison can be conducted, e.g., using the algorithm in "Wilbur and Lipman, Proc Natl Acad Sci USA 80: 726-30 (1983)". Homology calculations can also be performed using BLAST, which can be found on the NCBI server at: www.ncbi.nlm.nih.gov/BLAST/ (Altschul S F, et al, Nucleic Acids Res. 1997; 25(17):3389-402; Altschul S F, et al, J Mol. Biol. 1990; 215(3):403-10). In the case of an isolated polynucleotide which is longer than or equivalent in length to the reference sequence, e.g., a sequence identified by the methods herein, the comparison is made with the full length of the reference sequence. Where the isolated polynucleotide is shorter than the reference sequence, e.g., shorter than a sequence identified by the methods herein, the comparison is made to a segment of the reference sequence of the same length (excluding any loop required by the homology calculation).

The invention further contemplates aptamer sequences that are functional fragments of the sequences that are discovered by the methods of the invention. In the context of an aptamer sequence, a "functional fragment" of the aptamer sequence may comprise a subsequence that binds to the same target as the full length sequence. In some instances, a candidate aptamer sequence is from a member of a library that contains a 5' leader sequences and/or a 3' tail sequence. Such leader sequences or tail sequences may serve to facilitate primer binding for amplification or capture, etc. In these embodiments, the functional fragment of the full length sequence may comprise the subsequence of the candidate aptamer sequence absent the leader and/or tail sequences.

Competitive Antibody Addition

Known aptamer production methods may involve eluting all bound aptamers from the target sequence. In some cases, this may not easily identify the desired aptamer sequence. For example, when trying to replace an antibody in an assay, it may be desirable to only collect aptamers that bind to the specific epitope of the antibody being replaced. The invention provides a method comprising addition of an antibody that is to be replaced to the aptamer/target reaction in order to allow for the selective collection of aptamers which bind to the antibody epitope. In an embodiment, the method comprises incubating a reaction mixture comprising randomly generated oligonucleotides with a target of interest, removing unbound aptamers from the reaction mixture that do not bind the target, adding an antibody to the reaction mixture that binds to that epitope of interest, and collecting the aptamers that are displaced by the antibody. The target can be a a biological entity such as disclosed herein, e.g., a protein.

Motif Analysis

Figure 2B:
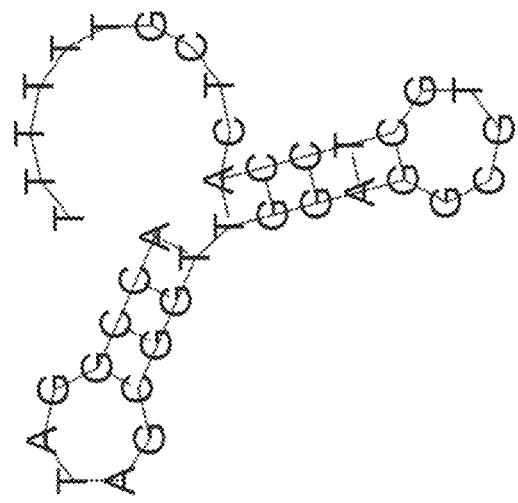
FIGS. 2A-B illustrates a non-limiting example of an aptamer nucleotide sequence and its secondary structure.
Figure 2A:
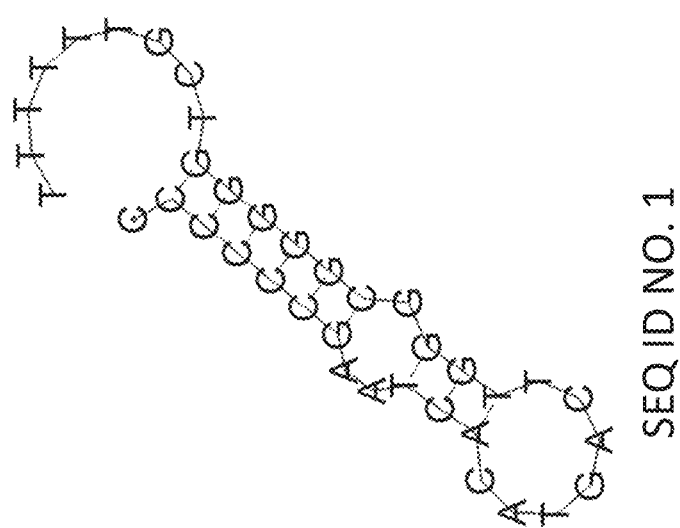

In aptamer experiments, multiple aptamer sequences can be identified that bind to a given target. These aptamers will have various binding affinities. It can be time consuming and laborious to generate quantities of these many aptamers sufficient to assess the affinities of each. To identify large numbers of aptamers with the highest affinities without physically screening large subsets, the invention provides a method comprising the analysis of the two dimensional structure of one or more high affinity aptamers to the target of interest. In an embodiment, the method comprises screening the database for aptamers that have similar two-dimensional structures, or motifs, but not necessarily similar primary sequences. In an embodiment, the method comprises identifying a high affinity aptamer using traditional methods such as disclosed herein or known in the art (e.g. surface plasmon resonance binding assay), approximating the two-dimensional structure of the high affinity aptamer, and identifying aptamers from a pool of sequences that are predicted to have a similar two-dimensional structure to the high affinity aptamer. The method thereby provides a pool of candidates that also bind the target of interest. The two-dimensional structure of an oligo can be predicting using methods known in the art, e.g., via free energy ($\Delta G$) calculations performed using a commercially available software program such as Vienna or mFold, for example as described in Mathews, D., Sabina, J., Zucker, M. & Turner, H. Expanded sequence dependence of thermodynamic parameters provides robust prediction of RNA secondary structure. J. Mol. Biol. 288, 911-940 (1999); Hofacker et al., Monatshefte f. Chemie 125: 167-188 (1994); and Hofacker, I. L. Vienna RNA secondary structure server. Nucleic Acids Res. 31, 3429-3431 (2003), the contents of which are incorporated herein by reference in their entirety. See FIGS. 2A-2B. The pool of sequences can be sequenced from a pool of randomly generated aptamer candidates using a high-throughput sequencing platform, such as the Ion Torrent platform from Thermo Fisher Scientific (Waltham, Mass.) or HiSeq/NextSeq/MiSeq platform from Illumina, Inc (San Diego, Calif.). Identifying aptamers from a pool of sequences that are predicted to have a similar two-dimensional structure to the high affinity aptamer may comprise loading the resulting sequences into the software program of choice to identify members of the pool of sequences with similar two-dimensional structures as the high affinity aptamer. The affinities of the pool of sequences can then be determined in situ, e.g., surface plasmon resonance binding assay or the like.

Aptamer Subtraction Methods

In order to develop an assay to detect a disease, for example, cancer, one typically screens a large population of known biomarkers from normal and diseased patients in order to identify markers that correlate with disease. This process works where discriminating markers are already described. In order to address this problem, the invention provides a method comprising subtracting out non-discriminating aptamers from a large pool of aptamers by incubating them initially with non-target tissue, microvesicles, cells, or other targets of interest. The non-target entities can be from a normal/healthy/non-diseased sample. The aptamers that did not bind to the normal non-target entities are then incubated with diseased entities. The aptamers that bind to the diseased entities but that did not bind the normal entities are then possible candidates for an assay to detect the disease. This process is independent of knowing the existence of a particular marker in the diseased sample.

Subtraction methods can be used to identify aptamers that preferentially recognize a desired population of targets. In an embodiment, the subtraction method is used to identify aptamers that preferentially recognize target from a diseased target population over a control (e.g., normal or non-diseased) population. The diseased target population may be a tissue or a population of cells or microvesicles from a diseased individual or individuals, whereas the control population comprises corresponding tissue, cells or microvesicles from a non-diseased individual or individuals. The disease can be a cancer or other disease disclosed herein or known in the art. Accordingly, the method provides aptamers that preferentially identify disease targets versus control targets.

Circulating microvesicles can be isolated from control samples, e.g., plasma from "normal" individuals that are absent a disease of interest, such as an absence of cancer. Vesicles in the sample are isolated using a method disclosed herein or as known in the art. For example, vesicles can be isolated from the plasma by one of the following methods: filtration, ultrafiltration, nanomembrane ultrafiltration, the ExoQuick reagent (System Biosciences, Inc., Mountain View, Calif.), centrifugation, ultracentrifugation, using a molecular crowding reagent (e.g., TEXIS from Life Technologies), polymer precipitation (e.g., polyethylene glycol (PEG)), affinity isolation, affinity selection, immunoprecipitation, chromatography, size exclusion, or a combination of any of these methods. The microvesicles isolated in each case will be a mixture of vesicle types and will be various sizes although ultracentrifugation methods may have more tendencies to produce exosomal-sized vesicles. Randomly generated oligonucleotide libraries (e.g., produced as described in the Examples herein) are incubated with the isolated normal vesicles. The aptamers that do not bind to these vesicles are isolated, e.g., by precipitating the vesicles (e.g, with PEG) and collecting the supernatant containing the non-binding aptamers. These non-binding aptamers are then contacted with vesicles isolated from diseased patients (e.g., using the same methods as described above) to allow the aptamers to recognize the disease vesicles. Next, aptamers that are bound to the diseased vesicles are collected. In an embodiment, the vesicles are isolated then lysed using a chaotropic agent (e.g., SDS or a similar detergent), and the aptamers are then captured by running the lysis mixture over an affinity column. The affinity column may comprise streptavidin beads in the case of biotin conjugated aptamer pools. The isolated aptamers are the amplified. The process can then then repeated, e.g., 1, 2, 3, 4, 5, 6, 7, 8, 9, 10, 11, 12, 13, 14, 15, 16, 17, 18, 19 or 20 or more times to achieve aptamers having a desired selectivity for the target.

In one aspect of the invention, an aptamer profile is identified that can be used to characterize a biological sample of interest. In an embodiment, a pool of randomly generated oligonucleotides, e.g., at least $10$, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides, is contacted with a biological component or target of interest from a control population. The oligonucleotides that do not bind the biological component or target of interest from the control population are isolated and then contacted with a biological component or target of interest from a test population. The oligonucleotides that bind the biological component or target of interest from the test population are retained. The retained oligonucleotides can be used to repeat the process by contacting the retained oligonucleotides with the biological component or target of interest from the control population, isolating the retained oligonucleotides that do not bind the biological component or target of interest from the control population, and again contacting these isolated oligonucleotides with the biological component or target of interest from the test population and isolating the binding oligonucleotides. The "component" or "target" can be anything that is present in sample to which the oligonucleotides are capable of binding (e.g., tissue, cells, microvesicles, polypeptides, peptide, nucleic acid molecules, carbodyhrates, lipids, etc.). The process can be repeated any number of desired iterations, e.g., 1, 2, 3, 4, 5, 6, 7, 8, 9, 10, 11, 12, 13, 14, 15, 16, 17, 18, 19 or 20 or more times. The resulting oligonucleotides comprise aptamers that can differentially detect the test population versus the control. These aptamers provide an aptamer profile, which comprises a biosignature that is determined using one or more aptamer, e.g., a biosignature comprising a presense or level of the component or target which is detected using the one or more aptamer.

Figure 3:
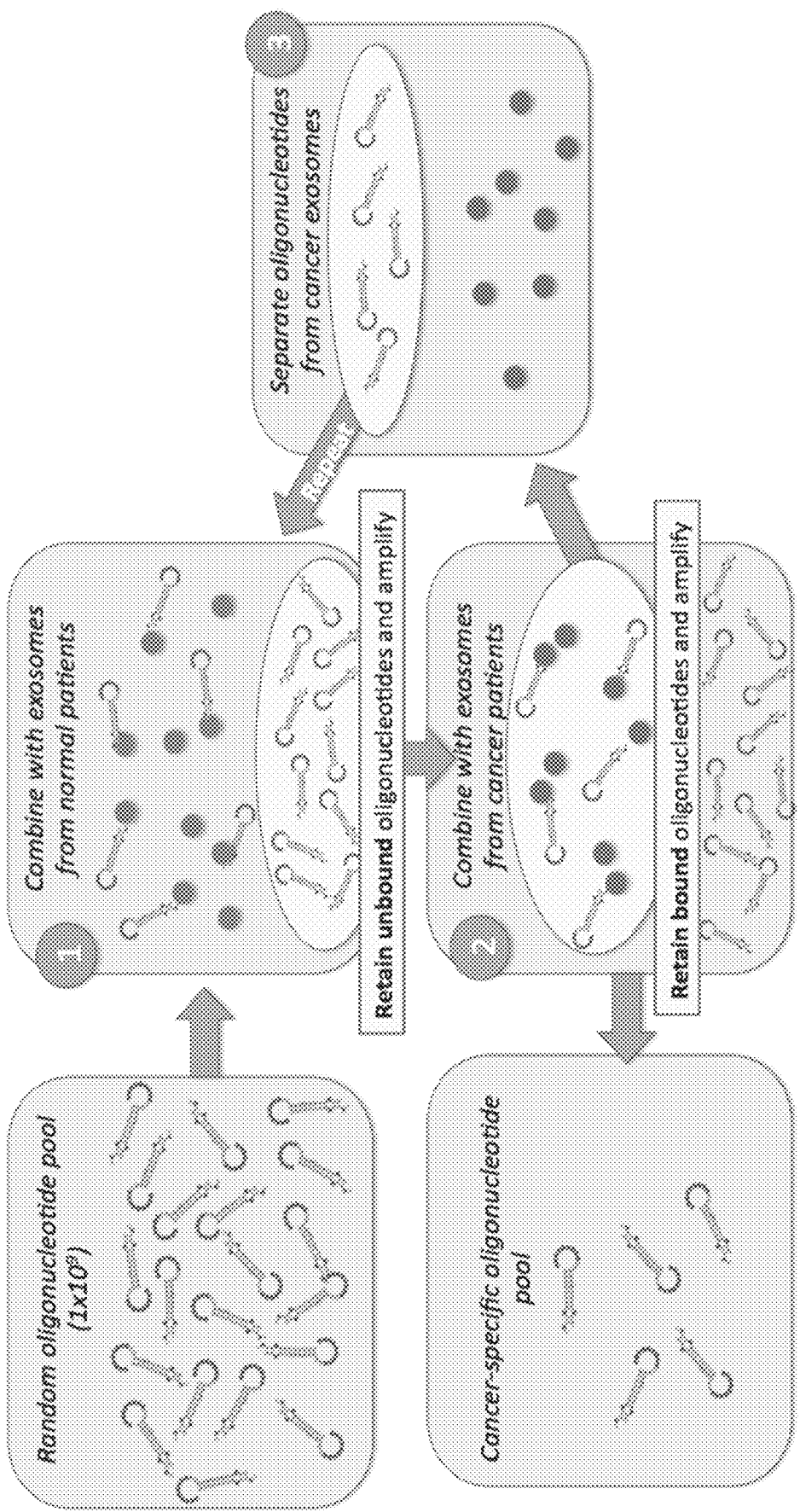
FIG. 3 illustrates a process for producing a target-specific set of aptamers using a cell subtraction method, wherein the target is a biomarker associated with a specific disease. In Step 1, a random pool of oligonucleotides are contacted with a biological sample from a normal patient. In Step 2, the oligos that did not bind in Step 1 are added to a biological sample isolated from diseased patients. The bound oligos from this step are then eluted, captured via their biotin linkage and then combined again with normal biological sample. The unbound oligos are then added again to disease-derived biological sample and isolated. This process can be repeated iteratively. The final eluted aptamers are tested against patient samples to measure the sensitivity and specificity of the set. Biological samples can include blood, including plasma or serum, or other components of the circulatory system, such as microvesicles.

An exemplary process is illustrated in FIG. 3, which demonstrates the method to identify aptamer that preferentially recognize cancer exosomes using exosomes from normal (non-cancer) individuals as a control. In the figure, exosomes are exemplified but one of skill will appreciate that other microvesicles can be used in the same manner. The resulting aptamers can provide a profile that can differentially detect the cancer exosomes from the normal exosomes. One of skill will appreciate that the same steps can be used to derive an aptamer profile to characterize any disease or condition of interest. The process can also be applied with tissue, cells, or other targets of interest.

In an embodiment, the invention provides an isolated polynucleotide that encodes a polypeptide, or a fragment thereof, identified by the methods above. The invention further provides an isolated polynucleotide having a nucleotide sequence that is at least 60% identical to the nucleotide sequence identified by the methods above. More preferably, the isolated nucleic acid molecule is at least 65%, 70%, 75%, 80%, 85%, 9⁰%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of characterizing a biological phenotype using an aptamer profile. The aptamer profile can be determined using the method above. The aptamer profile can be determined for a test sample and compared to a control aptamer profile. The phenotype may be a disease or disorder such as a cancer. Characterizing the phenotype can include without limitation providing a diagnosis, prognosis, or theranosis. Thus, the aptamer profile can provide a diagnostic, prognostic and/or theranostic readout for the subject from whom the test sample is obtained.

In another embodiment, an aptamer profile is determined for a test sample by contacting a pool of aptamer molecules to the test sample, contacting the same pool of aptamers to a control sample, and identifying one or more aptamer molecules that differentially bind a component or target in the test sample but not in the control sample (or vice versa). A "component" or "target" as used in the context of the biological test sample or control sample can be anything that is present in sample to which the aptamers are capable of binding (e.g., tissue, cells, microvesicles, polypeptides, peptide, nucleic acid molecules, carbodyhrates, lipids, etc.). For example, if a sample is a plasma or serum sample, the aptamer molecules may bind a polypeptide biomarker that is solely expressed or differentially expressed (over- or under-expressed) in a disease state as compared to a non-diseased subject. Comparison of the aptamer profile in the test sample as compared to the control sample may be based on qualitative and quantitative measure of aptamer binding (e.g., binding versus no binding, or level of binding in test sample versus different level of binding in the reference control sample).

In an aspect, the invention provides a method of identifying a target-specific aptamer profile, comprising contacting a biological test sample with a pool of aptamer molecules, contacting the pool to a control biological sample, identifying one or more aptamers that bind to a component in said test sample but not to the control sample, thereby identifying an aptamer profile for said biological test sample. In an embodiment, a pool of aptamers is selected against a disease sample and compared to a reference sample, the aptamers in a subset that bind to a component(s) in the disease sample but not in the reference sample can be sequenced using conventional sequencing techniques to identify the subset that bind, thereby identifying an aptamer profile for the particular disease sample. In this way, the aptamer profile provides an individualized platform for detecting disease in other samples that are screened. Furthermore, by selecting an appropriate reference or control sample, the aptamer profile can provide a diagnostic, prognostic and/or theranostic readout for the subject from whom the test sample is obtained.

In a related aspect, the invention provides a method of selecting a pool of aptamers, comprising: (a) contacting a biological control sample with a pool of oligonucleotides; (b) isolating a first subset of the pool of oligonucleotides that do not bind the biological control sample; (c) contacting the biological test sample with the first subset of the pool of oligonucleotides; and (d) isolating a second subset of the pool of oligonucleotides that bind the biological test sample, thereby selecting the pool of aptamers. The pool of oligonucleotides may comprise any number of desired sequences, e.g., at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ oligonucleotides may be present in the starting pool. Steps (a)-(d) may be repeated to further hone the pool of aptamers. In an embodiment, these steps are repeated at least 1, 2, 3, 4, 5, 6, 7, 8, 9, 10, 11, 12, 13, 14, 15, 16, 17, 18, 19 or at least 20 times.

As described herein, the biological test sample and biological control sample may comprise tissues, cells, microvesicles, or biomarkers of interest. In an embodiment, the biological test sample and optionally biological control sample comprise a bodily fluid. The bodily fluid may comprise without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, Cowper's fluid, pre-ejaculatory fluid, female ejaculate, sweat, fecal matter, hair, tears, cyst fluid, pleural fluid, peritoneal fluid, malignant fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates or other lavage fluids. Tthe biological test sample and optionally biological control may also comprise a tumor sample, e.g., cells from a tumor or tumor tissue. In other embodiments, the biological test sample and optionally biological control sample comprise a cell culture medium. In embodiments, the biological test sample comprises a diseased sample and the biological control sample comprises a non-diseased sample. Accordingly, the pool of aptamers may be used to provide a diagnostic, prognostic and/or theranostic readout for the disease.

As noted, the invention can be used to assess microvesicles. Microvesicles are powerful biomarkers because the vesicles provide one biological entity that comprises multiple pieces of information. For example as described, a vesicle can have multiple surface antigens, each of which provides complementary information. Consider a cancer marker and a tissue specific marker. If both markers are individually present in a sample, e.g., both are circulating proteins or nucleic acids, it may not be ascertainable whether the cancer marker and the tissue specific marker are derived from the same anatomical locale. However, if both the cancer marker and the tissue specific marker are surface antigens on a single microvesicle, the vesicle itself links the two markers and provides an indication of a disease (via the cancer marker) and origin of the disease (via the tissue specific marker). Furthermore, the vesicle can have any number of surface antigens and also payload that can be assessed. Accordingly, the invention provides a method for identifying binding agents comprising contacting a plurality of extracellular microvesicles with a randomly generated library of binding agents, identifying a subset of the library of binding agents that have an affinity to one or more components of the extracellular microvesicles. The binding agents may comprise aptamers, antibodies, and/or any other useful type of binding agent disclosed herein or known in the art.

In a related aspect, the invention provides a method for identifying a plurality of target ligands comprising, (a) contacting a reference microvesicle population with a plurality of ligands that are capable of binding one or more microvesicle surface markers, (b) isolating a plurality of reference ligands, wherein the plurality of reference ligands comprise a subset of the plurality of ligands that do not have an affinity for the reference microvesicle population; (c) contacting one or more test microvesicle with the plurality of reference ligands; and (d) identifying a subset of ligands from the plurality of reference ligands that form complexes with a surface marker on the one or more test microvesicle, thereby identifying the plurality of target ligands. The term "ligand" can refer a molecule, or a molecular group, that binds to another chemical entity to form a larger complex. Accordingly, a binding agent comprises a ligand. The plurality of ligands may comprise aptamers, antibodies and/or other useful binding agents described herein or known in the art. The process can also be applied to tissue samples. See, e.g., Examples 19-31 herein.

The invention further provides kits comprising one or more reagent to carry out the methods above. In an embodiment, the one or more reagent comprises a library of potential binding agents that comprises one or more of an aptamer, antibody, and other useful binding agents described herein or known in the art.

Negative and Positive Aptamer Selection

Aptamers can be used in various biological assays, including numerous types of assays which rely on a binding agent. For example, aptamers can be used instead of or along side antibodies in various immunoassay formats, such as sandwich assays, flow cytometry and IHC. The invention provides an aptamer screening method that identifies aptamers that do not bind to any surfaces (substrates, tubes, filters, beads, other antigens, etc.) throughout the assay steps and bind specifically to an antigen of interest. The assay relies on negative selection to remove aptamers that bind non-target antigen components of the final assay. The negative selection is followed by positive selection to identify aptamers that bind the desired antigen.

In an aspect, the invention provides a method of identifying an aptamer specific to a target of interest, comprising (a) contacting a pool of candidate aptamers with one or more assay components, wherein the assay components do not comprise the target of interest; (b) recovering the members of the pool of candidate aptamers that do not bind to the one or more assay components in (a); (c) contacting the members of the pool of candidate aptamers recovered in (b) with the target of interest in the presence of one or more confounding target; and (d) recovering a candidate aptamer that binds to the target of interest in step (c), thereby identifying the aptamer specific to the target of interest. In the method, steps (a) and (b) provide negative selection to remove aptamers that bind non-target entities. Conversely, steps (c) and (d) provide positive selection by identifying aptamers that bind the target of interest but not other confounding targets, e.g., other antigens that may be present in a biological sample which comprises the target of interest. The pool of candidate aptamers may comprise at least 10, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$ or at least $10^{20}$ nucleic acid sequences.

In some embodiments, steps (a)-(b) are optional. In other embodiments, steps (a)-(b) are repeated at least 1, 2, 3, 4, 5, 6, 7, 8, 9, 10, 11, 12, 13, 14, 15, 16, 17, 18, 19 or at least 20 times before positive selection in step (c) is performed. The positive selection can also be performed in multiple rounds. Steps (c)-(d) can be repeated at least 1, 2, 3, 4, 5, 6, 7, 8, 9, 10, 11, 12, 13, 14, 15, 16, 17, 18, 19 or at least 20 times before identifying the aptamer specific to the target of interest. Multiple rounds may provide improved stringency of selection.

In some embodiments, the one or more assay components contacted with the aptamer pool during negative selection comprise one or more of a substrate, a bead, a planar array, a column, a tube, a well, or a filter. One of skill will appreciate that the assay components can include any substance that may be part of a desired biological assay.

The target of interest can be any appropriate entity that can be detected when recognized by an aptamer. In an embodiment, the target of interest comprises a protein or polypeptide. As used herein, "protein," "polypeptide" and "peptide" are used interchangeably unless stated otherwise. The target of interest can be a nucleic acid, including DNA, RNA, and various subspecies of any thereof as disclosed herein or known in the art. The target of interest can comprise a lipid. The target of interest can comprise a carbohydrate. The target of interest can also be a complex, e.g., a complex comprising protein, nucleic acids, lipids and/or carbohydrates. In some embodiments, the target of interest comprises a tissue, cell, or microvesicle. In such cases, the aptamer may be a binding agent to a surface antigen or disease antigen.

The surface antigen can be a biomarker of a disease or disorder. In such cases, the aptamer may be used to provide a diagnosis, prognosis or theranosis of the disease or disorder. For example, the one or more protein may comprise one or more of PSMA, PCSA, B7H3, EpCam, ADAM-10, BCNP, EGFR, IL1B, KLK2, MMP7, p53, PBP, SERPINB3, SPDEF, SSX2, and SSX4. These markers can be used detect a prostate cancer. Additional surface antigens and disease antigens are provided in Tables 3-4 herein.

The one or more confounding target can be an antigen other than the target of interest. For example, a confounding target can be another entity that may be present in a sample to be assayed. As a non-limiting example, consider that the sample to be assessed is a tissue or blood sample from an individual. The target of interest may be a protein, e.g., a surface antigen, which is present in the sample. In this case, a confounding target could be selected from any other antigen that is likely to be present in the sample. Accordingly, the positive selection should provide candidate aptamers that recognize the target of interest but have minimal, if any, interactions with the confounding targets. In some embodiments, the target of interest and the one or more confounding target comprise the same type of biological entity, e.g., all protein, all nucleic acid, all carbohydrate, or all lipids. As a non-limiting example, the target of interest can be a protein selected from the group consisting of SSX4, SSX2, PBP, KLK2, SPDEF, and EpCAM, and the one or more confounding target comprises the other members of this group. In other embodiments, the target of interest and the one or more confounding target comprise different types of biological entities, e.g., any combination of protein, nucleic acid, carbohydrate, and lipids. The one or more confounding targets may also comprise different types of biological entities, e.g., any combination of protein, nucleic acid, carbohydrate, and lipids.

In an embodiment, the invention provides an isolated polynucleotide, or a fragment thereof, identified by the methods above. The invention further provides an isolated polynucleotide having a nucleotide sequence that is at least 60% identical to the nucleotide sequence identified by the methods above. The isolated polynucleotide is also referred to as an aptamer or oligonucleotide probe. More preferably, the isolated nucleic acid molecule is at least 65%, 70%, 75%, 80%, 85%, 90%, 91%, 92%, 93%, 94%, 95%, 96%, 97%, 98%, 99% or more, identical to the nucleotide sequence identified by the methods above. In the case of an isolated polynucleotide which is longer than or equivalent in length to the reference sequence, e.g., a sequence identified by the methods above, the comparison is made with the full length of the reference sequence. Where the isolated polynucleotide is shorter than the reference sequence, e.g., shorter than a sequence identified by the methods above, the comparison is made to a segment of the reference sequence of the same length (excluding any loop required by the homology calculation).

In a related aspect, the invention provides a method of selecting a group of aptamers, comprising: (a) contacting a pool of aptamers to a population of microvesicles from a first sample; (b) enriching a subpool of aptamers that show affinity to the population of microvesicles from the first sample; (c) contacting the subpool to a second population of microvesicles from a second sample; and (d) depleting a second subpool of aptamers that show affinity to the second population of microvesicles from the second sample, thereby selecting the group of aptamers that have preferential affinity for the population of microvesicles from the first sample. The first sample and/or second sample may comprise a biological fluid such as disclosed herein. For example, the biological fluid may include without limitation blood, a blood derivative, plasma, serum or urine. The first sample and/or second sample may also be derived from a cell culture.

In another related aspect, the invention provides a method of selecting a group of aptamers, comprising: (a) contacting a pool of aptamers to a tissue from a first sample; (b) enriching a subpool of aptamers that show affinity to the tissue from the first sample; (c) contacting the subpool to a second tissue from a second sample; and (d) depleting a second subpool of aptamers that show affinity to the second tissue from the second sample, thereby selecting the group of aptamers that have preferential affinity for the tissue from the first sample as compared to the second sample. The first sample and/or second sample may comprise a fixed tissue such as disclosed herein. For example, the fixed tissue may include FFPE tissue. The first sample and/or second sample may comprise a tumor sample.

In an embodiment, the first sample comprises a cancer sample and the second sample comprises a control sample, such as a non-cancer sample. The first sample and/or and the second sample may each comprise a pooled sample. For example, the first sample and/or second sample can comprise bodily fluid from 2, 3, 4, 5, 6, 7, 8, 9, 10, 11, 12, 13, 14, 15, 16, 17, 18, 19, 20, 25, 30, 40, 50, 60, 70, 80, 90, 100 or more than 100 individuals. In such cases, the members of a pool may be chosen to represent a desired phenotype. In a non-limiting example, the members of the first sample pool may be from patients with a cancer and the members of the second sample pool may be from non-cancer controls. With tissue samples, the first sample may comprise tissues from different individuals, e.g., from 2, 3, 4, 5, 6, 7, 8, 9, 10, 11, 12, 13, 14, 15, 16, 17, 18, 19, 20, 25, 30, 40, 50, 60, 70, 80, 90, 100 or more than 100 individuals. As a non-limiting example, the first sample may comprise a fixed tissue from each individual.

Steps (a)-(d) can be repeated a desired number of times in order to further enrich the pool in aptamers that have preferential affinity for the target from the first sample. For example, steps (a)-(d) can be repeated 1, 2, 3, 4, 5, 6, 7, 8, 9, 10, 11, 12, 13, 14, 15, 16, 17, 18, 19, 20 or more than 20 times. The output from step (d) can be used as the input to repeated step (a). In embodiment, the first sample and/or second sample are replaced with a different sample before repeating steps (a)-(d). In a non-limiting example, members of a first sample pool may be from patients with a cancer and members of a second sample pool may be from non-cancer controls. During subsequent repetitions of steps (a)-(d), the first sample pool may comprise samples from different cancer patients than in the prior round/s. Similarly, the second sample pool may comprise samples from different controls than in the prior round/s.

In still another related aspect, the invention provides a method of enriching a plurality of oligonucleotides, comprising: (a) contacting a first sample with the plurality of oligonucleotides; (b) fractionating the first sample contacted in step (a) and recovering members of the plurality of oligonucleotides that fractionated with the first sample; (c) contacting the recovering members of the plurality of oligonucleotides from step (b) with a second sample; (d) fractionating the second sample contacted in step (c) and recovering members of the plurality of oligonucleotides that did not fractionate with the second sample; (e) contacting the recovering members of the plurality of oligonucleotides from step (d) with a third sample; and (f) fractionating the third sample contacted in step (a) and recovering members of the plurality of oligonucleotides that fractionated with the third sample; thereby enriching the plurality of oligonucleotides. The samples can be of any appropriate form as described herein, e.g., tissue, cells, microvesicles, etc. The first and third samples may have a first phenotype while the second sample has a second phenotype. Thus, positive selection occurs for the samples associated with the first phenotype and negative selection occurs for the samples associated with the second phenotype. In one non-limiting example of such selection schemes, the first phenotype comprises biopsy-positive breast cancer and the second phenotype comprises non-breast cancer (biopsy-negative or healthy).

In some embodiments, the first phenotype comprises a medical condition, disease or disorder and the second phenotype comprises a healthy state or a different state of the medical condition, disease or disorder. The first phenotype can be a healthy state and the second phenotype comprises a medical condition, disease or disorder. The medical condition, disease or disorder can be any detectable medical condition, disease or disorder, including without limitation a cancer, a premalignant condition, an inflammatory disease, an immune disease, an autoimmune disease or disorder, a cardiovascular disease or disorder, neurological disease or disorder, infectious disease or pain. Various types of such conditions are disclosed herein. See, e.g., Section "Phenotypes" herein.

Any useful method to isolate microvesicles in whole or in part can be used to fractionate the samples as appropriate. Several useful techniques are described herein. In an embodiment, the fractionating comprises ultracentrifugation in step (b) and polymer precipitation in steps (d) and (f). In other embodiments, polymer precipitation is used in all steps. The polymer can be polyethylene glycol (PEG). Any appropriate form of PEG may be used. For example, the PEG may be PEG 8000. The PEG may be used at any appropriate concentration. For example, the PEG can be used at a concentration of 1%, 2%, 3%, 4%, 5%, 6%, 7%, 8%, 9%, 10%, 11%, 12%, 13%, 14% or 15% to isolate the microvesicles. In some embodiments, the PEG is used at a concentration of 6%.

When the sample comprises an FFPE tissue sample, the sample can be subjected to epitope retrival, also known as antigen retrival, prior ro the enrichment process. Although tissue fixation is useful for the preservation of tissue morphology, this process can also have a negative impact on immuno detection methods. For example, fixation can alter protein biochemistry such that the epitope of interest is masked and can no longer bind to the primary antibody. Masking of the epitope can be caused by cross-linking of amino acids within the epitope, cross-linking unrelated peptides at or near an epitope, altering the conformation of an epitope, or altering the electrostatic charge of the antigen. Epitope retrieval refers to any technique in which the masking of an epitope is reversed and epitope-recognition is restored. Techniques for epitope retrieval are known in the art. For example, enzymes including Proteinase K, Trypsin, and Pepsin have been used successfully to restore epitope binding. Without being bound by theory, the mechanism of action may be the cleavage of peptides that may be masking the epitope. Heating the sample may also reverse some cross-links and allows for restoration of secondary or tertiary structure of the epitope. Change in pH or cation concentration may also influence epitope availability.

The contacting can be performed in the presence of a competitor, which may reduce non-specific binding events. Any useful competitor can be used. In an embodiment, the competitor comprises at least one of salmon sperm DNA, tRNA, dextran sulfate and carboxymethyl dextran. As desired, different competitors or competitor concentrations can be used at different contacting steps.

The method can be repeated to achieve a desired enrichment. In an embodiment, steps (a)-(f) are repeated at least once. These steps can be repeated 1, 2, 3, 4, 5, 6, 7, 8, 9, 10, 11, 12, 13, 14, 15, 16, 17, 18, 19, 20, or more than 20 times as desired. At the same time, each of the contacting steps can be repeated as desired. In some embodiments, the method further comprises: (i) repeating steps (a)-(b) at least once prior to step (c), wherein the recovered members of the plurality of oligonucleotides that fractionated with the first sample in step (b) are used as the input plurality of oligonucleotides for the repetition of step (a); (ii) repeating steps (c)-(d) at least once prior to step (e), wherein the recovered members of the plurality of oligonucleotides that did not fractionate with the second sample in step (d) are used as the input plurality of oligonucleotides for the repetition of step (c); and/or (iii) repeating steps (e)-(f) at least once, wherein the recovered members of the plurality of oligonucleotides that fractionated with the third sample in step (f) are used as the input plurality of oligonucleotides for the repetition of step (e). Repetitions (i)-(iii) can be repeated any desired number of times, e.g., (i)-(iii) can be repeated 1, 2, 3, 4, 5, 6, 7, 8, 9, 10, 11, 12, 13, 14, 15, 16, 17, 18, 19, 20 or more than 20 times. In an embodiment, (i)-(iii) each comprise three repetitions.

The method may further comprise identifying the members of the selected group of aptamers or oligonucleotides, e.g., by DNA sequencing. The sequencing may be performed by Next Generation sequencing as desired and after or before any desired step in the method.

The method may also comprise identifying the targets of the selected group of aptamers/oligonucleotides. Useful methods to identify such targets are disclosed herein. In a non-limiting example, an enriched oligonucleotide library is contacted with an appropriate sample (e.g., the first or third sample), the library is cross-linked to the sample, and the library is recovered. Proteins cross-linked with the recovered library are identified, e.g., by mass spectrometry.

Oligonucleotide Probe Target Identification

The methods and kits above can be used to identify binding agents that differentiate between two target populations. The invention further provides methods of identifying the targets of such binding agents. For example, the methods may further comprise identifying a surface marker of a cell or microvesicle that is recognized by the binding agent.

In an embodiment, the invention provides a method of identifying a target of a binding agent comprising: (a) contacting the binding agent with the target to bind the target with the binding agent, wherein the target comprises a surface antigen of a cell or microvesicle; (b) disrupting the cell or microvesicle under conditions which do not disrupt the binding of the target with the binding agent; (c) isolating the complex between the target and the binding agent; and (d) identifying the target bound by the binding agent. The binding agent can be a binding agent identified by the methods above, e.g., an oligonucleotide probe, ligand, antibody, or other useful binding agent that can differentiate between two target populations, e.g., by differentiating between biomarkers thereof.

Figure 4:
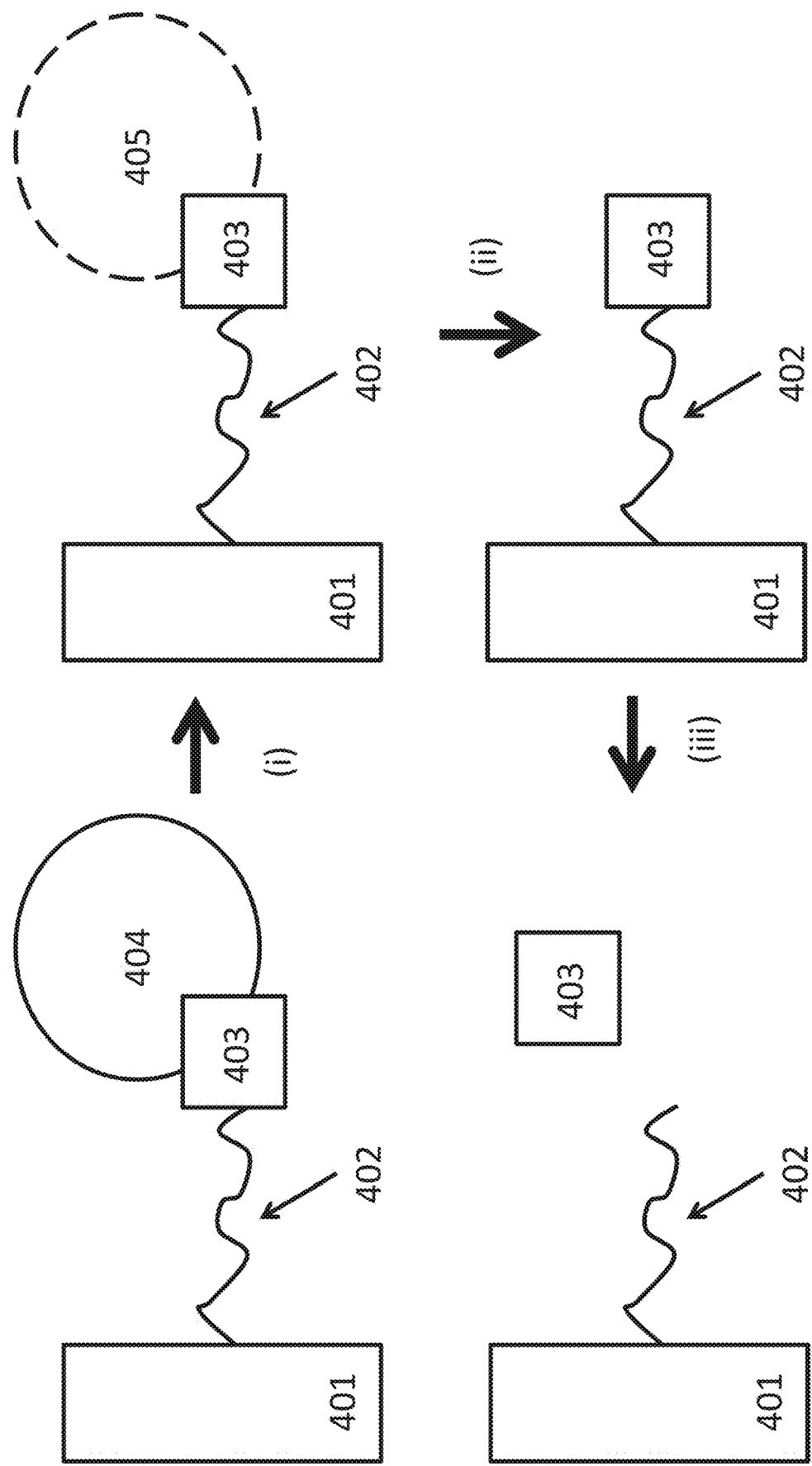
FIG. 4 comprises a schematic for identifying a target of a selected aptamer, such as an aptamer selected by the process of the invention. The figure shows a binding agent 402, here an aptamer for purposes of illustration, tethered to a substrate 401. The binding agent 402 can be covalently attached to substrate 401. The binding agent 402 may also be non-covalently attached. For example, binding agent 402 can comprise a label which can be attracted to the substrate, such as a biotin group which can form a complex with an avidin/streptavidin molecule that is covalently attached to the substrate. The binding agent 402 binds to a surface antigen 403 of microvesicle 404. In the step signified by arrow (i), the microvesicle is disrupted while leaving the complex between the binding agent 402 and surface antigen 403 intact. Disrupted microvesicle 405 is removed, e.g., via washing or buffer exchange, in the step signified by arrow (ii). In the step signified by arrow (iii), the surface antigen 403 is released from the binding agent 402. The surface antigen 403 can be analyzed to determine its identity.

An illustrative schematic for carrying on the method is shown in FIG. 4. The figure shows a binding agent 402, here an oligonucleotide probe or aptamer for purposes of illustration, tethered to a substrate 401. The binding agent 402 can be covalently attached to substrate 401. The binding agent 402 may also be non-covalently attached. For example, binding agent 402 can comprise a label which can be attracted to the substrate, such as a biotin group which can form a complex with an avidin/streptavidin molecule that is covalently attached to the substrate. This can allow a complex to be formed between the aptamer and the microvesicle while in solution, followed by capture of the aptamer using the biotin label. The binding agent 402 binds to a surface antigen 403 of cell or microvesicle 404. In the step signified by arrow (i), the cell or microvesicle 405 is disrupted while leaving the complex between the binding agent 402 and surface antigen 403 intact. Disrupted cell or microvesicle 405 is removed, e.g., via washing or buffer exchange, in the step signified by arrow (ii). In the step signified by arrow (iii), the surface antigen 403 is released from the binding agent 402. The surface antigen 403 can be analyzed to determine its identity using methods disclosed herein and/or known in the art. The target of the method can be any useful biological entity associated with a cell or microvesicle. For example, the target may comprise a protein, nucleic acid, lipid or carbohydrate, or other biological entity disclosed herein or known in the art.

In some embodiments of the method, the target is cross-linked to the binding agent prior disrupting the cell or microvesicle. Without being bound by theory, this step may assist in maintaining the complex between the binding agent and the target during the disruption process. Any useful method of crosslinking disclosed herein or known in the art can be used. In embodiments, the cross-linking comprises photocrosslinking, an imidoester crosslinker, dimethyl suberimidate, an N-Hydroxysuccinimide-ester crosslinker, bis-sulfosuccinimidyl suberate (BS3), an aldehyde, acrolein, crotonaldehyde, formaldehyde, a carbodiimide crosslinker, N,N'-dicyclohexylcarbodiimide (DDC), N,N'-diisopropylcarbodiimide (DIC), 1-Ethyl-3-[3-dimethylaminopropyl] carbodiimide hydrochloride (EDC or EDAC), Succinimidyl-4-(N-maleimidomethyl)cyclohexane-1-carboxylate (SMCC), a Sulfosuccinimidyl-4-(N-maleimidomethyl)cyclohexane-1-carboxylate (Sulfo-SMCC), a Sulfo-N-hydroxysuccinimidyl-2-(6-[biotinamido]-2-(p-azido benzamido)-hexanoamido) ethyl-1,3'-dithioproprionate (Sulfo-SBED), 2-[N2-(4-Azido-2,3,5,6-tetrafluorobenzoyl)-N6-(6-biotin-amidocaproyl)-L-lysinyl]ethyl methanethiosulfonate (Mts-Atf-Biotin; available from Thermo Fisher Scientific Inc, Rockford Ill.), 2-{N2-[N6-(4-Azido-2,3,5,6-tetrafluorobenzoyl-6-amino-caproyl)-N6-(6-biotinamidocaproyl)-L-lysinylamido]}ethyl methanethiosultonate (Mts-Atf-LC-Biotin; available from Thermo Fisher Scientific Inc), a photoreactive amino acid (e.g., L-Photo-Leucine and L-Photo-Methionine, see, e.g., Suchanek, M., et al. (2005). Photo-leucine and photo-methionine allow identification of protein-protein interactions. Nat. Methods 2:261-267), an N-Hydroxysuccinimide (NHS) crosslinker, an NHS-Azide reagent (e.g., NHS-Azide, NHS-PEG4-Azide, NHS-PEG12-Azide; each available from Thermo Fisher Scientific, Inc.), an NHS-Phosphine reagent (e.g., NHS-Phosphine, Sulfo-NHS-Phosphine; each available from Thermo Fisher Scientific, Inc.), or any combination or modification thereof.

A variety of methods can be used to disrupt the cell or microvesicle. For example, the cellular or vesicular membrane can be disrupted using mechanical forces, chemical agents, or a combination thereof. In embodiments, disrupting the cell or microvesicle comprises use of one or more of a detergent, a surfactant, a solvent, an enzyme, or any useful combination thereof. The enzyme may comprise one or more of lysozyme, lysostaphin, zymolase, cellulase, mutanolysin, a glycanase, a protease, and mannase. The detergent or surfactant may comprise one or more of a octylthioglucoside (OTG), octyl beta-glucoside (OG), a nonionic detergent, Triton X, Tween 20, a fatty alcohol, a cetyl alcohol, a stearyl alcohol, cetostearyl alcohol, an oleyl alcohol, a polyoxyethylene glycol alkyl ether (Brij), octaethylene glycol monododecyl ether, pentaethylene glycol monododecyl ether, a polyoxypropylene glycol alkyl ether, a glucoside alkyl ether, decyl glucoside, lauryl glucoside, octyl glucoside, a polyoxyethylene glycol octylphenol ethers, a polyoxyethylene glycol alkylphenol ether, nonoxynol-9, a glycerol alkyl ester, glyceryl laurate, a polyoxyethylene glycol sorbitan alkyl esters, polysorbate, a sorbitan alkyl ester, cocamide MEA, cocamide DEA, dodecyldimethylamine oxide, a block copolymers of polyethylene glycol and polypropylene glycol, poloxamers, polyethoxylated tallow amine (POEA), a zwitterionic detergent, 3-[(3-cholamidopropyl)dimethylammonio]-1-propanesulfonate (CHAPS), a linear alkylbenzene sulfonate (LAS), a alkyl phenol ethoxylate (APE), cocamidopropyl hydroxysultaine, a betaine, cocamidopropyl betaine, lecithin, an ionic detergent, sodium dodecyl sulfate (SDS), cetrimonium bromide (CTAB), cetyl trimethylammonium chloride (CTAC), octenidine dihydrochloride, cetylpyridinium chloride (CPC), benzalkonium chloride (BAC), benzethonium chloride (BZT), 5-Bromo-5-nitro-1,3-dioxane, dimethyldioctadecylammonium chloride, dioctadecyldimethylammonium bromide (DODAB), sodium deoxycholate, nonyl phenoxypolyethoxylethanol (Tergitol-type NP-40; NP-40), ammonium lauryl sulfate, sodium laureth sulfate (sodium lauryl ether sulfate (SLES)), sodium myreth sulfate, an alkyl carboxylate, sodium stearate, sodium lauroyl sarcosinate, a carboxylate-based fluorosurfactant, perfluorononanoate, perfluorooctanoate (PFOA or PFO), and a biosurfactant. Mechanical methods of disruption that can be used comprise without limitation mechanical shear, bead milling, homogenation, microfluidization, sonication, French Press, impingement, a colloid mill, decompression, osmotic shock, thermolysis, freeze-thaw, desiccation, or any combination thereof.

As shown in FIG. 4, the binding agent may be tethered to a substrate. The binding agent can be tethered before or after the complex between the binding agent and target is formed. The substrate can be any useful substrate such as disclosed herein or known in the art. In an embodiment, the substrate comprises a microsphere. In another embodiment, the substrate comprises a planar substrate. In another embodiment, the substrate comprises column material. The binding agent can also be labeled. Isolating the complex between the target and the binding agent may comprise capturing the binding agent via the label. As a non-limiting example, the label can be a biotin label. In such cases, the binding agent can be attached to the substrate via a biotin-avidin/streptavidin binding event.

Methods of identifying the target after release from the binding agent will depend on the type of target of interest. For example, when the target comprises a protein, identifying the target may comprise use of mass spectrometry (MS), peptide mass fingerprinting (PMF; protein fingerprinting), sequencing, N-terminal amino acid analysis, C-terminal amino acid analysis, Edman degradation, chromatography, electrophoresis, two-dimensional gel electrophoresis (2D gel), antibody array, and immunoassay. Nucleic acids can be identified by amplification, hybridization or sequencing.

One of skill will appreciate that the method can be used to identify any appropriate target, including those not associated with a membrane. For example, with respect to the FIG. 4, all steps except for the step signified by arrow (i) (i.e., disrupting the cell or microvesicle 405), could be performed for a tissue lysate or a circulating target such as a protein, nucleic acid, lipid, carbohydrate, or combination thereof. The target can be any useful target, including without limitation a tissue, a cell, an organelle, a protein complex, a lipoprotein, a carbohydrate, a microvesicle, a virus, a membrane fragment, a small molecule, a heavy metal, a toxin, a drug, a nucleic acid, mRNA, microRNA, a protein-nucleic acid complex, and various combinations, fragments and/or complexes of any of these.

In an aspect, the invention provides a method of identifying at least one protein associated with at least one cell or microvesicle in a biological sample, comprising: a) contacting the at least one cell or microvesicle with an oligonucleotide probe library, b) isolating at least one protein bound by at least one member of the oligonucleotide probe library in step a); and c) identifying the at least one protein isolated in step b). The isolating can be performed using any useful method such as disclosed herein, e.g., by immunoprecipition or capture to a substrate. Similarly, the identifying can be performed using any useful method such as disclosed herein, including without limitation use of mass spectrometry, 2-D gel electrophoresis or an antibody array. Examples of such methodology are presented herein in Examples 9-11.

The targets identified by the methods of the invention can be detected, e.g., using the oligonucleotide probes of the invention, for various purposes as desired. For example, an identified surface antigen can be used to detect a cell or microvesicle displaying such antigen. In an aspect, the invention provides a method of detecting at least one cell or microvesicle in a biological sample comprising contacting the biological sample with at least one binding agent to at least one surface antigen and detecting the at least one cell or microvesicle recognized by the binding agent to the at least one protein. In an embodiment, the at least one surface antigen is selected from Tables 3-4 herein. The at least one surface antigen can be selected those disclosed in International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety. The at least one surface antigen can be a protein in any of Tables 10-17 herein. See Example 9. The at least one binding agent may comprise any useful binding agent, including without limitation a nucleic acid, DNA molecule, RNA molecule, antibody, antibody fragment, aptamer, peptoid, zDNA, peptide nucleic acid (PNA), locked nucleic acid (LNA), lectin, peptide, dendrimer, membrane protein labeling agent, chemical compound, or a combination thereof. In some embodiments, the at least one binding agent comprises at least one oligonucleotide, such as an oligonucleotide probe as provided herein. The cell can be part of a tissue.

The at least one binding agent can be used to capture and/or detect the at least one cell or microvesicle, which can be a circulating cell or microvesicle, including without limitation a microvesicle shed into bodily fluids. Methods of detecting soluble biomarkers and circulating cells or microvesicles using binding agents are provided herein. See, e.g., FIGS. 2A-B, which figures describe sandwich assay formats. In some embodiments, the at least one binding agent used to capture the at least one cell or microvesicle is bound to a substrate. Any useful substrate can be used, including without limitation a planar array, a column matrix, or a microbead. See, e.g., FIGS. 2A-B. In some embodiments, the at least one binding agent used to detect the at least one cell or microvesicle is labeled. Various useful labels are provided herein or known in the art, including without limitation a magnetic label, a fluorescent moiety, an enzyme, a chemiluminescent probe, a metal particle, a non-metal colloidal particle, a polymeric dye particle, a pigment molecule, a pigment particle, an electrochemically active species, a semiconductor nanocrystal, a nanoparticle, a quantum dot, a gold particle, a fluorophore, or a radioactive label.

In an embodiment, the detecting is used to characterize a phenotype. The phenotype can be any appropriate phenotype of interest. In some embodiments, the phenotype is a disease or disorder. The characterizing may comprise providing diagnostic, prognostic and/or theranostic information for the disease or disorder. The characterizing may be performed by comparing a presence or level of the at least one cell or microvesicle to a reference. The reference can be selected per the characterizing to be performed. For example, when the phenotype comprises a disease or disorder, the reference may comprise a presence or level of the at least one microvesicle in a sample from an individual or group of individuals without the disease or disorder. The comparing can be determining whether the presence or level of the cell or microvesicle differs from that of the reference. In some embodiments, the detected cell or microvesicle is found at higher levels in a healthy sample as compared to a diseased sample. In another embodiment, the detected cell or microvesicle is found at higher levels in a diseased sample as compared to a healthy sample. When multiplex assays are performed, e.g., using a plurality of binding agents to different biomarkers, some antigens may be observed at a higher level in the biological samples as compared to the reference whereas other antigens may be observed at a lower level in the biological samples as compared to the reference.

The method can be used to detect the at least one cell or microvesicle in any appropriate biological sample. For example, the biological sample may comprise a bodily fluid, tissue sample or cell culture. The bodily fluid or tissue sample can be from a subject having or suspected of having a medical condition, a disease or a disorder. Thus, the method can be used to provide a diagnostic, prognostic, or theranostic read out for the subject. Any appropriate bodily fluid can be used, including without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

The method of the invention can be used to detect or characterize any appropriate disease or disorder of interest, including without limitation Breast Cancer, Alzheimer's disease, bronchial asthma, Transitional cell carcinoma of the bladder, Giant cellular osteoblastoclastoma, Brain Tumor, Colorectal adenocarcinoma, Chronic obstructive pulmonary disease (COPD), Squamous cell carcinoma of the cervix, acute myocardial infarction (AMI)/acute heart failure, Chron's Disease, diabetes mellitus type II, Esophageal carcinoma, Squamous cell carcinoma of the larynx, Acute and chronic leukemia of the bone marrow, Lung carcinoma, Malignant lymphoma, Multiple Sclerosis, Ovarian carcinoma, Parkinson disease, Prostate adenocarcinoma, psoriasis, Rheumatoid Arthritis, Renal cell carcinoma, Squamous cell carcinoma of skin, Adenocarcinoma of the stomach, carcinoma of the thyroid gland, Testicular cancer, ulcerative colitis, or Uterine adenocarcinoma.

In some embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor, basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer, gallbladder cancer, gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer, lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer, papillomatosis; paranasal sinus cancer; parathyroid cancer; pelvic cancer, penile cancer, pharyngeal cancer, pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer, respiratory tract cancer; retinoblastoma; rhabdomyosarcoma; salivary gland cancer; Sezary syndrome; small cell lung cancer; small intestine cancer, soft tissue sarcoma; squamous cell carcinoma; squamous neck cancer, stomach (gastric) cancer; supratentorial primitive neuroectodermal tumors; T-cell lymphoma; testicular cancer; throat cancer, thymic carcinoma; thymoma; thyroid cancer, transitional cell cancer; transitional cell cancer of the renal pelvis and ureter; trophoblastic tumor; ureter cancer; urethral cancer; uterine cancer; uterine sarcoma; vaginal cancer; vulvar cancer, Waldenstrim macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza. One of skill will appreciate that oligonucleotide probes or plurality of oligonucleotides or methods of the invention can be used to assess any number of these or other related diseases and disorders.

In a related aspect, the invention provides a kit comprising a reagent for carrying out the methods herein. In still another related aspect, the invention provides for use of a reagent for carrying out the methods. The reagent may comprise at least one binding agent to the at least one protein. The binding agent may be an oligonucleotide probe as provided herein.

Sample Characerization

The oligonucleotide probe/aptamers of the invention can be used to characterize a biological sample. For example, an oligonucleotide probe or oligonucleotide probe library can be used to provide a biosignature for the sample. The biosignature can indicate a characteristic of the sample, such as a diagnosis, prognosis or theranosis of a disease or disorder associated with the sample. In some embodiments, the biosignature comprises a presence or level of one or more biomarker present in the sample. In some embodiments, biosignature comprises a presence or level of the oligonucleotide probe or members of the oligonucleotide probe library that associated with the sample (e.g., by forming a complex with the sample).

In an aspect, the invention provides an aptamer comprising a nucleic acid sequence that is at least about 50, 55, 60, 65, 70, 75, 80, 85, 90, 95, 96, 97, 98, 99 or 100 percent homologous to any one of SEQ ID NOs. 1-206506; or a functional variation or fragment of any preceding sequence. A functional variation or fragment includes a sequence comprising modifications that is still capable of binding a target molecule, wherein the modifications comprise without limitation at least one of a deletion, insertion, point mutation, truncation or chemical modification. In a related aspect, the invention provides a method of characterizing a disease or disorder, comprising: (a) contacting a biological test sample with one or more aptamer of the invention, e.g., any of those in this paragraph or modifications thereof; (b) detecting a presence or level of a complex between the one or more aptamer and the target bound by the one or more aptamer in the biological test sample formed in step (a); (c) contacting a biological control sample with the one or more aptamer; (d) detecting a presence or level of a complex between the one or more aptamer and the target bound by the one or more aptamer in the biological control sample formed in step (c); and (e) comparing the presence or level detected in steps (b) and (d), thereby characterizing the disease or disorder.

The biological test sample and biological control sample can each comprise a tissue sample, a cell culture, or a biological fluid. In some embodiments, the biological test sample and biological control sample comprise the same sample type, e.g., both the test and control samples are tissue samples or both are fluid samples. In other embodiments, different sample types may be used for the test and control samples. For example, the control sample may comprise an engineered or otherwise artificial sample. In some embodiments, the tissue samples comprise fixed samples.

The biological fluid may comprise a bodily fluid. The bodily fluid may include without limitation one or more of peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some embodiments, the bodily fluid comprises blood, serum or plasma.

The biological fluid may comprise microvesicles. For example, the biological fluid can be a tissue, cell culture, or bodily fluid which comprises microvesicles released from cells in the sample. The microvesicles can be circulating microvesicles. The biological fluid may comprise cells. For example, the biological fluid can be a tissue, cell culture, or bodily fluid which comprises cells circulating in the sample.

The one or more aptamer can bind a target biomarker, e.g., a biomarker useful in characterizing the sample. The biomarker may comprise a polypeptide or fragment thereof, or other useful biomarker described herein or known in the art (lipid, carbohydrate, complex, nucleic acid, etc). In embodiments, the polypeptide or fragment thereof is soluble or membrane bound. Membrane bound polypeptides may comprise a cellular surface antigen or a microvesicle surface antigen. The biomarker can be a biomarker selected from Table 3 or Table 4. The biomarker can be selected from one of International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety.

The characterizing can comprise a diagnosis, prognosis or theranosis of the disease or disorder. Various diseases and disorders can be characterized using the compositions and methods of the invention, including without limitation a cancer, a premalignant condition, an inflammatory disease, an immune disease, an autoimmune disease or disorder, a cardiovascular disease or disorder, a neurological disease or disorder, an infectious disease, and/or pain. See, e.g., section herein "Phenotypes" for further details. In embodiments, the disease or disorder comprises a proliferative or neoplastic disease or disorder. For example, the disease or disorder can be a cancer. In some embodiments, the cancer comprises a breast cancer, ovarian cancer, prostate cancer, lung cancer, colorectal cancer, melanoma, pancreatic cancer, kidney cancer, or brain cancer.

Figure 10A:
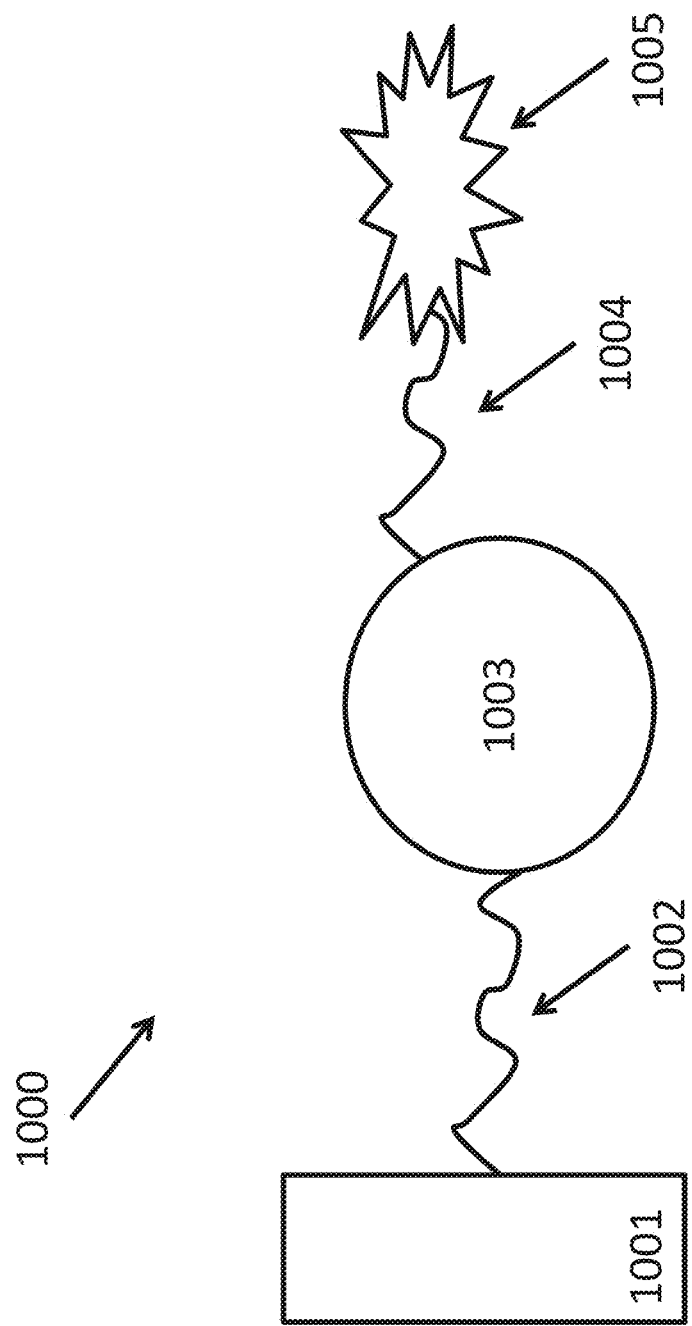
FIGS. 10A-D illustrate use of aptamers in methods of characterizing a phenotype.
Figure 10B:
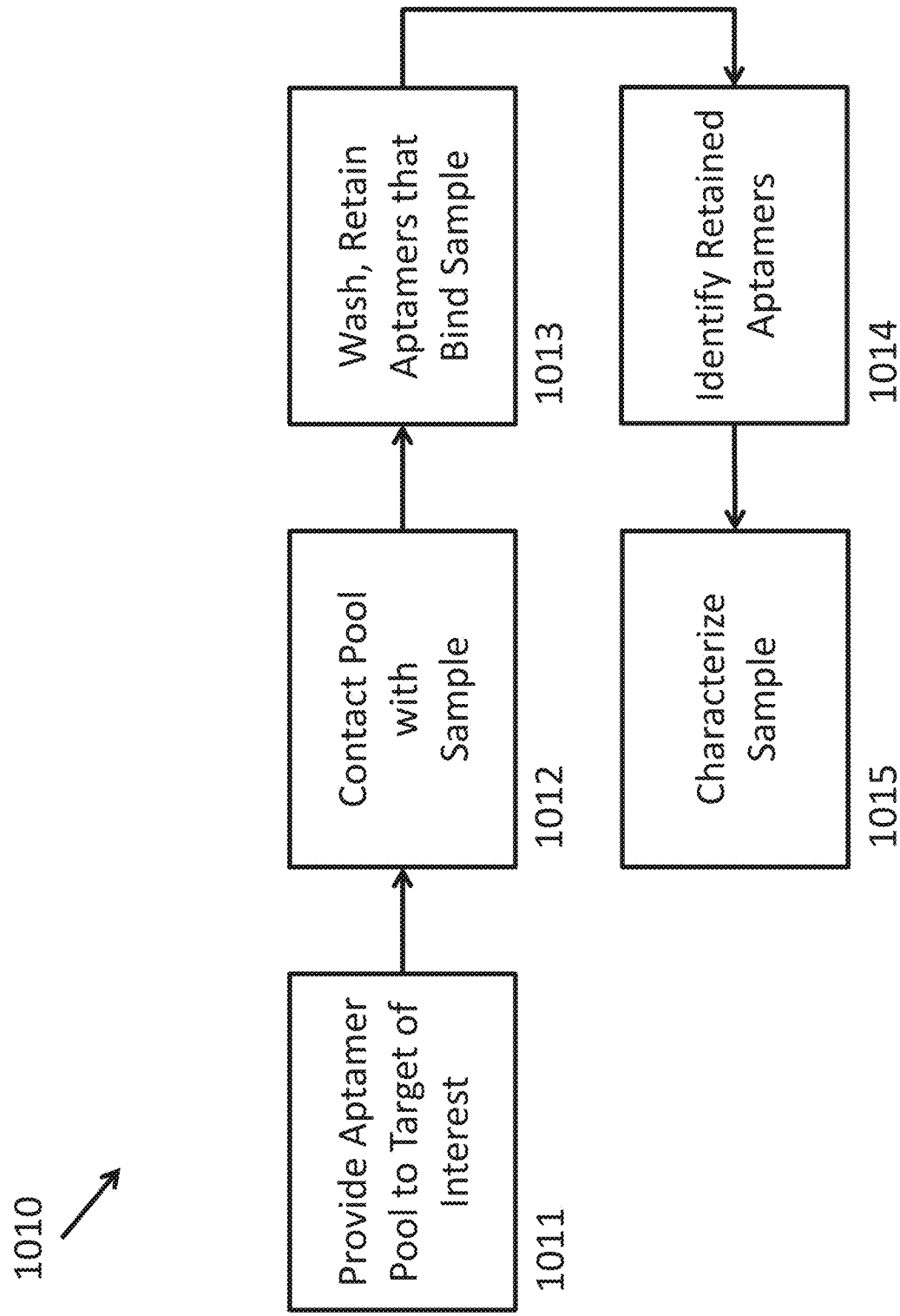
Figure 10C:
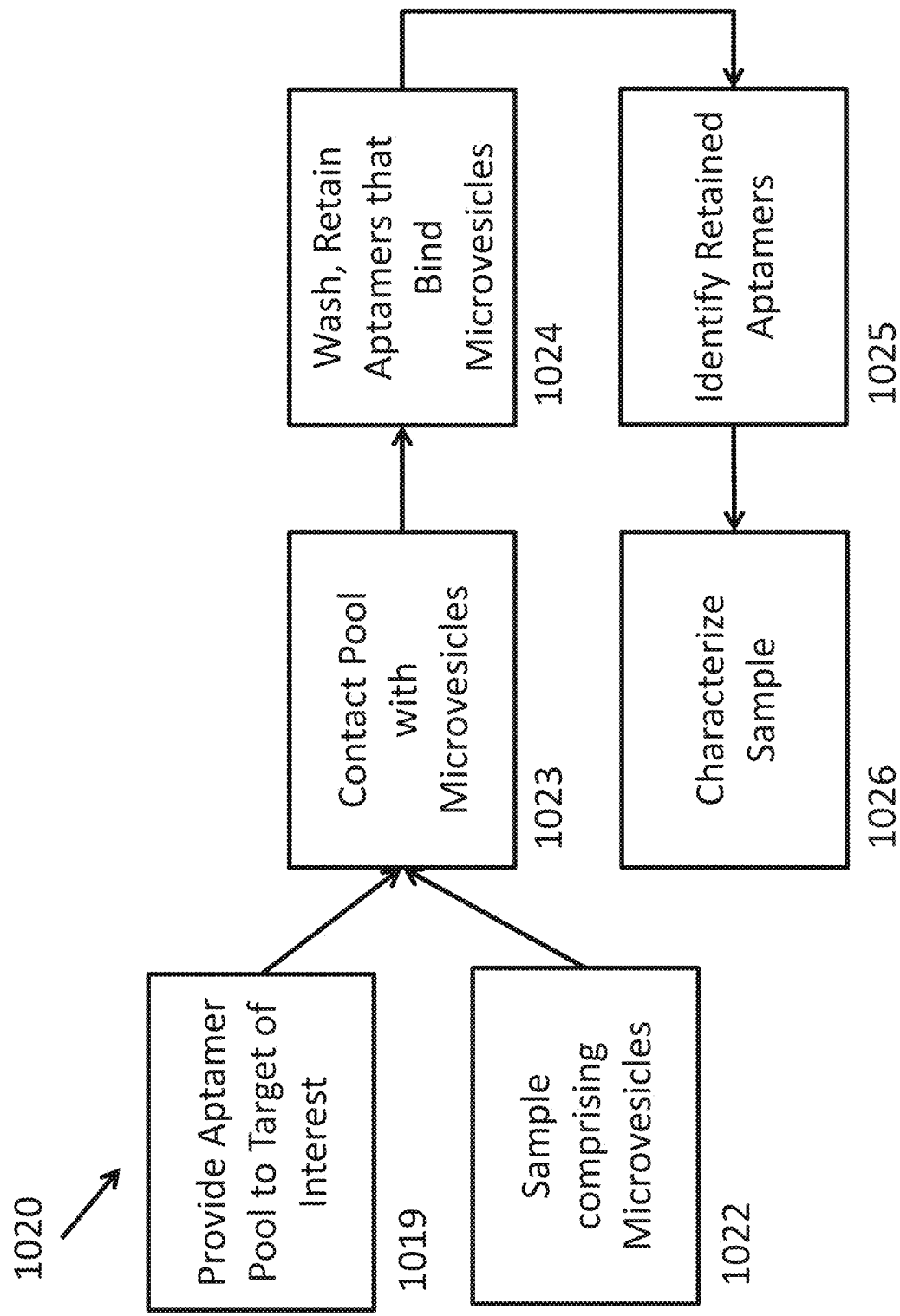

FIG. 10A is a schematic 1000 showing an assay configuration that can be used to detect and/or quantify a target of interest using one or more oligonucleotide probe of the invention. Capture aptamer 1002 is attached to substrate 1001. The substrate can be a planar substrate, well, microbead, or other useful substrate as disclosed herein or known in the art. Target of interest 1003 is bound by capture aptamer 1002. The target of interest can be any appropriate entity that can be detected when recognized by an aptamer or other binding agent. The target of interest may comprise a protein or polypeptide, a nucleic acid, including DNA, RNA, and various subspecies thereof, a lipid, a carbohydrate, a complex, e.g., a complex comprising protein, nucleic acids, lipids and/or carbohydrates. In some embodiments, the target of interest comprises a tissue, cell or microvesicle. The target of interest can be a cellular surface antigen or microvesicle surface antigen. The target of interest may be a biomarker, e.g., as disclosed herein. The target of interest can be isolated from a sample using various techniques as described herein, e.g., chromatography, filtration, centrifugation, flow cytometry, affinity capture (e.g., to a planar surface, column or bead), and/or using microfluidics. Detection aptamer 1004 is also bound to target of interest 1003. Detection aptamer 1004 carries label 1005 which can be detected to identify target captured to substrate 1001 via capture aptamer 1002. The label can be a fluorescent, radiolabel, enzyme, or other detectable label as disclosed herein. Either capture aptamer 1002 or detection aptamer 1004 can be substituted with another binding agent, e.g., an antibody. For example, the target may be captured with an antibody and detected with an aptamer, or vice versa. When the target of interest comprises a complex, the capture and detection agents (aptamer, antibody, etc) can recognize the same or different targets. For example, when the target is a cell or microvesicle, the capture agent may recognize one surface antigen while the detection agent recognizes microvesicle surface antigen. Alternately, the capture and detection agents can recognize the same surface antigen.

The aptamers of the invention may be identified and/or used for various purposes in the form of DNA or RNA. Unless otherwise specified, one of skill in the art will appreciate that an aptamer may generally be synthesized in various forms of nucleic acid. The aptamers may also carry various chemical modifications and remain within the scope of the invention.

In some embodiments, an aptamer of the invention is modified to comprise at least one chemical modification. The modification may include without limitation a chemical substitution at a sugar position; a chemical substitution at a phosphate position; and a chemical substitution at a base position of the nucleic acid. In some embodiments, the modification is selected from the group consisting of: biotinylation, incorporation of a fluorescent label, incorporation of a modified nucleotide, a 2'-modified pyrimidine, 3' capping, conjugation to an amine linker, conjugation to a high molecular weight, non-immunogenic compound, conjugation to a lipophilic compound, conjugation to a drug, conjugation to a cytotoxic moiety, and labeling with a radioisotope, or other modification as disclosed herein. The position of the modification can be varied as desired. For example, the biotinylation, fluorescent label, or cytotoxic moiety can be conjugated to the 5' end of the aptamer. The biotinylation, fluorescent label, or cytotoxic moiety can also be conjugated to the 3' end of the aptamer.

In some embodiments, the cytotoxic moiety is encapsulated in a nanoparticle. The nanoparticle can be selected from the group consisting of: liposomes, dendrimers, and comb polymers. In other embodiments, the cytotoxic moiety comprises a small molecule cytotoxic moiety. The small molecule cytotoxic moiety can include without limtation vinblastine hydrazide, calicheamicin, *vinca* alkaloid, a cryptophycin, a tubulysin, dolastatin-10, dolastatin-15, auristatin E, rhizoxin, epothilone B, epithilone D, taxoids, maytansinoids and any variants and derivatives thereof. In still other embodiments, the cytotoxic moiety comprises a protein toxin. For example, the protein toxin can be selected from the group consisting of diphtheria toxin, ricin, abrin, gelonin, and *Pseudomonas* exotoxin A. Non-immunogenic, high molecular weight compounds for use with the invention include polyalkylene glycols, e.g., polyethylene glycol. Appropriate radioisotopes include yttrium-90, indium-111, iodine-131, lutetium-177, copper-67, rhenium-186, rhenium-188, bismuth-212, bismuth-213, astatine-211, and actinium-225. The aptamer may be labeled with a gamma-emitting radioisotope.

In some embodiments of the invention, an active agent is conjugated to the aptamer. For example, the active agent may be a therapeutic agent or a diagnostic agent. The therapeutic agent may be selected from the group consisting of tyrosine kinase inhibitors, kinase inhibitors, biologically active agents, biological molecules, radionuclides, adriamycin, ansamycin antibiotics, asparaginase, bleomycin, busulphan, cisplatin, carboplatin, carmustine, capecotabine, chlorambucil, cytarabine, cyclophosphamide, camptothecin, dacarbazine, dactinomycin, daunorubicin, dexrazoxane, docetaxel, doxorubicin, etoposide, epothilones, floxuridine, fludarabine, fluorouracil, gemcitabine, hydroxyurea, idarubicin, ifosfamide, irinotecan, lomustine, mechlorethamine, mercaptopurine, melphalan, methotrexate, rapamycin (sirolimus), mitomycin, mitotane, mitoxantrone, nitrosurea, paclitaxel, pamidronate, pentostatin, plicamycin, procarbazine, rituximab, streptozocin, teniposide, thioguanine, thiotepa, taxanes, vinblastine, vincristine, vinorelbine, taxol, combretastatins, discodermolides, transplatinum, anti-vascular endothelial growth factor compounds ("anti-VEGFs"), anti-epidermal growth factor receptor compounds ("anti-EGFRs"), 5-fluorouracil and derivatives, radionuclides, polypeptide toxins, apoptosis inducers, therapy sensitizers, enzyme or active fragment thereof, and combinations thereof.

Oligonucleotide Pools to Characterize a Sample

Figure 11A:
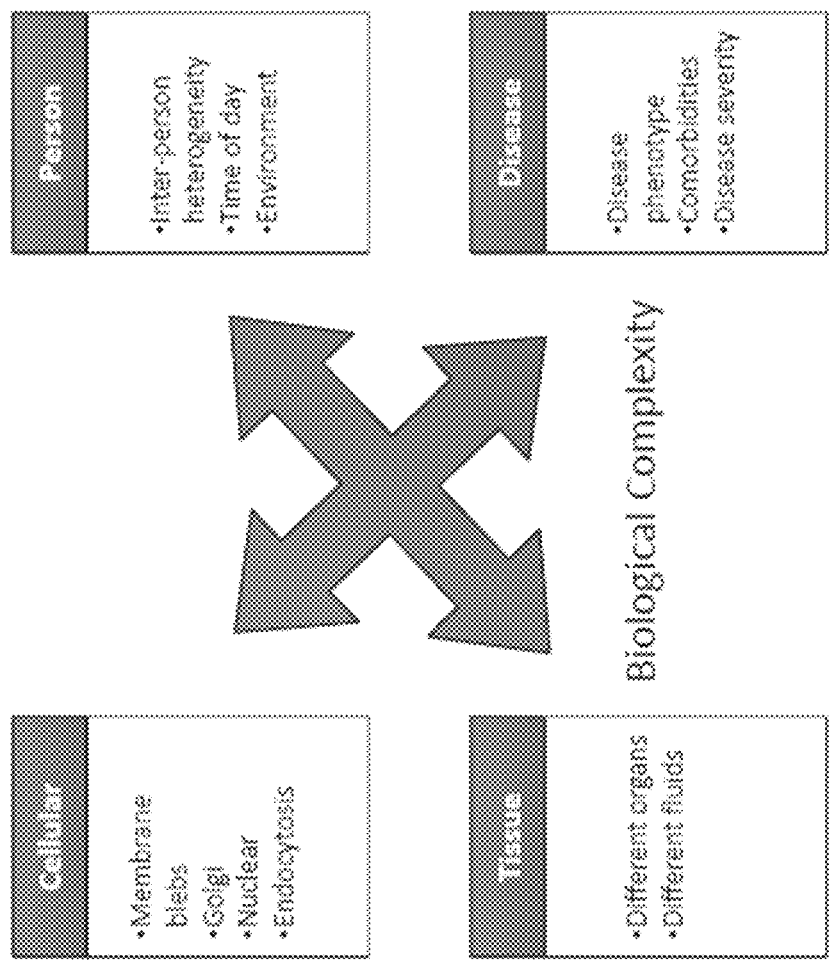
FIGS. 11A-I illustrate development and use of an oligonucleotide probe library to distinguish biological sample types.
Figure 11B:
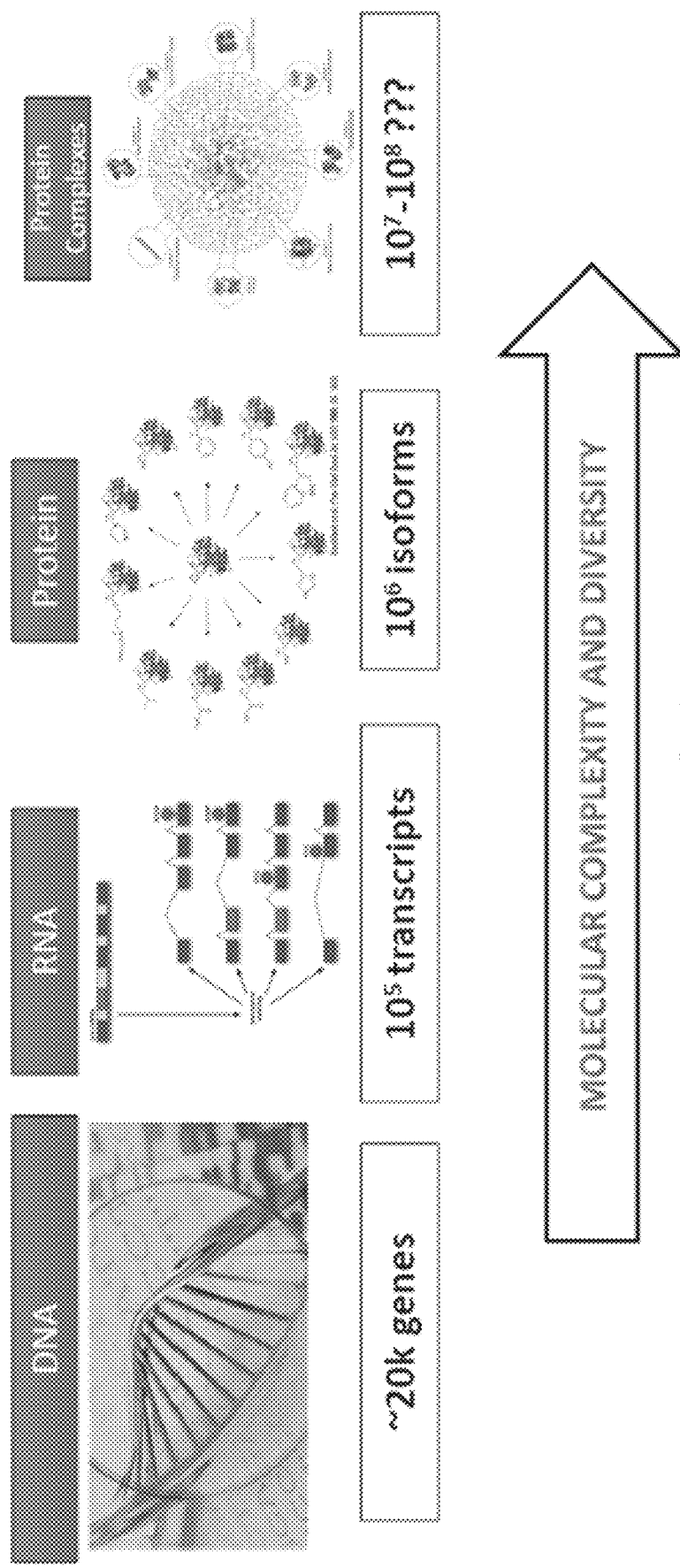

The complexity and heterogeneity present in biology challenges the understanding of biological systems and disease. Diversity exists at various levels, e.g., within and between cells, tissues, individuals and disease states. See, e.g., FIG. 11A. FIG. 11B overviews various biological entities that can be assessed to characterize such samples. As shown in FIG. 11B, as one moves from assessing DNA, to RNA, to protein, and finally to protein complexes, the amount of diversity and complexity increases dramatically. The oligonucleotide probe library method of the invention can be used characterize complex biological sources, e.g., tissue samples, cells, circulating tumor cells, microvesicles, and complexes such as protein and proteolipid complexes.

Figure 11C:
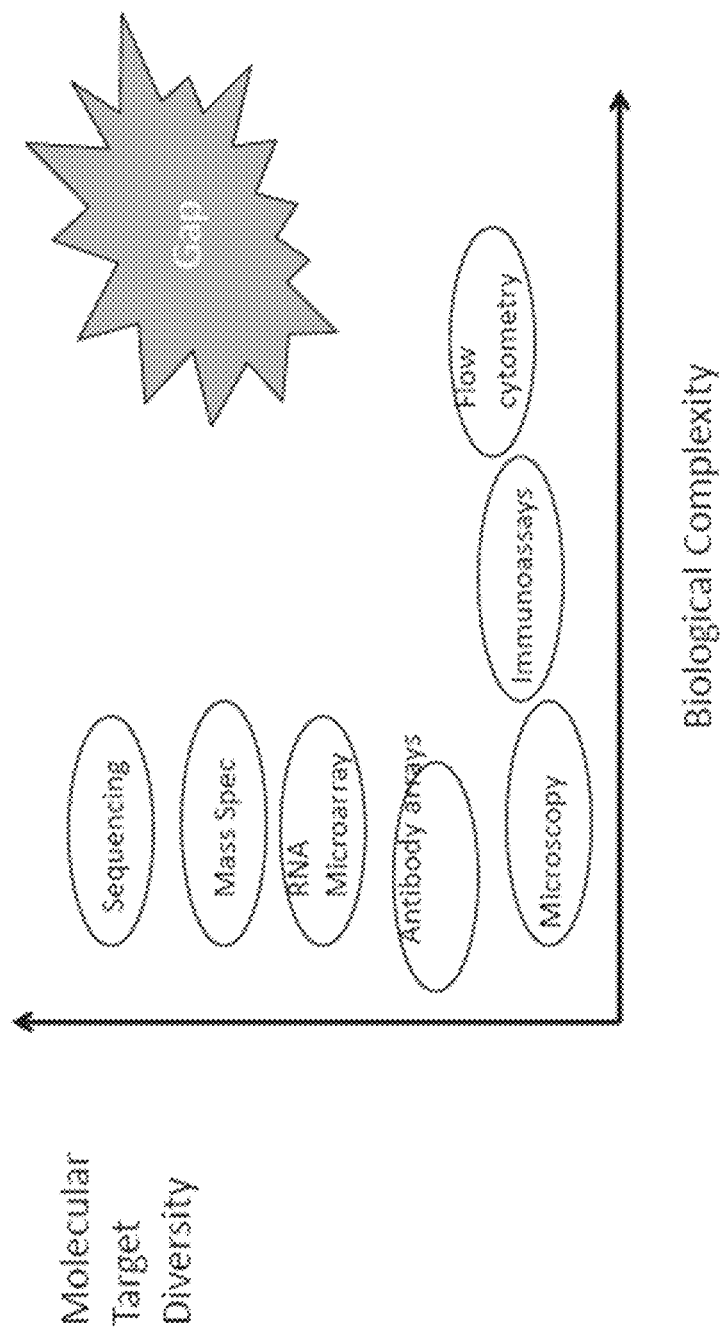

Current methods to characterize biological samples may not adequately address such complexity and diversity. As shown in FIG. 11C, such current methods often have a trade off between measuring diversity and complexity. As an example, consider high throughput sequencing technology. Next generation approaches may query many 1000s of molecular targets in a single assay. However, such approaches only probe individual DNA and/or RNA molecules, and thus miss out on the great diversity of proteins and biological complexes. On the other hand, flow cytometry can probe biological complexes, but are limited to a small number of pre-defined ligands. For example, a single assay can probe a handful of differentially labeled antibodies to pre-defined targets.

The oligonucleotide probe libraries of the invention address the above challenges. The size of the starting library can be adjusted to measure as many different entities as there are library members. For example, the initial untrained oligonucleotide library has the potential to measure $10^{12}$ or more biological features. A larger and/or different library can be constructed as desired. The technology is adapted to find differences between samples without assumptions about what "should be different." For example, the probe library may distinguish based on individual proteins, protein modifications, protein complexes, lipids, nucleic acids, different folds or conformations, or whatever is there that distinguishes a sample of interest. Thus, the method provides an unbiased approach to identify differences in biological samples that can be used to identify different populations of interest.

In the context herein, the use of the oligonucleotide library probe to assess a sample may be referred to as Adaptive Dynamic Artificial Poly-ligand Targeting, or ADAPF™ (alternately referred to as Topological Oligonucleotide Profiling: TOP™). Although as noted the terms aptamer and oligonucleotides are typically used interchangeably herein, some differences between "classic" individual aptamers and ADAPT probes are as follows. Individual aptamers may comprise individual oligonucleotides selected to bind to a known specific target in an antibody-like "key-in-lock" binding mode. They may be evaluated individually based on specificity and binding affinity to the intended target. However, ADAPT probes may comprise a library of oligonucleotides intended to produce multi-probe signatures. The ADAPT probes comprise numerous potential binding modalities (electrostatic, hydrophobic, Watson-Crick, multi-oligo complexes, etc.). The ADAPT probe signatures have the potential to identify heterogeneous patient subpopulations. For example, a single ADAPT library can be assembled to differentiate multiple biological states. Unlike classic single aptamers, the binding targets may or may not be isolated or identified. It will be understood that screening methods that identify individual aptamers, e.g., SELEX, can also be used to enrich a naive library of oligonucleotides to identify a ADAPT probe library.

Figure 11D:
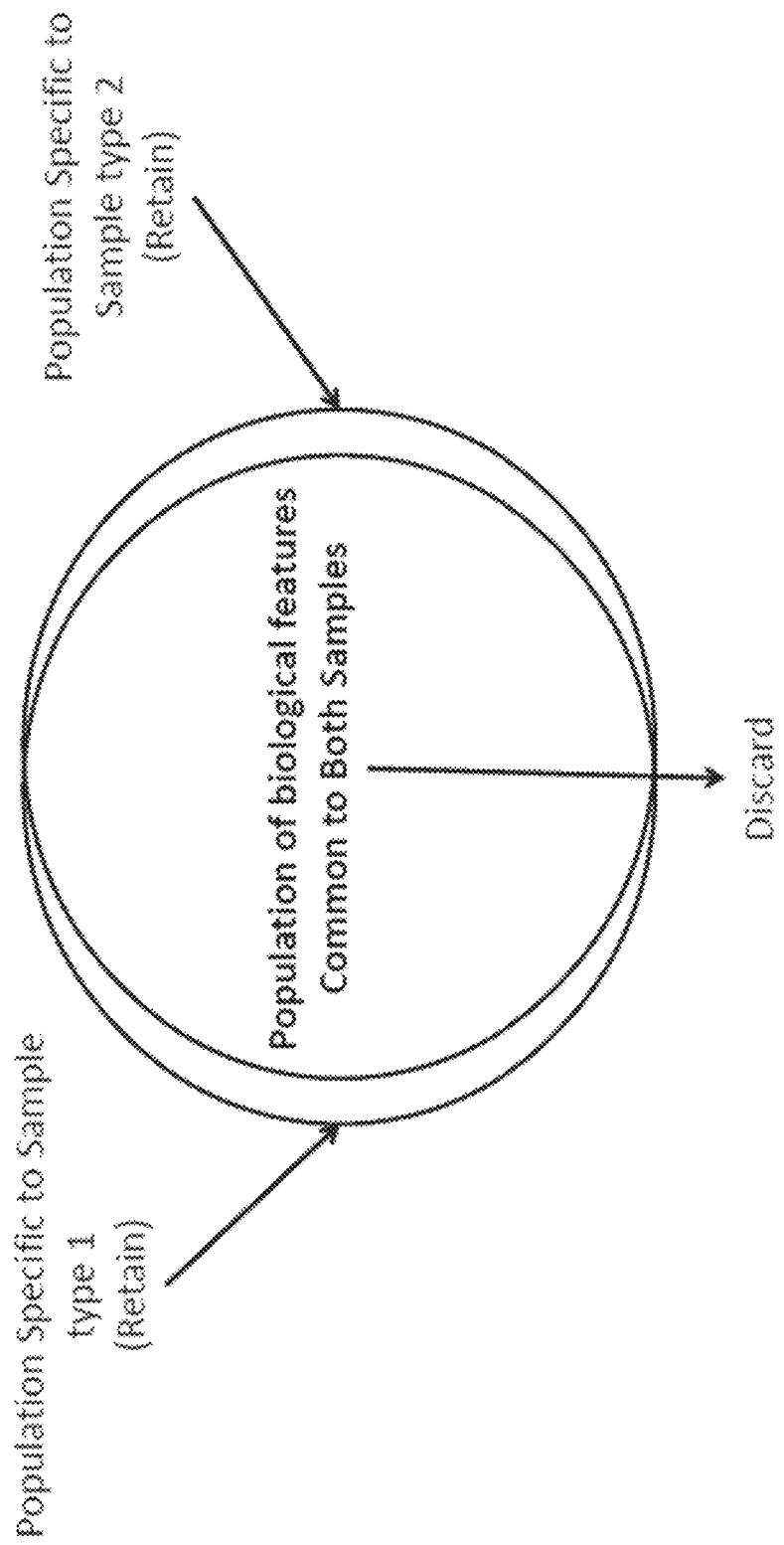

The general method of the invention is outlined in FIG. 11D. One input to the method comprises a randomized oligonucleotide library with the potential to measure $10^{12}$ or more biological features. As outlined in the figure, the method identifies a desired number (e.g., ~$10^5$-$10^6$) that are different between two input sample types. The randomized oligonucleotide library is contacted with a first and a second sample type, and oligonucleotides that bind to each sample are identified. The bound oligonucleotide populations are compared and oligonucleotides that specifically bind to one or the other biological input sample are retained for the oligonucleotide probe library, whereas oligonucleotides that bind both biological input samples are discarded. This trained oligonucleotide probe library can then be contacted with a new test sample and the identities of oligonucleotides that bind the test sample are determined. The test sample is characterized based on the profile of oligonucleotides that bound. See, e.g., FIG. 11H.

Figure 11E:
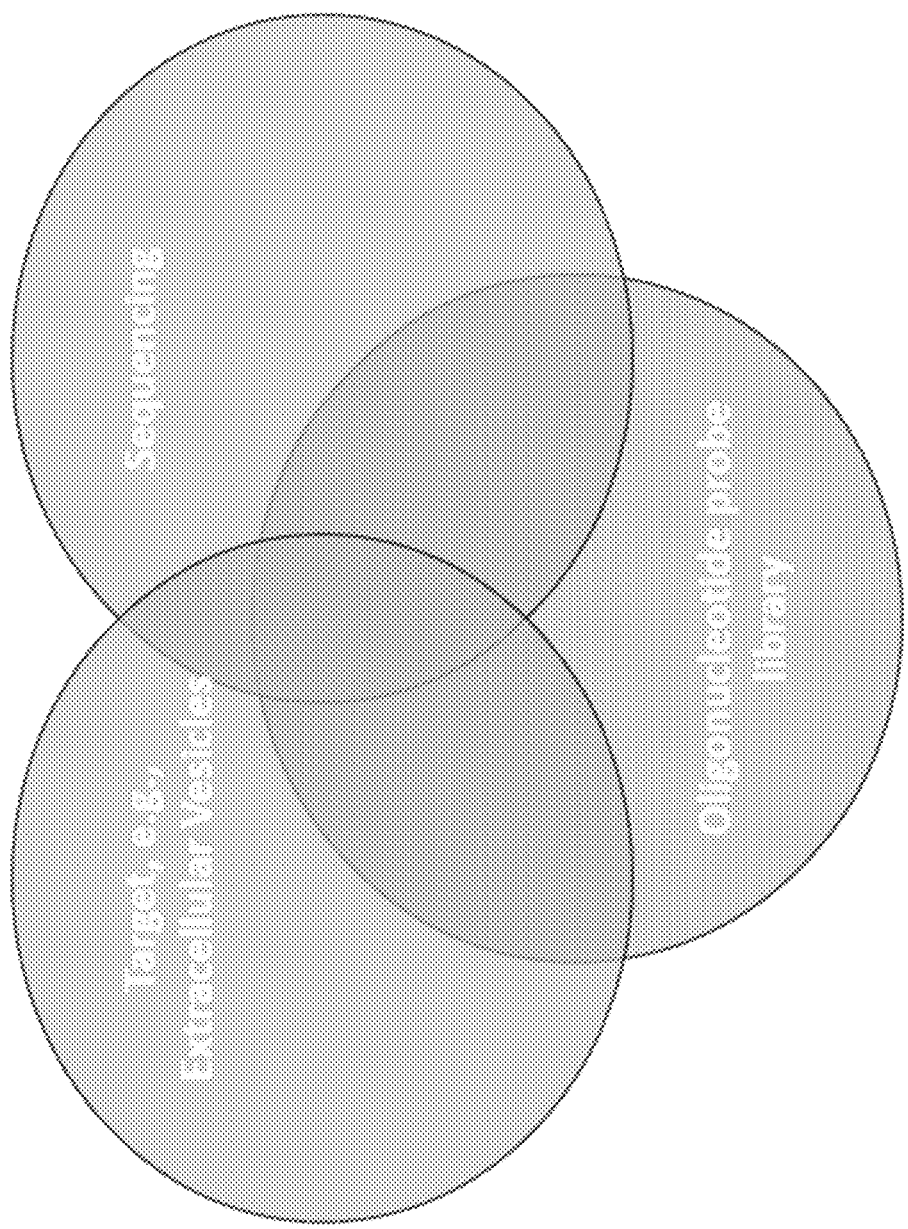

Extracellular vesicles provide an attractive vehicle to profile the biological complexity and diversity driven by many inter-related sources. There can be a great deal of heterogeneity between patient-to-patient microvesicle populations, or even in microvesicle populations from a single patient under different conditions (e.g., stress, diet, exercise, rest, disease, etc). Diversity of molecular phenotypes within microvesicle populations in various disease states, even after microvesicle isolation and sorting by vesicle biomarkers, can present challenges identifying surface binding ligands. This situation is further complicated by vesicle surface-membrane protein complexes. The oligonucleotide probe library can be used to address such challenges and allow for characterization of biological phenotypes. The approach combines the power of diverse oligonucleotide libraries and high throughput (next-generation) sequencing technologies to probe the complexity of extracellular microvesicles. See FIG. 11E.

Figure 11F:
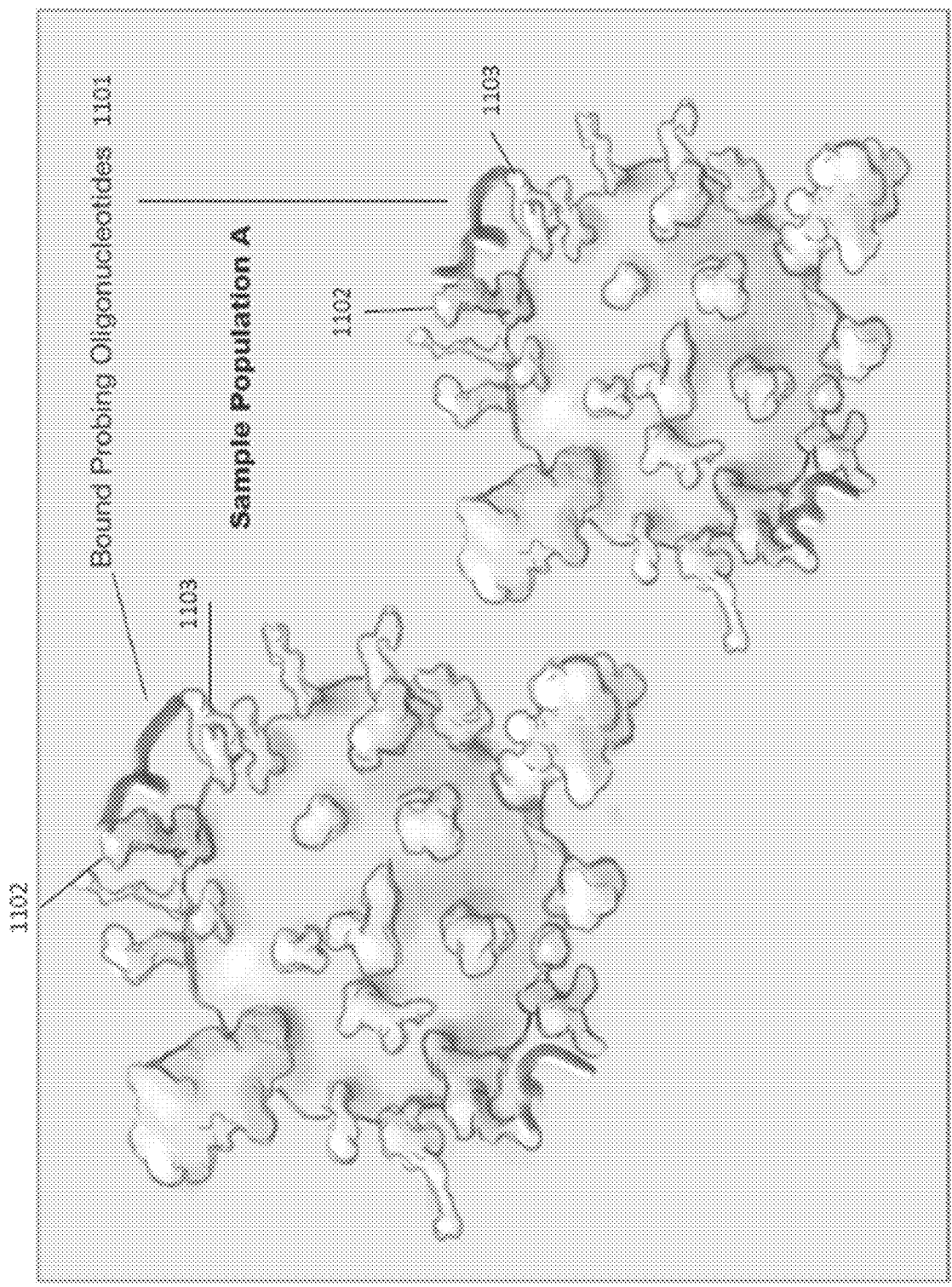
Figure 11G:
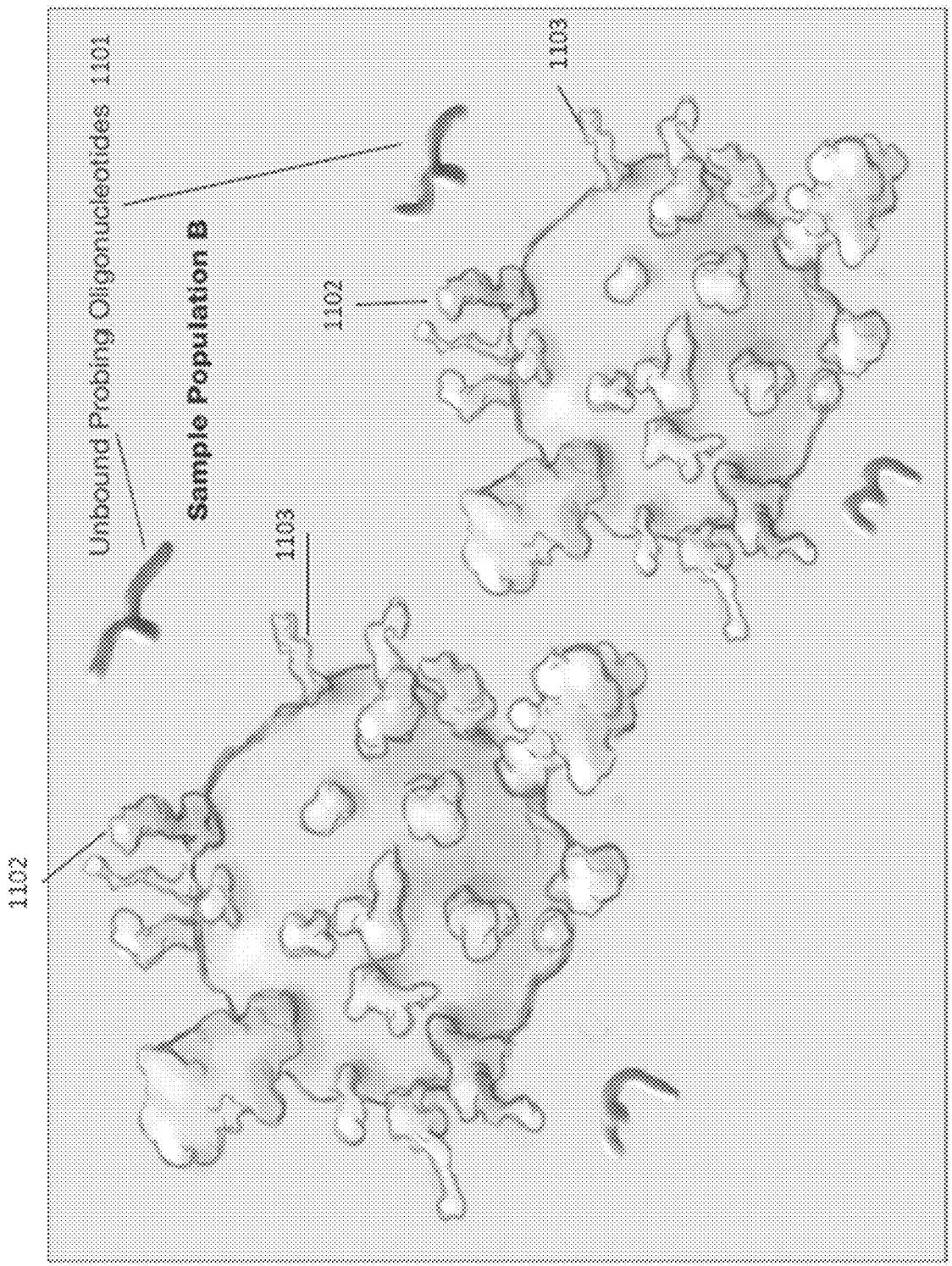

ADAPT™ profiling may provide quantitative measurements of dynamic events in addition to detection of presence/absence of various biomarkers in a sample. For example, the binding probes may detect protein complexes or other post-translation modifications, allowing for differentiation of samples with the same proteins but in different biological configurations. Such configurations are illustrated in FIGS. 11F-G. In FIG. 11F, microvesicles with various surface markers are shown from an example microvesicle sample population: Sample Population A. The indicated Bound Probing Oligonucleotides 1101 are contacted to two surface markers 1102 and 1103 in a given special relationship. Here, probes unique to these functional complexes and spatial relationships may be retained. In contrast, in microvesicle Sample Population B shown in FIG. 11F, the two surface markers 1102 and 1103 are found in disparate spacial relationship. Here, probes 1101 are not bound due to absence of the spatial relationship of the interacting components 1102 and 1103.

Figure 11H:
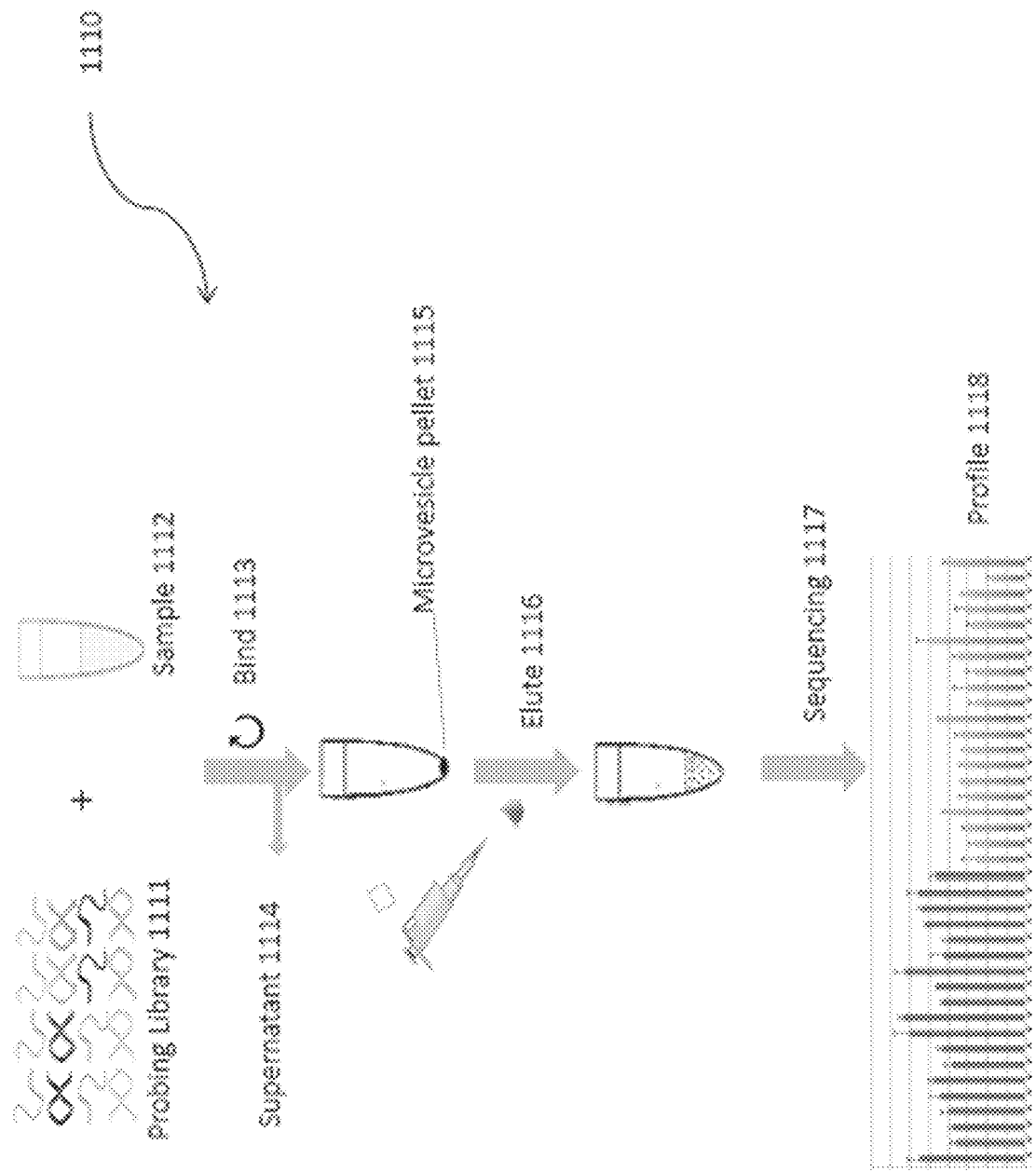
Figure 11I:
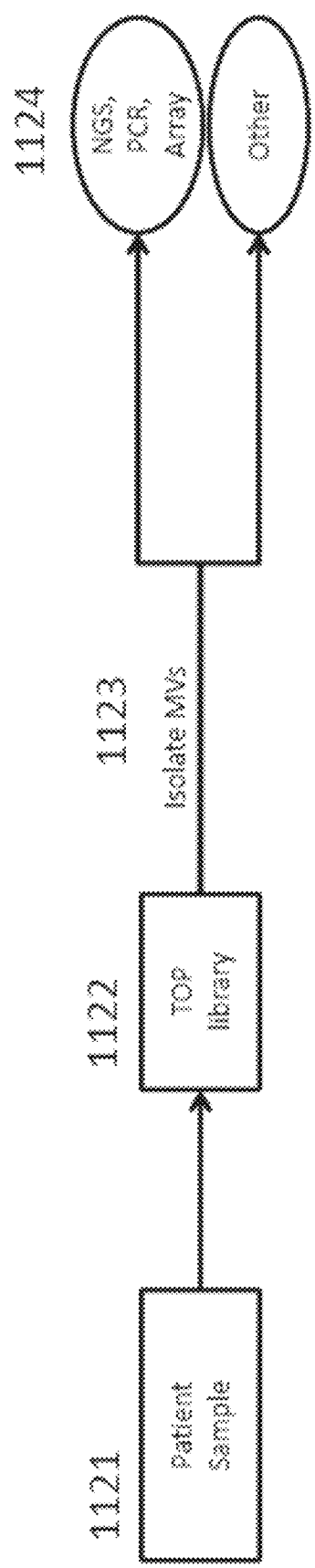

An illustrative approach 1110 for using ADAPT profiling to assess a sample is shown in FIG. 11H. The probing library 1111 is mixed with sample 1112. The sample can be as described herein, e.g., a bodily fluid from a subject having or suspected of having a disease. The probes are allowed to bind the sample 1120 and the microvesicles are pelleted 1115. The supernatant 1114 comprising unbound oligonucleotides is discarded. Oligonucleotide probes bound to the pellet 1115 are eluted 1116 and sequenced 1117. The profile 1118 generated by the bound oligonucleotide probes as determined by the sequencing 1117 is used to characterize the sample 1112. For example, the profile 1118 can be compared to a reference, e.g., to determine if the profile is similar or different from a reference profile indicative of a disease or healthy state, or other phenotypic characterization of interest. The comparison may indicate the presence of a disease, provide a diagnosis, prognosis or theranosis, or otherwise characterize a phenotype associated with the sample 1112. FIG. 11I illustrates another schematic for using ADAPT profiling to characterize a phenotype. A patient sample such as a bodily fluid disclosed herein is collected 1121. The sample is contacted with the ADAPT library pool 1122. Microvesicles (MVs) are isolated from the contacted sample 1123, e.g., using ultracentrifugation, filtration, polymer precipitation or other appropriate technique or combination of techniques disclosed herein. Oligonucleotides that bound the isolated microvesicles are collected and identity is determined 1124. The identity of the bound oligonucleotides can be determined by any useful technique such as sequencing, high throughput sequencing (e.g., NGS), amplification including without limitation qPCR, or hybridization such as to a planar or particle based array. The identity of the bound oligonucleotides is used to characterize the sample, e.g., as containing disease related microvesicles.

The approaches outlined in FIG. 11 can be adapted to any desired sample type, e.g., tissues, cells, microvesicles, circulating biomarkers, and constituents of any of these.

In an aspect, the invention provides a method of characterizing a sample by contacting the sample with a pool of different oligonucleotides (which can be referred to as an aptamer pool or oligonucleotide probe library), and determining the frequency at which various oligonucleotides in the pool bind the sample. For example, a pool of oligonucleotides is identified that preferentially bind to tissues, cells or microvesicles from cancer patients as compared to non-cancer patients. A test sample, e.g., from a patient suspected of having the cancer, is collected and contacted with the pool of oligonucleotides. Oligonucleotides that bind the test sample are eluted from the test sample, collected and identified, and the composition of the bound oligonucleotides is compared to those known to bind cancer samples. Various sequencing, amplification and hybridization techinques can be used to identify the eluted oligonucleotides. For example, when a large pool of oligonucleotides is used, oligonucleotide identification can be performed by high throughput methods such as next generation sequencing or via hybridization. If the test sample is bound by the oligonucleotide pool in a similar manner (e.g., as determined by bioinformatics classification methods) to the sample from cancer patients, then the test sample is indicative of cancer as well. Using this method, a pool of oligonucleotides that bind one or more antigen can be used to characterize the sample without necessarily knowing the precise target of each member of the pool of oligonucleotides. Thus, the pool of oligonucleotides provide a biosignature. Examples 5-7 and 9-31 and others herein illustrate embodiments of the invention.

In an aspect, the invention provides a method for characterizing a condition for a test sample comprising: contacting a sample with a plurality of oligonucleotide capable of binding one or more target(s) present in the sample, identifying a set of oligonucleotides that form a complex with the sample wherein the set is predetermined to characterize a condition for the sample, thereby characterizing a condition for a sample. The sample can be any useful sample such as disclosed herein, e.g., a tissue, cell, microvesicle, or biomarker sample, or any useful combination thereof.

In an related aspect, the invention provides a method for identifying a set of oligonucleotides associated with a test sample, comprising: (a) contacting a sample with a plurality of oligonucleotides, isolating a set of oligonucleotides that form a complex with the sample, (b) determining sequence and/or copy number for each of the oligonucleotides, thereby identifying a set of oligonucleotides associated with the test sample. The sample can be any useful sample such as disclosed herein, e.g., a tissue, cell, microvesicle, or biomarker sample, or any useful combination thereof.

In still another related aspect, the invention provides a method of diagnosing a sample as cancerous or predisposed to be cancerous, comprising contacting the sample with a plurality of oligonucleotides that are predetermined to preferentially form a complex with a cancer sample as compared to a non-cancer sample. The sample can be any useful sample such as disclosed herein, e.g., a tissue, cell, microvesicle, or biomarker sample, or any useful combination thereof.

The oligonucleotides can be identified by sequencing, e.g., by dye termination (Sanger) sequencing or high throughput methods. High throughput methods can comprise techiques to rapidly sequence a large number of nucleic acids, including next generation techniques such as Massively parallel signature sequencing (MPSS; Polony sequencing; 454 pyrosequencing; Illumina (Solexa; MiSeq/HiSeq/NextSeq/etc) sequencing; SOLiD sequencing; Ion Torrent semiconductor sequencing; DNA nanoball sequencing; Heliscope single molecule sequencing; Single molecule real time (SMRT) sequencing, or other methods such as Nanopore DNA sequencing; Tunnelling currents DNA sequencing; Sequencing by hybridization; Sequencing with mass spectrometry; Microfluidic Sanger sequencing; Microscopy-based techniques; RNAP sequencing; In vitro virus high-throughput sequencing. The oligonucleotides may also be identified by hybridization techniques. For example, a microarray having addressable locals to hybridize and thereby detect the various members of the pool can be used. Alternately, detection can be based on one or more differentially labelled oligonucleotides that hybridize with various members of the oligonucleotide pool. The detectable signal of the label can be associated with a nucleic acid molecule that hybridizes with a stretch of nucleic acids present in various oligonucleotides. The stretch can be the same or different as to one or more oligonucleotides in a library. The detectable signal can comprise fluorescence agents, including color-coded barcodes which are known, such as in U.S. Patent Application Pub. No. 20140371088, 2013017837, and 20120258870. Other detectable labels (metals, radioisotopes, etc) can be used as desired.

The plurality or pool of oligonucleotides can comprise any desired number of oligonucleotides to allow characterization of the sample. In various embodiments, the pool comprises at least 2, 3, 4, 5, 6, 7, 8, 9, 10, 11, 12, 13, 14, 15, 16, 17, 18, 19, 20, 25, 30, 40, 50, 60, 70, 80, 90, 100, 150, 200, 250, 300, 350, 400, 450, 500, 600, 700, 800, 900, 1000, 2000, 3000, 4000, 5000, 6000, 7000, 8000, 9000, or at least 10000 different oligonucleotide members.

The plurality of oligonucleotides can be pre-selected through one or more steps of positive or negative selection, wherein positive selection comprises selection of oligonucleotides against a sample having substantially similar characteristics compared to the test sample, and wherein negative selection comprises selection of oligonucleotides against a sample having substantially different characteristics compared to the test sample. Substantially similar characteristics mean that the samples used for positive selection are representative of the test sample in one or more characteristic of interest. For example, the samples used for positive selection can be from cancer patients or cell lines and the test sample can be a sample from a patient having or suspected to have a cancer. Substantially different characteristics mean that the samples used for negative selection differ from the test sample in one or more phenotype/ characteristic of interest. For example, the samples used for negative selection can be from individuals or cell lines that do not have cancer (e.g., "normal," "healthy" or otherwise "control" samples) and the test sample can be a sample from a patient having or suspected to have a cancer. The cancer can be a breast cancer, ovarian cancer, prostate cancer, lung cancer, colorectal cancer, melanoma, brain cancer, pancreatic cancer, kidney cancer, or other cancer such as disclosed herein.

By selecting samples representative of the desired phenotypes to detect and/or distinguish, the characterizing can comprise a diagnosis, prognosis or theranosis for any number of diseases or disorders. Various diseases and disorders can be characterized using the compositions and methods of the invention, including without limitation a cancer, a premalignant condition, an inflammatory disease, an immune disease, an autoimmune disease or disorder, a cardiovascular disease or disorder, a neurological disease or disorder, an infectious disease, and/or pain. See, e.g., section herein "Phenotypes" for further details. In embodiments, the disease or disorder comprises a proliferative or neoplastic disease or disorder. For example, the disease or disorder can be a cancer.

FIG. 10B is a schematic 1010 showing use of an oligonucleotide pool to characterize a phenotype of a sample, such as those listed above. A pool of oligonucleotides to a target of interst is provided 1011. For example, the pool of oligonucleotides can be enriched to target a tissue, cell, microvesicle biomarker, or any combination thereof. The members of the pool may bind different targets (e.g., different proteins) or different epitopes of the same target (e.g., different epitopes of a single protein). The pool is contacted with a test sample to be characterized 1012. For example, the test sample may be a biological sample from an individual having or suspected of having a given disease or disorder. The mixture is washed to remove unbound oligonucleotides. The remaining oligonucleotides are eluted or otherwise disassociated from the sample and collected 1013. The collected oligonucleotides are identified, e.g., by sequencing or hybridization 1014. The presence and/or copy number of the identified is used to characterize the phenotype 1015.

FIG. 10C is a schematic 1020 showing an implementation of the method in FIG. 10B. A pool of oligonucleotides identified as binding a microvesicle population is provided 1019. The input sample comprises a test sample comprising microvesicles 1022. For example, the test sample may be a biological sample from an individual having or suspected of having a given disease or disorder. The pool is contacted with the isolated microvesicles to be characterized 1023. The microvesicle population can be isolated before or after the contacting 1023 from the sample using various techniques as described herein, e.g., chromatography, filtration, ultrafiltration, centrifugation, ultracentrifugation, flow cytometry, affinity capture (e.g., to a planar surface, column or bead), polymer precipitation, and/or using microfluidics. The mixture is washed to remove unbound oligonucleotides and the remaining oligonucleotides are eluted or otherwise disassociated from the sample and collected 1024. The collected oligonucleotides are identified 1025 and the presence and/or copy number of the retained oligonucleotides is used to characterize the phenotype 1026 as above.

As noted, in embodiment of FIG. 10C, the pool of oligonucleotides 1019 is directly contacted with a biological sample that comprises or is expected to comprise microvesicles. Microvesicles are thereafter isolated from the sample and the mixture is washed to remove unbound oligonucleotides and the remaining oligonucleotides are disassociated and collected 1024. The following steps are performed as above. As an example of this alternate configuration, a biological sample, e.g., a blood, serum or plasma sample, is directly contacted with the pool of oligonucleotides. Microvesicles are then isolated by various techniques disclosed herein, including without limitation ultracentrifugation, ultrafiltration, flow cytometry, affinity isolation, polymer precipitation, chromatography, various combinations thereof, or the like. Remaining oligonucleotides are then identified, e.g., by sequencing, hybridization or amplification.

Figure 10D:
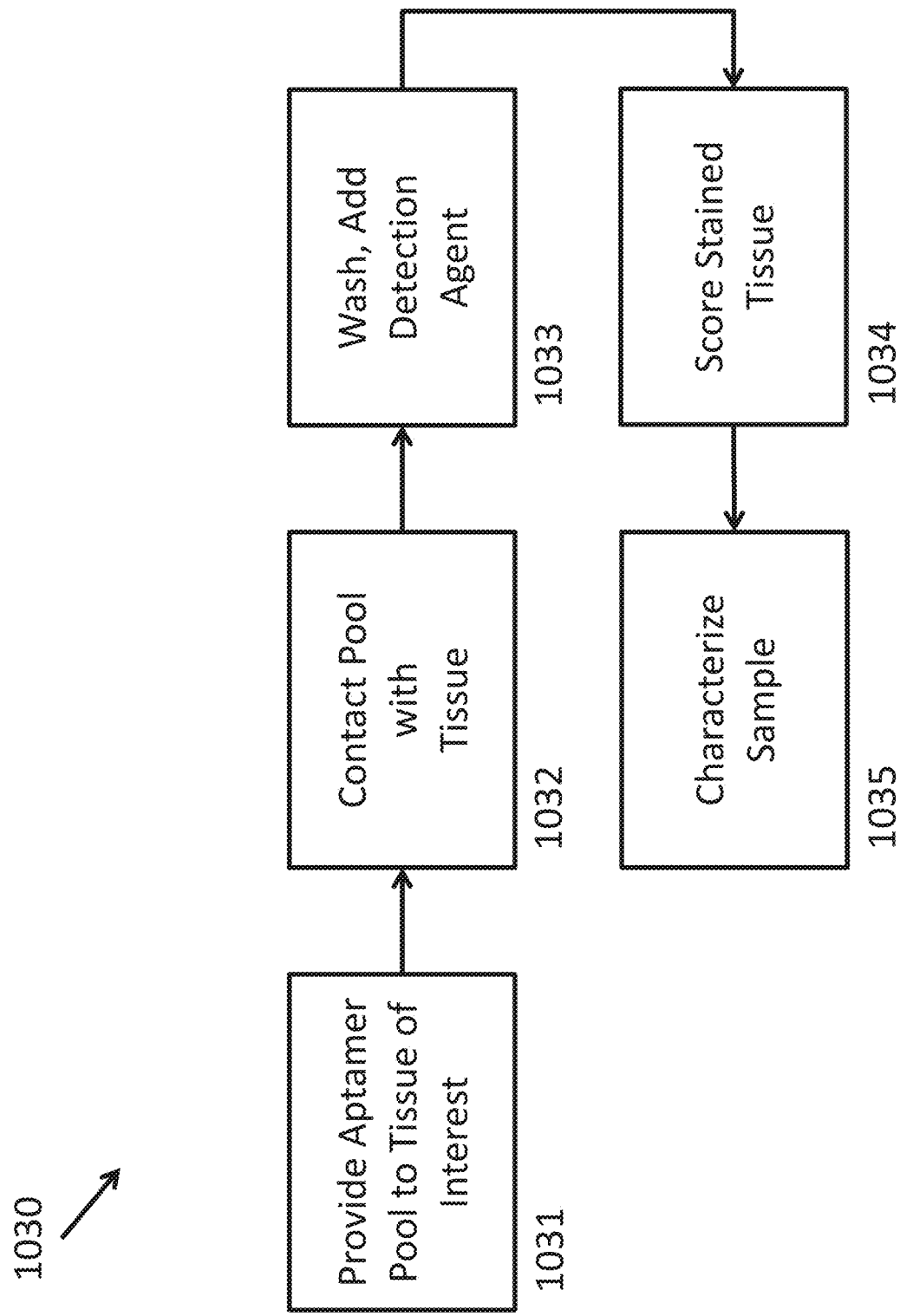

In other embodiments, an enriched library of oligonucleotide probes is used to assess a tissue sample. In some embodiments, the pool is used to stain the sample in a manner similar to IHC. Such method may be referred to herein as PHC, or polyligand histochemistry. FIG. 10D provides an outline 1030 of such method. An aptamer pool is provided that has been enriched against a tissue of interest 1031. The pool is contacted with a tissue sample 1032. The tissue sample can be in a format such as described herein. As a non-limiting example, the tissue sample can be a fixed tumor sample. The sample may be a FFPE sample fixed to a glass slide or membrane. The sample is washed to remove unbound members of the aptamer pool and the remaining aptamers are visualized 1033. Any appropriate method to visualize the aptamers can be used. In an example, the aptamer pool is biotinylated and the bound aptamer are visualized using streptavidin-horse radish peroxidase (SA-HRP). As described herein, other useful visualization methods are known in the art, including alternate labeling. The visualized sample is scored to determine the amount of staining 1034. For example a pathologist can score the slide as in IHC. The score can be used to characterize the sample 1035 as described herein. For example, a score of +1 or higher may indicate that the sample is a cancer sample, or is a cancer sample expressing a given biomarker. See Examples 19-31 herein.

In a related aspect, the invention provides a composition of matter comprising a plurality of oligonucleotides that can be used to carry out the methods comprising use of an oligonucleotide pool to characterize a phenotype. The plurality of oligonucleotides can comprise any of those described herein.

In an aspect, the invention provides a method for identifying oligonucleotides specific for a test sample. The method comprises: (a) enriching a plurality of oligonucleotides for a sample to provide a set of oligonucleotides predetermined to form a complex with a target sample; (b) contacting the plurality in (a) with a test sample to allow formation of complexes of oligonucleotides with test sample; (c) recovering oligonucleotides that formed complexes in (b) to provide a recovered subset of oligonucleotides; and (d) profiling the recovered subset of oligonucleotides by high-throughput sequencing, amplification or hybridization, thereby identifying oligonucleotides specific for a test sample. The test sample may comprise tissue, cells, microvesicles, biomarkers, or other biological entities of interest. The oligonucleotides may comprise RNA, DNA or both. In some embodiment, the method further comprises performing informatics analysis to identify a subset of oligonucleotides comprising sequence identity of at least 50%, 55%, 60%, 65%, 70%, 75%, 80%, 85%, 90%, 91%, 92%, 93%, 94%, 95%, 96%, 97%, 98%, or at least 99% to the oligonucleotides predetermined to form a complex with the target sample.

One of skill will appreciate that the method can be used to identify any appropriate target. The target can be any useful target, including without limitation a cell, an organelle, a protein complex, a lipoprotein, a carbohydrate, a microvesicle, a virus, a membrane fragment, a small molecule, a heavy metal, a toxin, a drug, a nucleic acid (including without limitation microRNA (miR) and messenger RNA (mRNA)), a protein-nucleic acid complex, and various combinations, fragments and/or complexes of any of these. The target can, e.g., comprise a mixture of such biological entities.

In an aspect, the invention also provides a method comprising contacting an oligonucleotide or plurality of oligonucleotides with a sample and detecting the presence or level of binding of the oligonucleotide or plurality of oligonucleotides to a target in the sample, wherein the oligonucleotide or plurality of oligonucleotides can be those provided by the invention above. The sample may comprise a biological sample, an organic sample, an inorganic sample, a tissue, a cell culture, a bodily fluid, blood, serum, a cell, a microvesicle, a protein complex, a lipid complex, a carbohydrate, or any combination, fraction or variation thereof. The target may comprise a cell, an organelle, a protein complex, a lipoprotein, a carbohydrate, a microvesicle, a membrane fragment, a small molecule, a heavy metal, a toxin, or a drug.

In another aspect, the invention provides a method comprising: a) contacting a sample with an oligonucleotide probe library comprising at least $10^6$, $10^7$, $10^8$, $10^9$, $10^{10}$, $10^{11}$, $10^{12}$, $10^{13}$, $10^{14}$, $10^{15}$, $10^{16}$, $\mathbf{10^{17}}$, or at least $10^{18}$ different oligonucleotide sequences oligonucleotides to form a mixture in solution, wherein the oligonucleotides are capable of binding a plurality of entities in the sample to form complexes, wherein optionally the oligonucleotide probe library comprises an oligonucleotide or plurality of oligonucleotides as provided by the invention above; b) partitioning the complexes formed in step (a) from the mixture; and c) recovering oligonucleotides present in the complexes partitioned in step (b) to identify an oligonucleotide profile for the sample.

In still another aspect, the invention provides a method for generating an enriched oligonucleotide probe library comprising: a) contacting a first oligonucleotide library with a biological test sample and a biological control sample, wherein complexes are formed between biological entities present in the biological samples and a plurality of oligonucleotides present in the first oligonucleotide library; b) partitioning the complexes formed in step (a) and isolating the oligonucleotides in the complexes to produce a subset of oligonucleotides for each of the biological test sample and biological control sample; c) contacting the subsets of oligonucleotides in (b) with the biological test sample and biological control sample wherein complexes are formed between biological entities present in the biological samples and a second plurality of oligonucleotides present in the subsets of oligonucleotides to generate a second subset group of oligonucleotides; and d) optionally repeating steps b)-c), one, two, three or more times to produce a respective third, fourth, fifth or more subset group of oligonucleotides, thereby producing the enriched oligonucleotide probe library. In a related aspect, the invention provides a plurality of oligonucleotides comprising at least 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 200000, 300000, 400000, or 500000 different oligonucleotide sequences, wherein the plurality results from the method in this paragraph, wherein the library is capable of distinguishing a first phenotype from a second phenotype. In some embodiments, the first phenotype comprises a disease or disorder and the second phenotype comprises a healthy state; or wherein the first phenotype comprises a disease or disorder and the second phenotype comprises a different disease or disorder; or wherein the first phenotype comprises a stage or progression of a disease or disorder and the second phenotype comprises a different stage or progression of the same disease or disorder; or wherein the first phenotype comprises a positive response to a therapy and the second phenotype comprises a negative response to the same therapy.

In yet another aspect, the invention provides a method of characterizing a disease or disorder, comprising: a) contacting a biological test sample with the oligonucleotide or plurality of oligonucleotides provided by the invention; b) detecting a presence or level of complexes formed in step (a) between the oligonucleotide or plurality of oligonucleotides provided by the invention and a target in the biological test sample; and c) comparing the presence or level detected in step (b) to a reference level from a biological control sample, thereby characterizing the disease or disorder. The step of detecting may comprise performing sequencing of all or some of the oligonucleotides in the complexes, amplification of all or some of the oligonucleotides in the complexes, and/or hybridization of all or some of the oligonucleotides in the complexes to an array. The sequencing may be high-throughput or next generation sequencing. In some embodiments, the step of detecting comprises visualizing the oligonucleotide or plurality of oligonucleotides in association with the biological test sample. For example, polyligand histochemistry (PHC) as provided by the invention may be used.

In the methods of the invention, the biological test sample and biological control sample may each comprise a tissue sample, a cell culture, or a biological fluid. In some embodiments, the biological fluid comprises a bodily fluid. Useful bodily fluids within the method of the invention comprise peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood. In some preferred embodiments, the bodily fluid comprises blood, serum or plasma. The biological fluid may comprise microvesicles. In such case, the complexes may be formed between the oligonucleotide or plurality of oligonucleotides and at least one of the microvesicles.

The biological test sample and biological control sample may further comprise isolated microvesicles, wherein optionally the microvesicles are isolated using at least one of chromatography, filtration, ultrafiltration, centrifugation, ultracentrifugation, flow cytometry, affinity capture (e.g., to a planar surface, column or bead), polymer precipitation, and using microfluidics. The vesicles can also be isolated after contact with the oligonucleotide or plurality of oligonucleotides.

The biological test sample and biological control sample may comprise tissue. The tissue can be formalin fixed paraffin embedded (FFPE) tissue. In some embodiments, the FFPE tissue comprises at least one of a fixed tissue, unstained slide, bone marrow core or clot, biopsy sample, surgical sample, core needle biopsy, malignant fluid, and fine needle aspirate (FNA). The FFPE tissue can be fixed on a substrate, e.g., a glass slide or membrane.

In various embodiments of the methods of the invention, the oligonucleotide or plurality of oligonucleotides binds a polypeptide or fragment thereof. The polypeptide or fragment thereof can be soluble or membrane bound, wherein optionally the membrane comprises a cellular or microvesicle membrane. The membrane could also be from a fragment of a cell, organelle or microvesicle. In some embodiments, the polypeptide or fragment thereof comprises a biomarker in Table 3, Table 4 or any one of Tables 10-17. For example, the polypeptide or fragment thereof could be a general vesicle marker such as in Table 3 or a tissue-related or disease-related marker such as in Table 4, or a vesicle associated biomarker provided in any one of Tables 10-17. The oligonucleotide or plurality of oligonucleotides may bind a microvesicle surface antigen in the biological sample. For example, the oligonucleotide or plurality of oligonucleotides can be enriched from a naïve library against microvesicles.

As noted above, the microvesicles may be isolated in whole or in part using polymer precipitation. In an embodiment, the polymer comprises polyethylene glycol (PEG). Any appropriate form of PEG may be used. For example, the PEG may be PEG 8000. The PEG may be used at any appropriate concentration. For example, the PEG can be used at a concentration of 1%, 2%, 3%, 4%, 5%, 6%, 7%, 8%, 9%, 10%, 11%, 12%, 13%, 14% or 15% to isolate the microvesicles. In some embodiments, the PEG is used at a concentration of 6%.

The disease or disorder detected by the oligonucleotide, plurality of oligonucleotides, or methods provided here may comprise any appropriate disease or disorder of interest, including without limitation Breast Cancer, Alzheimer's disease, bronchial asthma, Transitional cell carcinoma of the bladder, Giant cellular osteoblastoclastoma, Brain Tumor, Colorectal adenocarcinoma, Chronic obstructive pulmonary disease (COPD), Squamous cell carcinoma of the cervix, acute myocardial infarction (AMI)/acute heart failure, Chron's Disease, diabetes mellitus type II, Esophageal carcinoma, Squamous cell carcinoma of the larynx, Acute and chronic leukemia of the bone marrow, Lung carcinoma, Malignant lymphoma, Multiple Sclerosis, Ovarian carcinoma, Parkinson disease, Prostate adenocarcinoma, psoriasis, Rheumatoid Arthritis, Renal cell carcinoma, Squamous cell carcinoma of skin, Adenocarcinoma of the stomach, carcinoma of the thyroid gland, Testicular cancer, ulcerative colitis, or Uterine adenocarcinoma.

In some embodiments, the disease or disorder comprises a cancer, a premalignant condition, an inflammatory disease, an immune disease, an autoimmune disease or disorder, a cardiovascular disease or disorder, neurological disease or disorder, infectious disease or pain. The cancer can include without limitation one of acute lymphoblastic leukemia; acute myeloid leukemia; adrenocortical carcinoma; AIDS-related cancers; AIDS-related lymphoma; anal cancer; appendix cancer; astrocytomas; atypical teratoid/rhabdoid tumor, basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer, gallbladder cancer, gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer, lung cancer; malignant fibrous histiocytoma bone cancer; medulloblastoma; medulloepithelioma melanoma; Merkel cell carcinoma Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer, papillomatosis; paranasal sinus cancer; parathyroid cancer; pelvic cancer, penile cancer, pharyngeal cancer, pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer, respiratory tract cancer; retinoblastoma; rhabdomyosarcoma; salivary gland cancer; Sézary syndrome; small cell lung cancer; small intestine cancer, soft tissue sarcoma; squamous cell carcinoma; squamous neck cancer, stomach (gastric) cancer; supratentorial primitive neuroectodermal tumors; T-cell lymphoma; testicular cancer; throat cancer, thymic carcinoma; thymoma; thyroid cancer, transitional cell cancer; transitional cell cancer of the renal pelvis and ureter; trophoblastic tumor; ureter cancer; urethral cancer; uterine cancer; uterine sarcoma; vaginal cancer; vulvar cancer, Waldenström macroglobulinemia; or Wilm's tumor. The premalignant condition can include without limitation Barrett's Esophagus. The autoimmune disease can include without limitation one of inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. The cardiovascular disease can include without limitation one of atherosclerosis, congestive heart failure, vulnerable plaque, stroke, ischemia, high blood pressure, stenosis, vessel occlusion or a thrombotic event. The neurological disease can include without limitation one of Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. The pain can include without limitation one of fibromyalgia, chronic neuropathic pain, or peripheral neuropathic pain. The infectious disease can include without limitation one of a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, or influenza. One of skill will appreciate that the oligonucleotide or plurality of oligonucleotides or methods of the invention can be used to assess any number of these or other related diseases and disorders.

In some embodiments of the invention, the oligonucleotide or plurality of oligonucleotides and methods of use thereof are useful for characterizing certain diseases or disease states. As desired, a pool of oligonucleotides useful for characterizing various diseases is assembled to create a master pool that can be used to probe useful for characterizing the various diseases. One of skill will also appreciate that pools of oligonucleotides useful for characterizing specific diseases or disorders can be created as well. The sequences provided herein can also be modified as desired so long as the functional aspects are still maintained (e.g., binding to various targets or ability to characterize a phenotype). For example, the oligonucleotides may comprise DNA or RNA, incorporate various non-natural nucleotides, incorporate other chemical modifications, or comprise various deletions or insertions. Such modifications may facilitate synthesis, stability, delivery, labeling, etc, or may have little to no effect in practice. In some cases, some nucleotides in an oligonucleotide may be substituted while maintaining functional aspects of the oligonucleotide. Similarly, 5' and 3' flanking regions may be substituted. In still other cases, only a portion of an oligonucleotide may be determined to direct its functionality such that other portions can be deleted or substituted. Numerous techniques to synthesize and modify nucleotides and polynucleotides are disclosed herein or are known in the art.

In an aspect, the invention provides a kit comprising a reagent for carrying out the methods of the invention provided herein. In a similar aspect, the invention contemplates use of a reagent for carrying out the methods of the invention provided herein. In embodiments, the reagent comprises an oligonucleotide or plurality of oligonucleotides. The oligonucleotide or plurality of oligonucleotides can be those provided herein. The reagent may comprise various other useful components including without limitation microRNA (miR) and messenger RNA (mRNA)), a protein-nucleic acid complex, and various combinations, fragments and/or complexes of any of these. The one or more reagent can be one or more of: a) a reagent configured to isolate a microvesicle, optionally wherein the at least one reagent configured to isolate a microvesicle comprises a binding agent to a microvesicle antigen, a column, a substrate, a filtration unit, a polymer, polyethylene glycol, PEG4000, PEG8000, a particle or a bead; b) at least one oligonucleotide configured to act as a primer or probe in order to amplify, sequence, hybridize or detect the oligonucleotide or plurality of oligonucleotides; c) a reagent configured to remove one or more abundant protein from a sample, wherein optionally the one or more abundant protein comprises at least one of albumin, immunoglobulin, fibrinogen and fibrin; d) a reagent for epitope retrieval; and e) a reagent for PHC visualization.

Detecting Watson-Crick Base Pairing with an Oligonucleotide Probe

The oligonucleotide probes provided by the invention can bind via non-Watson Crick base pairing. However, in some cases, the oligonucleotide probes provided by the invention can bind via Watson Crick base pairing. The oligonucleotide probe libraries of the invention, e.g., as described above, can query both types of binding events simultaneously. For example, some oligonucleotide probes may bind protein antigens in the classical aptamer sense, whereas other oligonucleotide probes may bind tissues, cells, microvesicles or other targets via nucleic acids associated with such targets, e.g., nucleic acid (including without limitation microRNA and mRNA) on the surface of the targets. Such surface bound nucleic acids can be associated with proteins. For example, they may comprise Argonaute-microRNA complexes. The argonaute protein can be Ago1, Ago2, Ago3 and/or Ago4.

In addition to the oligonucleotide probe library approach described herein which relies on determining a sequence of the oligonucleotides (e.g., via sequencing, hybridization or amplification), assays can also be designed to detect Watson Crick base pairing. In some embodiments, these approaches rely on Ago2-mediated cleavage wherein an Ago2-microRNA complex can be used to detected using oligonucleotide probes. For further details, see PCT/US15/62184, filed Nov. 23, 2015, which application is incorporated by reference herein in its entirety.

Tissue ADAPT

As noted herein, the invention provides methods of enriching oligonucleotide libraries against various biological samples, including tissue samples. Tissue samples may be fixed. Fixation may be used in the preparation of histological sections by which biological tissues are preserved from decay, thereby preventing autolysis or putrefaction. The principal macromolecules inside a cell are proteins and nucleic acids. Fixation terminates any ongoing biochemical reactions, and may also increase the mechanical strength or stability of the treated tissues. Thus, tissue fixation can be used to preserve cells and tissue components and to do this in such a way as to allow for the preparation of thin, stained sections. Such samples are available for many biological specimens, e.g., tumor samples. Thus, fixed tissues provide a desirable sample source for various applications of the oligonucleotide probe libraries of the invention. This process may be referred to as "tissue ADAPT."

Tissue ADAPT according to the invention has been used to provide various oligonucleotide probes. In an aspect, the invention provides an oligonucleotide comprising a region corresponding to: a) a variable sequence as described in any one of Examples 19-31; b) a variable sequence as described in any one of Tables 20-23, 25, 27, 38-40, or 45; or c) a sequence listed in any one of SEQ ID NO. 1-206506. In some embodiments, the oligonucleotide further comprises a 5' region with sequence 5'-CTAGCATGACTGCAGTACGT (SEQ ID NO. 4), a 3' region with sequence 5'-CTGTCTCT-TATACACATCTGACGCTGCCGACGA (SEQ ID NO. 5), or both. The invention further provides an oligonucleotide comprising a nucleic acid sequence or a portion thereof that is at least 50, 55, 60, 65, 70, 75, 80, 85, 90, 95, 96, 97, 98, 99 or 100 percent homologous to such oligonucleotide sequences. In a related aspect, the invention provides a plurality of oligonucleotides comprising at least 1, 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, or at least 100000 different oligonucleotide sequences as described above.

As described herein, many useful modifications can be made to nucleic acid molecules. In an embodiment, the oligonucleotide or the plurality of oligonucleotides of the invention comprise a DNA, RNA, 2'-O-methyl or phosphorothioate backbone, or any combination thereof. In some embodiments, the oligonucleotide or the plurality of oligonucleotides comprises at least one of DNA, RNA, PNA, LNA, UNA, and any combination thereof. The oligonucleotide or at least one member of the plurality of oligonucleotides can have at least one functional modification selected from the group consisting of DNA, RNA, biotinylation, a non-naturally occurring nucleotide, a deletion, an insertion, an addition, and a chemical modification. In some embodiments, the chemical modification comprises at least one of C18, polyethylene glycol (PEG), PEG4, PEG6, PEG8, PEG12 and digoxygenin.

The oligonucleotide or plurality of oligonucleotides of the invention can be labeled using any useful label such as described herein. For example, the oligonucleotide or plurality of oligonucleotides can be attached to a nanoparticle, liposome, gold, magnetic label, fluorescent label, light emitting particle, biotin moiety, or radioactive label.

Tissue ADAPT provides for the enrichment of oligonucleotide libraries against samples of interest. In an aspect, the invention provides a method of enriching an oligonucleotide library using multiple rounds of positive and negative selection. The method of enriching a plurality of oligonucleotides may comprise: a) performing at least one round of positive selection, wherein the positive selection comprises: i) contacting at least one sample with the plurality of oligonucleotides, wherein the at least one sample comprises tissue; and ii) recovering members of the plurality of oligonucleotides that associated with the at least one sample; b) optionally performing at least one round of negative selection, wherein the negative selection comprises: i) contacting at least one additional sample with the plurality of oligonucleotides, wherein at least one additonal sample comprises tissue; ii) recovering members of the plurality of oligonucleotides that did not associate with the at least one additonal sample; and c) amplifying the members of the plurality of oligonucleotides recovered in at least one or step (a)(ii) and step (b)(ii), thereby enriching the oligonucleotide library. Various alternatives of these processes are useful and described herein, such as varying the rounds of enrichment, and varying performance or positive and negative selection steps. In an embodiments, the recovered members of the plurality of oligonucleotides in step (a)(ii) are used as the input for the next iteration of step (a)(i). In an embodiment, the recovered members of the plurality of oligonucleotides in step (b)(ii) are used as the input for the next iteration of step (a)(i). The unenriched oligonucleotide library may possess great diversity. For example, the unenriched oligonucleotide library may comprise at least 2, 3, 4, 5, 6, 7, 8, 9, 10, 11, 12, 13, 14, 15, 16, 17, 18, 19, 20, 25, 30, 40, 45, 50, 55, 60, 65, 70, 75, 80, 85, 90, 95, 100, 125, 150, 175, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 200000, 300000, 400000, 500000, $10^6$, $10^7$, $10^8$, $10^9$, $10^{10}$, $10^{11}$, $10^{12}$, $10^{13}$, $10^{14}$, $10^{15}$, $10^{16}$, $10^{17}$, or at least $10^{18}$ different oligonucleotide sequences. In an embodiment, the unenriched oligonucleotide library comprises the naïve F-Trin library as described herein.

In embodiments of the enrichment methods of the invention, the at least one sample and/or at least one additional sample comprise tissue. As desired, such tissue may be fixed using methods described herein or known in the art. The fixed tissue may be archived. The fixed tissue may comprise formalin fixed paraffin embedded (FFPE) tissue. In embodiment, the FFPE tissue comprises at least one of a fixed tissue, unstained slide, bone marrow core or clot, biopsy sample, surgical sample, core needle biopsy, malignant fluid, and fine needle aspirate (FNA). The FFPE tissue can be fixed on a substrate. For example, the substrate can be a glass slide, membrane, or any other useful material.

In some embodiment, the at least one sample and/or the at least one additional sample are fixed on different substrates. As a non-limiting example, the at least one sample is fixed on one glass slide whereas the at least one additional sample is fixed on a different glass slide. As desired, such slides may be from different patients, different tumors, a same tumor at different time points, multiple slices of the same tumor, etc. Alternately, the at least one sample and/or the at least one additional sample is fixed on a single substrate. As a non-limiting example, the at least one sample and at least one additional sample are fixed on a same glass slide, such as a tumor sample and normal adjacent tissue to the tumor. In some embodiments, the at least one sample and/or the at least one additional sample are lysed (see, e.g., Example 29), scraped from a substrate (see, e.g., Example 30), or subjected to microdissection (see, e.g., Example 31). Lysed samples can be arrayed on a substrate. The invention contemplates any useful substrate. In some embodiments, the substrate comprises a membrane. For example, the membrane can be a nitrocellulose membrane.

In various embodiments of the enrichment methods of the invention, the at least one sample and the at least one additional sample differ in a phenotype of interest. The at least one sample and the at least one additional sample can be from different sections of a same substrate. As a non-limiting example, the samples may comprise cancer tissue and normal adjacent tissue from a fixed tissue sample. In such cases, the at least one sample and the at least one additional sample may be scraped or microdissected from the same substrate to facilitate enrichment.

The oligonucleotide library can be enriched for analysis of any desired phenotype. In embodiments, the phenotype comprises a tissue, anatomical origin, medical condition, disease, disorder, or any combination thereof. For example, the tissue can be muscle, epithelial, connective and nervous tissue, or any combination thereof. For example, the anatomical origin can be the stomach, liver, small intestine, large intestine, rectum, anus, lungs, nose, bronchi, kidneys, urinary bladder, urethra, pituitary gland, pineal gland, adrenal gland, thyroid, pancreas, parathyroid, prostate, heart, blood vessels, lymph node, bone marrow, thymus, spleen, skin, tongue, nose, eyes, ears, teeth, uterus, vagina, testis, penis, ovaries, breast, mammary glands, brain, spinal cord, nerve, bone, ligament, tendon, or any combination thereof. As described further below, the phenotype can be related to at least one of diagnosis, prognosis, theranosis, medical condition, disease or disorder.

In various embodiments of the enrichment methods of the invention, the method further comprises determining a target of the enriched members of the oligonucleotide library. Techniques for such determining are provided herein. See, e.g., Examples 9-10, 17 and 19.

Tissue ADAPT further comprises analysis of biological samples. In an aspect, the invention provides a method of characterizing a phenotype in a sample comprising: a) contacting the sample with at least one oligonucleotide or plurality of oligonucleotides; and b) identifying a presence or level of a complex formed between the at least one oligonucleotide or plurality of oligonucleotides and the sample, wherein the presence or level is used to characterize the phenotype. In a related aspect, the invention provides a method of visualizing a sample comprising: a) contacting the sample with at least one oligonucleotide or plurality of oligonucleotides; b) removing the at least one oligonucleotide or members of the plurality of oligonucleotides that do not bind the sample; and c) visualizing the at least one oligonucleotide or plurality of oligonucleotides that bound to the sample. The visualization can be used to characterize a phenotype.

The sample to be characterized can be any useful sample, including without limitation a tissue sample, bodily fluid, cell, cell culture, microvesicle, or any combination thereof. In some embodiments, the tissue sample comprises fixed tissue. The tissue may be fixed using any useful technique for fixation known in the art. Examples of fixation methods include heat fixation, immersion, perfusion, chemical fixation, cross-linked (for example, with an aldehyde such as formaldehyde or glutaraldehyde), precipitation (e.g., using an alcohol such as methanol, ethanol and acetone, and acetic acid), oxidation (e.g., using osmium tetroxide, potassium dichromate, chromic acid, and potassium permanganate), mercurials, picrates, Bouin solution, hepes-glutamic acid buffer-mediated organic solvent protection effect (HOPE), and freezing. In preferred embodiments, the fixed tissue is formalin fixed paraffin embedded (FFPE) tissue. In various embodiments, the FFPE sample comprises at least one of a fixed tissue, unstained slide, bone marrow core or clot, biopsy sample, surgical sample, core needle biopsy, malignant fluid, and fine needle aspirate (FNA).

Any useful technique for identifying a presence or level can be used for applications of tissue ADAPT, including without limitation nucleic acid sequencing, amplification, hybridization, gel electrophoresis, chromatography, or visualization. In some embodiments, the hybridization comprises contacting the sample with at least one labeled probe that is configured to hybridize with at least one oligonucleotide or plurality of oligonucleotides. The at least one labeled probe can be directly or indirectly attached to a label. The label can be, e.g., a fluorescent, radioactive or magnetic label. An indirect label can be, e.g., biotin or digoxigenin. See, e.g., Example 28. In some embodiments, the sequencing comprises next generation sequencing, dye termination sequencing, and/or pyrosequencing of the at least one oligonucleotide or plurality of oligonucleotides. The visualization may be that of a signal linked directly or indirectly to the at least one oligonucleotide or plurality of oligonucleotides. The signal can be any useful signal, e.g., a fluorescent signal or an enzymatic signal. In some embodiments, the enzymatic signal is produced by at least one of a luciferase, firefly luciferase, bacterial luciferase, luciferin, malate dehydrogenase, urease, peroxidase, horseradish peroxidase (HRP), alkaline phosphatase (AP), 3-galactosidase, glucoamylase, lysozyme, a saccharide oxidase, glucose oxidase, galactose oxidase, glucose-6-phosphate dehydrogenase, a heterocyclic oxidase, uricase, xanthine oxidase, lactoperoxidase, and microperoxidase. Visualization may comprise use of light microscopy or fluorescent microscopy. Various examples of visualization using polyligand histochemistry (PHC) are provided herein. See Examples 19-31.

In the methods of the invention directed to characterizing or visualizing a sample, the target of at least one of the at least one oligonucleotide or plurality of oligonucleotides may be known. For example, an oligonucleotide may bind a known protein target. In some embodiments, the target of at least one the at least one oligonucleotide or plurality of oligonucleotides is unknown. For example, the at least one oligonucleotide or plurality of oligonucleotides may themselves provide a biosignature or other useful result that does not necessarily require knowledge of the antigens bound by some or all of the oligonucleotides. In some embodiments, the targets of a portion of the oligonucleotides are known whereas the targets of another portion of the oligonucleotides have not been identified.

In the methods of characterizing or visualizing a sample, the at least one oligonucleotide or plurality of oligonucleotides can be as provided herein. The at least one oligonucleotide or plurality of oligonucleotides may have been determined using the enrichment methods of the invention provided herein, e.g., enrichment via tissue ADAPT. For example, the at least one oligonucleotide or plurality of oligonucleotides may comprise nucleic acids may have a sequence or a portion thereof that is at least 50, 55, 60, 65, 70, 75, 80, 85, 90, 95, 96, 97, 98, 99 or 100 percent homologous to an oligonucleotide sequence according to at least one of SEQ ID NOs. 1-206506.

For example, the at least one oligonucleotide or plurality of oligonucleotides may comprise nucleic acids may have a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. In such cases, the phenotype may be, e.g., lung cancer or prostate cancer. See Example 14.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. In such cases, the phenotype may be, e.g., prostate cancer. See Example 17.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. In such cases, the phenotype may be, e.g., HER2 status (+/−). See Example 19.

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. In such cases, the phenotype may be, e.g., response to anti-HER2 therapy, wherein optionally the anti-HER2 therapy comprises traztuzamab. See Examples 20-22.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. In such cases, the phenotype may be, e.g., response to at least one of FOLFOX and bevazicumab. See Example 24.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. In such cases, the phenotype may be, e.g., a tissue identity, including without limitation whether the tissue comprises breast, colon, kidney, lung or pancreatic tissue. See Example 29.

In the methods of the invention, including enriching an oligonucleotide library, characterizing a sample or visualizing a sample, the phenotype can be a biomarker status. In some embodiments, the biomarker is selected from Table 4 or FIGS. 26A-B. In some embodiments, the biomarker status comprises at least one of HER2 positive, HER2 negative, EGFR positive, EGFR negative, TUBB3 positive, or TUBB3 negative. See, e.g., Examples 19-23, 24, 26. In some embodiments, the biomarker status comprises expression, copy number, mutation, insertion, deletion or other alteration of at least one of ALK, AR, ER, ERCC1, Her2/Neu, MGMT, MLH1, MSH2, MSH6, PD-1, PD-L1, PD-L1 (22c3), PMS2, PR, PTEN, RRM1, TLE3, TOP2A, TOPO1, TrkA, TrkB, TrkC, TS, and TUBB3. In various embodiments, the biomarker status comprises the presence or absence of at least one of EGFR vIII or MET Exon 14 Skipping. In embodiments, the biomarker status comprises expression, copy number, fusion, mutation, insertion, deletion or other alteration of at least one of ALK, BRAF, NTRK1, NTRK2, NTRK3, RET, ROS1, and RSPO3. In embodiments, the biomarker status comprises expression, copy number, fusion, mutation, insertion, deletion or other alteration of at least one of ABL2, ACSL3, ACSL6, AFF1, AFF3, AFF4, AKAP9, AKT2, AKT3, ALDH2, ALK, APC, ARFRP1, ARHGAP26, ARHGEF12, ARID1A, ARID2, ARNT, ASPSCR1, ASXL1, ATF1, ATIC, ATM, ATP1A1, ATR, AURKA, AURKB, AXIN1, AXL, BAP1, BARD1, BCL10, BCL11A, BCL2L11, BCL3, BCL6, BCL7A, BCL9, BCR, BIRC3, BLM, BMPRIA, BRAF, BRCA1, BRCA2, BRIP1, BUB1B, C11orf30 (EMSY), C2orf44, CACNA1D, CALR, CAMTA, CANT1, CARD11, CARS, CASC5, CASP8, CBFA2T3, CBFB, CBL, CBLB, CCDC6, CCNB1IP1, CCND1, CCND2, CCND3, CCNE1, CD274 (PDL), CD74, CD79A, CDC73, CDH11, CDK4, CDK6, CDK8, CDKN1B, CDKN2A, CDX2, CHEK1, CHEK2, CHIC2, CHN1, CIC, CIITA, CLP1, CLTC, CLTCL, CNBP, CNTRL, COPB1, CREB1, CREB3L1, CREB3L2, CREBBP, CRKL, CRTC1, CRTC3, CSF1R, CSF3R, CTCF, CTLA4, CTNNA1, CTNNB1, CYLD, CYP2D6, DAXX, DDR2, DDX10, DDX5, DDX6, DEK, DICER1, DOT1L, EBF1, ECT2L, EGFR, ELK4, ELL, EML4, EP300, EPHA3, EPHA5, EPHB1, EPS15, ERBB2 (HER2), ERBB3 (HER3), ERBB4 (HER4), ERC1, ERCC2, ERCC3, ERCC4, ERCC5, ERG, ESR1, ETV1, ETV5, ETV6, EWSR1, EXT1, EXT2, EZH2, EZR, FANCA, FANCC, FANCD2, FANCE, FANCG, FANCL, FAS, FBXO11, FBXW7, FCRL4, FGF10, FGF14, FGF19, FGF23, FGF3, FGF4, FGF6, FGFR1, FGFR1OP, FGFR2, FGFR3, FGFR4, FH, FHIT, FIP1L1, FLCN, FLI1, FLT1, FLT3, FLT4, FNBP1, FOXA1, FOXO1, FOXP1, FUBP1, FUS, GAS7, GATA3, GID4 (C17orf39), GMPS, GNA13, GNAQ, GNAS, GOLGA5, GOPC, GPHN, GPR124, GRIN2A, GSK3B, H3F3A, H3F3B, HERPUD1, HGF, HIP1, HMGA1, HMGA2, HNRNPA2B1, HOOK3, HSP90AA1, HSP90AB1, IDH1, IDH2, IGF1R, IKZF1, IL2, IL21R, IL6ST, IL7R, IRF4, ITK, JAK1, JAK2, JAK3, JAZF1, KDM5A, KDR (VEGFR2), KEAP1, KIAA1549, KIF5B, KIT, KLHL6, KMT2A (MLL), KMT2C (MLL3), KMT2D (MLL2), KRAS, KTN1, LCK, LCP1, LGR5, LHFP, LIFR, LPP, LRIG3, LRP1B, LYL1, MAF, MALT, MAML2, MAP2K1, MAP2K2, MAP2K4, MAP3K1, MCL1, MDM2, MDM4, MDS2, MEF2B, MEN1, MET (cMET), MITF, MLF1, MLH1 (NGS), MLLT1, MLLT10, MLLT3, MLLT4, MLLT6, MNX1, MRE11A, MSH2 (NGS), MSH6 (NGS), MSI2, MTOR, MYB, MYC, MYCN, MYD88, MYH11, MYH9, NACA, NCKIPSD, NCOA1, NCOA2, NCOA4, NF1, NF2, NFE2L2, NFIB, NFKB2, NFKBIA, NIN, NOTCH2, NPM1, NR4A3, NSD1, NT5C2, NTRK1, NTRK2, NTRK3, NUP214, NUP93, NUP98, NUTM1, PALB2, PAX3, PAX5, PAX7, PBRM1, PBX1, PCM1, PCSK7, PDCD1 (PD1), PDCD1LG2 (PDL2), PDGFB, PDGFRA, PDGFRB, PDK1, PER1, PICALM, PIK3CA, PIK3R1, PIK3R2, PIM1, PML, PMS2 (NGS), POLE, POT1, POU2AF1, PPARG, PRCC, PRDM1, PRDM16, PRKAR1A, PRRX1, PSIP1, PTCH1, PTEN (NGS), PTPN11, PTPRC, RABEP1, RAC1, RAD50, RAD51, RAD51B, RAF1, RALGDS, RANBP17, RAP1GDS1, RARA, RB1, RBM15, REL, RET, RICTOR, RMI2, RNF43, ROS1, RPL22, RPL5, RPN1, RPTOR, RUNX1, RUNXIT1, SBDS, SDC4, SDHAF2, SDHB, SDHC, SDHD, SEPT9, SET, SETBP1, SETD2, SF3B1, SH2B3, SH3GL1, SLC34A2, SMAD2, SMAD4, SMARCB1, SMARCE1, SMO, SNX29, SOX10, SPECC1, SPEN, SRGAP3, SRSF2, SRSF3, SS18, SS18L1, STAT3, STAT4, STAT5B, STIL, STK11, SUFU, SUZ12, SYK, TAF15, TCF12, TCF3, TCF7L2, TET1, TET2, TFEB, TFG, TFRC, TGFBR2, TLX1, TNFAIP3, TNFRSF14, TNFRSF17, TOP1, TP53, TPM3, TPM4, TPR, TRAF7, TRIM26, TRIM27, TRIM33, TRIP11, TRRAP, TSC1, TSC2, TSHR, TTL, U2AF1, USP6, VEGFA, VEGFB, VTI1A, WHSC1, WHSCIL1, WIF1, WISP3, WRN, WT1, WWTR1, XPA, XPC, XPO1, YWHAE, ZMYM2, ZNF217, ZNF331, ZNF384, ZNF521, and ZNF703. The biomarker status may comprise expression, copy number, fusion, mutation, insertion, deletion or other alteration of at least one of ABI1, ABL1, ACKR3, AKT1, AMER1 (FAM123B), AR, ARAF, ATP2B3, ATRX, BCL11B, BCL2, BCL2L2, BCOR, BCORL1, BRD3, BRD4, BTG1, BTK, C15orf65, CBLC, CD79B, CDH1, CDK12, CDKN2B, CDKN2C, CEBPA, CHCHD7, CNOT3, COL1A1, COX6C, CRLF2, DDB2, DDIT3, DNM2, DNMT3A, EIF4A2, ELF4, ELN, ERCC1 (NGS), ETV4, FAM46C, FANCF, FEV, FOXL2, FOXO3, FOXO4, FSTL3, GATA1, GATA2, GNA11, GPC3, HEY1, HISTIH3B, HIST1H4I, HLF, HMGN2P46, HNF1A, HOXA1, HOXA13, HOXA9, HOXC11, HOXC13, HOXD11, HOXDI3, HRAS, IKBKE, INHBA, IRS2, JUN, KAT6A (MYST3), KAT6B, KCNJ5, KDM5C, KDM6A, KDSR, KLF4, KLK2, LASP1, LMO1, LMO2, MAFB, MAX, MECOM, MED12, MKL1, MLLT11, MN1, MPL, MSN, MTCP1, MUC1, MUTYH, MYCL (MYCL1), NBN, NDRG1, NKX2-1, NONO, NOTCH1, NRAS, NUMA1, NUTM2B, OLIG2, OMD, P2RY8, PAFAHIB2, PAK3, PATZ1, PAX8, PDE4DIP, PHF6, PHOX2B, PIK3CG, PLAG1, PMS1, POU5F1, PPP2RIA, PRF1, PRKDC, RAD21, RECQL4, RHOH, RNF213, RPL10, SEPT5, SEPT6, SFPQ, SLC45A3, SMARCA4, SOCS1, SOX2, SPOP, SRC, SSX1, STAG2, TAL1, TAL2, TBL1XR1, TCEA1, TCL1A, TERT, TFE3, TFPT, THRAP3, TLX3, TMPRSS2, UBR5, VHL, WAS, ZBTB16, and ZRSR2. The biomarker status can be for a biomarker in any one of PCT/US2007/69286, filed May 18, 2007; PCT/US2009/60630, filed Oct. 14, 2009; PCT/2010/000407, filed Feb. 11, 2010; PCT/US12/41393, filed Jun. 7, 2012; PCT/US2013/073184, filed Dec. 4, 2013; PCT/US2010/54366, filed Oct. 27, 2010; PCT/US11/67527, filed Dec. 28, 2011; PCT/US15/13618, filed Jan. 29, 2015; and PCT/US16/20657, filed Mar. 3, 2016; each of which applications is incorporated herein by reference in its entirety. Examples of additional biomarkers that can be incorporated into the methods and compositions of the invention include without limitation those disclosed in International Patent Application Nos. PCT/US2009/62880, filed Oct. 30, 2009; PCT/US2009/006095, filed Nov. 12, 2009; PCT/US2011/26750, filed Mar. 1, 2011; PCT/US2011/031479, filed Apr. 6, 2011; PCT/US11/48327, filed Aug. 18, 2011; PCT/US2008/71235, filed Jul. 25, 2008; PCT/US10/58461, filed Nov. 30, 2010; PCT/US2011/21160, filed Jan. 13, 2011; PCT/US2013/030302, filed Mar. 11, 2013; PCT/US12/25741, filed Feb. 17, 2012; PCT/2008/76109, filed Sep. 12, 2008; PCT/US12/42519, filed Jun. 14, 2012; PCT/US12/50030, filed Aug. 8, 2012; PCT/US12/49615, filed Aug. 3, 2012; PCT/US12/41387, filed Jun. 7, 2012; PCT/US2013/072019, filed Nov. 26, 2013; PCT/US2014/039858, filed May 28, 2013; PCT/IB2013/003092, filed Oct. 23, 2013; PCT/US13/76611, filed Dec. 19, 2013; PCT/US14/53306, filed Aug. 28, 2014; and PCT/US15/62184, filed Nov. 23, 2015; PCT/US16/40157, filed Jun. 29, 2016; PCT/US16/44595, filed Jul. 28, 2016; and PCT/US16/21632, filed Mar. 9, 2016; each of which applications is incorporated herein by reference in its entirety. The methods of the invention can be used to enrich oligonucleotide libraries and analyze samples given any desired biomarker status for which appropriate samples are available.

In the methods of the invention, including enriching an oligonucleotide library, characterizing a sample or visualizing a sample, the phenotype can be a phenotype comprises a disease or disorder. The methods can be employed to assist in providing a diagnosis, prognosis and/or theranosis for the disease or disorder. For example, the enriching may be performed using sample such that the enriched library can be used to assist in providing a diagnosis, prognosis and/or theranosis for the disease or disorder. Similarly, the characterizing may comprise assisting in providing a diagnosis, prognosis and/or theranosis for the disease or disorder. The visualization may also comprise assisting in providing a diagnosis, prognosis and/or theranosis for the disease or disorder. In some embodiments, the theranosis comprises predicting a treatment efficacy or lack thereof, classifying a patient as a responder or non-responder to treatment, or monitoring a treatment efficacy. The theranosis can be directed to any appropriate treatment, e.g., the treatment may comprise at least one of chemotherapy, immunotherapy, targeted cancer therapy, a monoclonal antibody, an anti-HER2 antibody, trastuzumab, an anti-VEGF antibody, bevacizumab, and/or platinum/taxane therapy. In some embodiments, the treatment comprises at least one of afatinib, afatinib+cetuximab, alectinib, aspirin, atezolizumab, bicalutamide, cabozantinib, capecitabine, carboplatin, ceritinib, cetuximab, cisplatin, crizotinib, dabrafenib, dacarbazine, doxorubicin, enzalutamide, epirubicin, erlotinib, everolimus, exemestane+everolimus, fluorouracil, fulvestrant, gefitinib, gemcitabine, hormone therapies, irinotecan, lapatinib, liposomal-doxorubicin, matinib, mitomycin-c, nab-paclitaxel, nivolumab, olaparib, osimertinib, oxaliplatin, palbociclib combination therapy, paclitaxel, palbociclib, panitumumab, pembrolizumab, pemetrexed, pertuzumab, sunitinib, T-DM1, temozolomide docetaxel, temsirolimus, topotecan, trametinib, trastuzumab, vandetanib, and vemurafenib. The hormone therapy can be one or more of tamoxifen, toremifene, fulvestrant, letrozole, anastrozole, exemestane, megestrol acetate, leuprolide, goserelin, bicalutamide, flutamide, abiraterone, enzalutamide, triptorelin, abarelix, and degarelix.

The theranosis can be for a therapy listed in FIGS. 26A-B, or in any one of PCT/US2007/69286, filed May 18, 2007; PCT/US2009/60630, filed Oct. 14, 2009; PCT/2010/000407, filed Feb. 11, 2010; PCT/US12/41393, filed Jun. 7, 2012; PCT/US2013/073184, filed Dec. 4, 2013; PCT/US2010/54366, filed Oct. 27, 2010; PCT/US11/67527, filed Dec. 28, 2011; PCT/US15/13618, filed Jan. 29, 2015; and PCT/US16/20657, filed Mar. 3, 2016; each of which applications is incorporated herein by reference in its entirety. The likelihood of benefit or lack of benefit of these therapies for treating various cancers can be related to a biomarker status. For example, anti-HER2 treatments may be of most benefit for patients whose tumors express HER2, and vice versa. Using appropriate samples for enrichment (e.g., known responders or non-responders), tissue ADAPT may be used to provide improved theranosis as compared to conventional companion diagnostics. See, e.g., Examples 20-22; see also Examples 24, 27.

In the methods of the invention directed to characterizing a sample, the characterizing may comprise comparing the presence or level to a reference. In some embodiments, the reference comprises a presence or level determined in a sample from an individual without a disease or disorder, or from an individual with a different state of a disease or disorder. The presence or level can be that of a visual level, such as an IHC score, determined by the visualizing. As a non-limiting example, the comparison to the reference of at least one oligonucleotide or plurality of oligonucleotides provided by the invention indicates that the sample comprises a cancer sample or a non-cancer/normal sample.

In some embodiments of the methods of the invention, one or more sample comprises a bodily fluid. The bodily fluid can be any useful bodily fluid, including without limitation peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

In the methods of the invention, including characterizing a sample or visualizing a sample, the sample can be from a subject suspected of having or being predisposed to a medical condition, disease, or disorder.

In the methods of the invention, including enriching an oligonucleotide library, characterizing a sample or visualizing a sample, the medical condition, the disease or disorder may be a cancer, a premalignant condition, an inflammatory disease, an immune disease, an autoimmune disease or disorder, a cardiovascular disease or disorder, neurological disease or disorder, infectious disease or pain. In some embodiments, the cancer comprises an acute lymphoblastic leukemia; acute myeloid leukemia; adrenocortical carcinoma; AIDS-related cancers; AIDS-related lymphoma; anal cancer; appendix cancer, astrocytomas; atypical teratoid/rhabdoid tumor; basal cell carcinoma; bladder cancer; brain stem glioma; brain tumor (including brain stem glioma, central nervous system atypical teratoid/rhabdoid tumor, central nervous system embryonal tumors, astrocytomas, craniopharyngioma, ependymoblastoma, ependymoma, medulloblastoma, medulloepithelioma, pineal parenchymal tumors of intermediate differentiation, supratentorial primitive neuroectodermal tumors and pineoblastoma); breast cancer; bronchial tumors; Burkitt lymphoma; cancer of unknown primary site; carcinoid tumor; carcinoma of unknown primary site; central nervous system atypical teratoid/rhabdoid tumor; central nervous system embryonal tumors; cervical cancer, childhood cancers; chordoma; chronic lymphocytic leukemia; chronic myelogenous leukemia; chronic myeloproliferative disorders; colon cancer, colorectal cancer; craniopharyngioma; cutaneous T-cell lymphoma; endocrine pancreas islet cell tumors; endometrial cancer; ependymoblastoma; ependymoma; esophageal cancer; esthesioneuroblastoma; Ewing sarcoma; extracranial germ cell tumor; extragonadal germ cell tumor; extrahepatic bile duct cancer, gallbladder cancer, gastric (stomach) cancer; gastrointestinal carcinoid tumor, gastrointestinal stromal cell tumor; gastrointestinal stromal tumor (GIST); gestational trophoblastic tumor; glioma; hairy cell leukemia; head and neck cancer, heart cancer; Hodgkin lymphoma; hypopharyngeal cancer; intraocular melanoma; islet cell tumors; Kaposi sarcoma; kidney cancer; Langerhans cell histiocytosis; laryngeal cancer; lip cancer; liver cancer, lung cancer; malignant fibrous histiocytoma bone cancer; medulloblastoma; medulloepithelioma; melanoma; Merkel cell carcinoma; Merkel cell skin carcinoma; mesothelioma; metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer; ovarian epithelial cancer; ovarian germ cell tumor; ovarian low malignant potential tumor; pancreatic cancer, papillomatosis; paranasal sinus cancer; parathyroid cancer; pelvic cancer, penile cancer, pharyngeal cancer, pineal parenchymal tumors of intermediate differentiation; pineoblastoma; pituitary tumor, plasma cell neoplasm/multiple myeloma; pleuropulmonary blastoma; primary central nervous system (CNS) lymphoma; primary hepatocellular liver cancer; prostate cancer; rectal cancer; renal cancer; renal cell (kidney) cancer; renal cell cancer, respiratory tract cancer; retinoblastoma; rhabdomyosarcoma; salivary gland cancer; Sdzary syndrome; small cell lung cancer; small intestine cancer, soft tissue sarcoma; squamous cell carcinoma; squamous neck cancer, stomach (gastric) cancer; supratentorial primitive neuroectodermal tumors; T-cell lymphoma; testicular cancer; throat cancer, thymic carcinoma; thymoma; thyroid cancer, transitional cell cancer; transitional cell cancer of the renal pelvis and ureter; trophoblastic tumor; ureter cancer; urethral cancer; uterine cancer; uterine sarcoma; vaginal cancer; vulvar cancer, WaldenstrOm macroglobulinemia; or Wilm's tumor. In some embodiments, the premalignant condition comprises Barrett's Esophagus. In some embodiments, the autoimmune disease comprises inflammatory bowel disease (IBD), Crohn's disease (CD), ulcerative colitis (UC), pelvic inflammation, vasculitis, psoriasis, diabetes, autoimmune hepatitis, multiple sclerosis, myasthenia gravis, Type I diabetes, rheumatoid arthritis, psoriasis, systemic lupus erythematosis (SLE), Hashimoto's Thyroiditis, Grave's disease, Ankylosing Spondylitis Sjogrens Disease, CREST syndrome, Scleroderma, Rheumatic Disease, organ rejection, Primary Sclerosing Cholangitis, or sepsis. In some embodiments, the cardiovascular disease comprises atherosclerosis, congestive heart failure, vulnerable plaque, stroke, ischemia, high blood pressure, stenosis, vessel occlusion or a thrombotic event. In some embodiments, the neurological disease comprises Multiple Sclerosis (MS), Parkinson's Disease (PD), Alzheimer's Disease (AD), schizophrenia, bipolar disorder, depression, autism, Prion Disease, Pick's disease, dementia, Huntington disease (HD), Down's syndrome, cerebrovascular disease, Rasmussen's encephalitis, viral meningitis, neurospsychiatric systemic lupus erythematosus (NPSLE), amyotrophic lateral sclerosis, Creutzfeldt-Jacob disease, Gerstmann-Straussler-Scheinker disease, transmissible spongiform encephalopathy, ischemic reperfusion damage (e.g. stroke), brain trauma, microbial infection, or chronic fatigue syndrome. In some embodiments, the pain comprises fibromyalgia, chronic neuropathic pain, or peripheral neuropathic pain. In some embodiments, the infectious disease comprises a bacterial infection, viral infection, yeast infection, Whipple's Disease, Prion Disease, cirrhosis, methicillin-resistant *Staphylococcus aureus*, HIV, HCV, hepatitis, syphilis, meningitis, malaria, tuberculosis, influenza.

In an aspect, the invention provides a kit comprising at least one reagent for carrying out the methods provided by the invention, including enriching an oligonucleotide library, characterizing a sample or visualizing a sample. In a related aspect, the invention provides use of at least one reagent for carrying out the methods provided by the invention, including enriching an oligonucleotide library, characterizing a sample or visualizing a sample. In some embodiments, the at least one reagent comprises an oligonucleotide or a plurality of oligonucleotides provided herein. Additional useful reagents are also provided herein. See, e.g., the protocols provided in the Examples.

The at least one oligonucleotide or plurality of oligonucleotides provided by tissue ADAPT can be used for various purposes. As described above, such oligonucleotides can be used to characterize and/or visualize a sample. As the oligonucleotides are selected to associate with tissues of interest, such associations can also be used for other purposes. In an aspect, the invention provides a method of imaging at least one cell or tissue, comprising contacting the at least one cell or tissue with at least one oligonucleotide or plurality of oligonucleotides provided herein, and detecting the at least one oligonucleotide or the plurality of oligonucleotides in contact with at least one cell or tissue. In a non-limiting example, such method can be used for medical imaging of a tumor or tissue in a patient.

For example, the at least one oligonucleotide or plurality of oligonucleotides may comprise nucleic acids may have a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. In such cases, the imaging may be, e.g., directed to lung or prostate tissue. See Example 14.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. In such cases, the phenotype may be, e.g., prostate cancer. See Example 17.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. In such cases, the imaging may be, e.g., directed to HER2 status of a cell or tissue. See Example 19.

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. In such cases, the imaging may be, e.g., directed to a HER2 status of a cell or tissue. See Examples 20-22.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. In such cases, the imaging may be, e.g., directed to colorectal cells or tissue. See Example 24.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. In such cases, the imaging may be, e.g., directed to a tissue, including without limitation breast, colon, kidney, lung or pancreatic tissue. See Example 29.

In the imaging methods provided by the invention, the at least one oligonucleotide or the plurality of oligonucleotides can carry various useful chemical structures or modifications such as described herein. Such modifications can be made to enhance binding, stability, allow detection, or for other useful purposes.

In the imaging methods provided by the invention, the at least one oligonucleotide or the plurality of oligonucleotides can be administered to a subject prior to the detecting. Such method may allow imaging of at least one cell or tissue in the subject. In some embodiments, the at least one cell or tissue comprises neoplastic, malignant, tumor, hyperplastic, or dysplastic cells. In some embodiments, the at least one cell or tissue comprises at least one of lymphoma, leukemia, renal carcinoma, sarcoma, hemangiopericytoma, melanoma, abdominal cancer, gastric cancer, colon cancer, cervical cancer, prostate cancer, pancreatic cancer, breast cancer, or non-small cell lung cancer cells. The at least one cell or tissue can be from any desired tissue or related to desired any medicinal condition, disease or disorder such as described herein.

As the oligonucleotides provided by tissue ADAPT are selected to associate with tissues of interest, such associations can also be used in therapeutic applications such as targeted drug delivery. The oligonucleotides may provide therapeutic benefit alone or by providing targeted delivery of immunomodulators, drugs and the like. In an aspect, the invention provides a pharmaceutical composition comprising a therapeutically effective amount of a construct comprising the at least one oligonucleotide or the plurality of oligonucleotides as provided herein, or a salt thereof, and a pharmaceutically acceptable carrier, diluent, or both. In some embodiments, the at least one oligonucleotide or plurality of oligonucleotides associates with one or more protein listed in Table 28.

For example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2922-2926, 2929-2947 and 2950-2952. Such pharmaceutical composition may be useful for therapy related to a cancer, wherein optionally the cancer comprises lung cancer or prostate cancer. See Example 14.

In another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20 or all of SEQ ID NOs. 2953-2961 and 2971-2979. Such pharmaceutical composition may be useful for therapy related to a cancer, wherein optionally the cancer comprises prostate cancer. See Example 17.

In still another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50 or all of SEQ ID NOs. 3039-3061. Such pharmaceutical composition may be useful for therapy related to a cancer, wherein optionally the cancer comprises breast cancer. See Example 19.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000, 150,000 or all of SEQ ID NOs. 3062-103061 and 103062-203061. Such pharmaceutical composition may be useful for therapy related to a cancer, wherein optionally the cancer comprises breast cancer. See Examples 20-22.

In an example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15, 20, 25, 30, 35, 40, 50, 60, 70, 80, 90, 100, 200, 300, 400, 500, 600, 700, 800, 900, 1000, 2000, 3000, 4000 or all of SEQ ID NOs. 203064-203067 and 203076-206478. Such pharmaceutical composition may be useful for therapy related to a cancer, wherein optionally the cancer comprises colorectal cancer. See Example 24.

In yet another example, the at least one oligonucleotide or plurality of oligonucleotides may comprise nucleic acids having a sequence or a portion thereof that is at least 50, 55, 60, 65, 70, 75, 80, 85, 90, 95, 96, 97, 98, 99 or 100 percent homologous to an oligonucleotide sequence according to at least 1, 2, 3, 4, 5, 6, 7, 8, 9, 10, 12, 15 or all of SEQ ID NOs. 206491-206506. Such pharmaceutical composition may be useful for therapy related to a cancer, wherein optionally the cancer comprises a cancer of the breast, colon, kidney, lung or pancreas. See Example 29.

The at least one oligonucleotide or the plurality of oligonucleotides within the pharmaceutical composition can have any useful desired chemical modification. In an embodiment, the at least one oligonucleotide or the plurality of oligonucleotides is attached to a toxin or chemotherapeutic agent. The at least one oligonucleotide or the plurality of oligonucleotides may be comprised within a multipartite construct. The at least one oligonucleotide or the plurality of oligonucleotides can be attached to a liposome or nanoparticle. In some embodiments, the liposome or nanoparticle comprises a toxin or chemotherapeutic agent. In such cases, the at least one oligonucleotide or the plurality of oligonucleotides can be used to target a therapeutic agent to a desired cell, tissue, organ or the like.

In a related aspect, the invention provides a method of treating or ameliorating a disease or disorder in a subject in need thereof, comprising administering the pharmaceutical composition of the invention to the subject. In another related aspect, the invention provides a method of inducing cytotoxicity in a subject, comprising administering the pharmaceutical composition of the invention to the subject. Any useful means of administering can be used, including without limitation at least one of intradermal, intramuscular, intraperitoneal, intravenous, subcutaneous, intranasal, epidural, oral, sublingual, intracerebral, intravaginal, transdermal, rectal, by inhalation, topical administration, or any combination thereof.

The oligonucleotide or plurality of oligonucleotides provided by tissue ADAPT can be used for imaging or therapeutic applications of any desired medical condition, disease or disorder, such as those described herein (see above). As a non-limiting example, the oligonucleotide or plurality of oligonucleotides can be used for imaging of tumors from various anatomical locals, or for treatment of cancers derived from various tissues.

Kits

The invention also provides a kit comprising one or more reagent to carry out the methods of the invention. For example, the one or more reagent can be the one or more aptamer, a buffer, blocker, enzyme, or combination thereof. The one or more reagent may comprise any useful reagents for carrying out the subject methods, including without limitation aptamer libraries, substrates such as microbeads or planar arrays or wells, reagents for biomarker and/or microvesicle isolation (e.g., via chromatography, filtration, ultrafiltration, centrifugation, ultracentrifugation, flow cytometry, affinity capture (e.g., to a planar surface, column or bead), polymer precipitation, and/or using microfluidics), aptamers directed to specific targets, aptamer pools that facilitate detection of a tissue/cell/microvesicle/biomarker population, reagents such as primers for nucleic acid sequencing or amplification, arrays for nucleic acid hybridization, detectable labels, solvents or buffers and the like, various linkers, various assay components, blockers, and the like. The one or more reagent may also comprise various compositions provided by the invention. In an embodiment, the one or more reagent comprises one or more aptamer of the invention. The one or more reagent can comprise a substrate, such as a planar substate, column or bead. The kit can contain instructions to carry out various assays using the one or more reagent. The one or more reagent may comprise a reagent for performing a PHC assay, including components of enzymatic detection systems and substrates thereof useful for staining a tissue sample.

In an embodiment, the kit comprises an oligonucleotide probe or composition provided herein. The kit can be configured to carry out the methods provided herein. For example, the kit can include an aptamer of the invention, a substrate, or both an aptamer of the invention and a substrate.

In an embodiment, the kit is configured to carry out an assay. For example, the kit can contain one or more reagent and instructions for detecting the presence or level of a biological entity in a biological sample. In such cases, the kit can include one or more binding agent to a biological entity of interest. The one or more binding agent can be bound to a substrate. The one or more binding agent can be modified to allow capture, detection or visualization. For example, the one or more binding agent can be biotinylated or conjugated to digoxigenin.

In an embodiment, the kit comprises a set of oligonucleotides that provide a particular oligonucleotide profile for a biological sample. An oligonucleotide profile can include, without limitation, a profile that can be used to characterize a particular disease or disorder. For example, the disease or disorder can be a proliferative disease or disorder, including without limitation a cancer. In some embodiments, the cancer comprises a breast cancer.

EXAMPLES

Example 1: Aptamer Target Identification

In this Example, aptamers conjugated to microspheres are used to assist in determining the target of two aptamers identified by library screening methods as described above. The general approach is shown in FIG. 9. The approach is used to verify the targets of CAR003, an aptamer identified by library screening to recognize EpCAM. CAR003 is an aptamer candidate identified using the above methodology. As an RNA aptamer, CAR003 with alternate tail sequence has the following RNA sequence (SEQ ID NO. 3):

```
5'-auccagagug acgcagcagu cuuuucugau ggacacgugg
uggucuagua ucacuaagcc accgugucca-3'
```

In this approach, the sequence of CAR003 is randomly rearranged before linkage to the microspheres. The microspheres are used as controls to bind to targets that are similar but not identical to the intended target molecule.

The protocol used is as follows:

1) The candidate aptamers (here, CAR003) and negative control aptamers (here, randomly arranged CAR003) are synthesized with modifications to allow capture (here, the aptamers are biotinylated) and crosslinking (here, using the Sulfo-SBED Biotin Label Transfer Reagent and Kit, Catalog Number 33073 from Thermo Fisher Scientific Inc., Rockford, Ill., to allow photocrosslinking).

2) Each of the aptamers is individually mixed with microvesicles having the target of interest (here, BrCa cell line microvesicles).

3) After incubation to allow the aptamers to bind target, ultraviolet light is applied to the mixtures to trigger crosslinking of the aptamers with the microvesicle targets.

4) The microvesicles are lysed, thereby releasing the crosslinked aptamer-target complex into solution.

5) The crosslinked aptamer-target complexes are captured from solution using a streptavidin coated substrate.

6) The crosslinked aptamer-target complexes for each aptamer are run individually on SDS-PAGE gel electrophoresis. The captured protein targets are visualized with Coomasie Blue staining.

7) The crosslinking and binding steps may be promiscuous so that multiple bands including the intended target but also random proteins will appear on each of the gels. The intended target will be found in a band that appears on the gel with the candidate aptamer (here, CAR003) but not the related negative control aptamers (here, randomly arranged CAR003). The bands corresponding to the target are excised from the gel.

8) Mass spectrometry (MS) is used to identify the aptamer target from the excised bands.

Example 2: Disease Diagnosis

This example illustrates the use of oligonucleotide probes of the invention to diagnose a proliferative disease.

A suitable quantity of an oligonucleotide or pool of oligonucleotides that bind a BrCa-derived population of microvesicles, such as identified in Example 12 or various Examples below, is synthesized via chemical means known in the art. The oligonucleotides are conjugated to a diagnostic agent suitable for detection, such as a fluorescent moiety, using a conjugation method known in the art.

The composition is applied to microvesicles isolated from blood samples taken from a test cohort of patients suffering from a proliferative disease associated with the overexpression of microvesicles, e.g. breast cancer. The composition is likewise applied to microvesicles isolated from blood samples taken from a negative control cohort, not suffering from a proliferative disease.

The use of appropriate detection techniques (e.g., microbead assay or flow cytometry) on the test cohort samples indicates the presence of disease, while the same techniques applied to the control cohort samples indicate the absence of disease.

The results show that the oligonucleotides of the present invention are useful in diagnosing proliferative diseases.

Example 3: Theranostics

This example illustrates the use of oligonucleotide probes of the present invention to provide a theranosis for a drug for treating a proliferative disease.

A suitable quantity of an oligonucleotide or pool of oligonucleotides that bind breast cancer tissue, such as identified in Examples 19-21 or various Examples below, is synthesized via chemical means known in the art. The probes are conjugated to an agent suitable for detection, such as a biotin moiety, which can then be detected using streptavidin constructs such as streptavidin-horse radish peroxidase using immunohistochemistry (IHC) techniques. The oligonucleotide probe or panel of oligonucleotide probes are within a suitable composition, such as a buffered solution.

Treatment Selection.

The probes are applied to tumor tissue samples taken from a test cohort of patients suffering from a proliferative disease, e.g. breast cancer, that responded to a certain treatment, e.g., trautuzamab. The probes are likewise applied to tumor tissue taken from a control cohort consisting of patients suffering from the same proliferative disease that did not respond to the treatment. The use of appropriate detection techniques (e.g., IHC) on the test cohort samples indicates that probes which bind the samples are useful for identifying patients that will respond to the treatment, while the same techniques applied to the control cohort samples identifies probes useful for identifying patients that will not respond to the treatment.

Treatment Monitoring.

In another setting, the probes are applied to tumor tissue samples from a test cohort of patients suffering from a proliferative disease, e.g. breast cancer, prior to or during a course of treatment, such as surgery, radiotherapy and/or chemotherapy. The probes are then applied to tumor tissue samples from the patients over a time course. The use of appropriate detection techniques (e.g., IHC) on the test cohort samples indicates whether the detected population of disease-related cells increases, decreases, or remains steady in concentration over time during the course of treatment. An increase in the population of disease-related cells post-treatment may indicate that the treatment is less effective whereas a decrease in the population of disease-related cells post-treatment may indicate that the treatment has a beneficial effect.

The results show that the oligonucleotide probes of the present invention are useful in theranosing proliferative diseases.

Example 4: Therapeutic Oligonucleotide Probes

This example illustrates the use of oligonucleotide probes of the present invention to treat a proliferative disease.

A suitable quantity of an oligonucleotide or pool of oligonucleotides that bind breast cancer tumor tissue, such as identified in Examples 19-21 or various Examples below, is synthesized via chemical means known in the art. The oligonucleotides are conjugated to a chemotherapeutic agent, such as Doxil, using a conjugation method known in the art. The conjugate is formulated in an aqueous composition.

The composition is administered intravenously, in one or more doses, to a test cohort of subjects suffering from breast cancer. A control cohort suffering from breast cancer is administered a placebo intravenously, according to a corresponding dosage regimen.

Pathological analysis of tumor samples and/or survival indicates that mortality and/or morbidity are improved in the test cohort over the control cohort.

The results show that the oligonucleotides of the present invention are useful in treating proliferative diseases.

Example 5: Oligonucleotide—Sequencing Detection Method

This example illustrates the use of an oligonucleotide pool to detect microvesicles that are indicative of a phenotype of interest. The method makes use of a pool of oligonucleotides that have been enriched against a target of interest that is indicative of a phenotype of interest. The method in this Example allows efficient use of a library of oligonucleotides to preferentially recognize a target entity.

For purposes of illustration, the method is described in the Example with a microvesicle target from a bodily fluid sample. One of skill will appreciate that the method can be extended to other types of target entity (e.g., cells, proteins, various other biological complexes), sample (e.g., tissue, cell culture, biopsy, other bodily fluids) and other phenotypes (other cancers, other diseases, etc) by enriching an aptamer library against the desired input samples.

General Workflow:

1) Obtain sample (plasma, serum, urine or any other biological sample) of patients with unknown medical etymology and pre-treating them accordingly to ensure availability of the target of interest (see below). Where the target of interest is a microvesicle population, the microvesicles can be isolated and optionally tethered to a solid support such as a microbead.

2) Expose pre-treated sample to an oligonucleotide pool carrying certain specificity against target of interest. As described herein, an oligonucleotide pool carrying certain specificity against the target of interest can be enriched using various selection schemes, e.g., using non-cancer microvesicles for negative selection and cancer microvesicles for positive selection as described above. DNA or RNA oligonucleotides can be used as desired.

3) Contact oligonucleotide library with the sample.

4) Elute any oligonucleotides bound to the target.

5) Sequence the eluted oligonucleotides. Next generation sequencing methods can be used.

6) Analyze oligonucleotide profile from the sequencing. A profile of oligonucleotides known to bind the target of interest indicates the presence of the target within the input sample. The profile can be used to characterize the sample, e.g., as cancer or non-cancer.

Protocol Variations:

Various configurations of the assay can be performed. Four exemplary protocols are presented for the purposes of the oligonucleotide-sequencing assay. Samples can be any appropriate biological sample. The protocols can be modified as desired. For example, the microvesicles can be isolated using alternate techniques instead or or in addition to ultracentrifugation. Such techniques can be disclosed herein, e.g., polymer precipitation (e.g., PEG), column chromatography, and/or affinity isolation.

Protocol 1:

Ultracentrifugation of 1-5 ml bodily fluid samples (e.g., plasma/serum/urine) (120K×g, no sucrose) with two washes of the precipitate to isolate microvesicles.

Measure total protein concentration of recovered sample containing the isolated microvesicles.

Conjugate the isolated microvesicles to magnetic beads (for example MagPlex beads (Luminex Corp. Austin Tex.)).

Incubate conjugated microvesicles with oligonucleotide pool of interest.

Wash unbound oligonucleotides by retaining beads using magnet.

Elute oligonucleotides bound to the microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 2:

This alternate protocol does not include a microvesicle isolation step, microvesicles conjugation to the beads, or separate partitioning step. This may present non-specific binding of the oligonucleotides against the input sample.

Remove cells/debris from bodily fluid sample and dilute sample with PBS containing $MgCl_2$ (2 mM).

Pre-mix sample prepared above with oligonucleotide library.

Ultracentrifugation of oligonucleotide/sample mixture (120K×g, no sucrose). Wash precipitated microvesicles.

Recover precipitate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 3:

This protocol uses filtration instead of ultracentrifugation and should require less time and sample volume.

Remove cells/debris from bodily fluid sample and dilute it with PBS containing $MgCl_2$(2 mM).

Pre-mix sample prepared above with oligonucleotide library.

Load sample into filter (i.e., 150K or 300K MWCO filter or any other that can eliminate unbound or unwanted oligonucleotides). Centrifuge sample to concentrate. Concentrated sample should contain microvesicles.

Wash concentrate. Variant 1: Dilute concentrate with buffer specified above to the original volume and repeat centrifugation. Variant 2: Dilute concentrate with buffer specified above to the original volume and transfer concentrate to new filter unit and centrifuge. Repeat twice.

Recover concentrate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

Protocol 4:

Ultracentrifugation of 1-5 ml bodily fluid sample (120K×g, no sucrose) with 2 washes of the precipitate to isolate microvesicles.

Pre-mix microvesicles with oligonucleotide pool.

Load sample into 300K MWCO filter unite and centrifuge (2000×g). Concentration rate is ~3×.

Wash concentrate. Variant 1: Dilute concentrate with buffer specified above to the original volume and centrifuge. Repeat twice. Variant 2: Dilute concentrate with buffer specified above to the original volume and transfer concentrate to new filter unit and centrifuge. Repeat twice Recover concentrate and elute oligonucleotides bound to microvesicles.

Amplify and purify the eluted oligonucleotides.

Oligonucleotide sequencing (for example, Next generation methods; Ion Torrent: fusion PCR, emulsion PCR, sequencing).

Assess oligonucleotide profile.

In alterations of the above protocols, polymer precipitation is used to isolate microvesicles from the patient samples. For example, the oligonucleotides are added to the sample and then PEG4000 or PEG8000 at 4% or 8% concentration is used to precipitate and thereby isolate microvesicles. Elution, recovery and sequence analysis continues as above.

Example 6: Plasma/Serum Probing with an Oligonucleotide Probe Library

The following protocol is used to probe a plasma or serum sample using an oligonucleotide probe library.

Input Oligonucleotide Library:

Use 2 ng input of oligonucleotide library per sample.

Input oligonucleotide library is a mixture of two libraries, cancer and non-cancer enriched, concentration is 16.3 ng/ul.

Dilute to 0.2 ng/ul working stock using Aptamer Buffer (3 mM $MgCl_2$ in 1×PBS)

Add 10 ul from working stock (equal to 2 ng library) to each optiseal tube

Materials:

PBS, Hyclone SH30256.01, LN: AYG165629, bottle #8237, exp. July 2015

Round Bottom Centrifuge Tubes, Beckman 326820, LN:P91207

OptiSeal Centrifuge tubes and plugs, polyallomer Konical, Beckman 361621, lot # Z10804SCA Ultracentrifuge rotor: 50.4 TI Ultracentrifuge rotor: 50.4 TI, Beckman Caris ID #0478

Protocol:

1 Pre-chill tabletop centrifuge, ultracentrifuge, buckets, and rotor at 4° C.

2 Thaw plasma or serum samples

3 Dilute 1 ml of samples with 1:2 with Aptamer Buffer (3 mM $MgCl_2$ in 1×PBS)

4 Spin at 2000×g, 30 min, 4° C. to remove debris (tabletop centrifuge)

5 Transfer supernatants for all samples to a round bottom conical

6 Spin at 12,000×g, 45 min, 4° C. in ultracentrifuge to remove additional debris.

7 Transfer supernatant about 1.8 ml for all samples into new OptiSeal bell top tubes (uniquely marked).

8 Add 2 ng (in 10 ul) of DNA Probing library to each optiseal tube

9 QS to 4.5 ml with Aptamer Buffer

10 Fix caps onto the OptiSeal bell top tubes

11 Apply Parafilm around caps to prevent leakage

12 Incubate plasma and oligonucleotide probe library for 1 hour at room temperature with rotation 13 Remove parafilm (but not caps)

14 Place correct spacer on top of each plugged tube

15 Mark pellet area on the tubes, insure this marking is facing outwards from center.

16 Spin tubes at 120,000×g, 2 hr, 4° C. (inner row, 33,400 rpm) to pellet microvesicles.

17 Check marking is still pointed away from center.

18 Completely remove supernatant from pellet, by collecting liquid from opposite side of pellet marker and using a 10 ml syringe barrel and 21G2 needle 19 Discard supernatant in appropriate biohazard waste container Add 1 ml of 3 mM MgCl2 diluted with 1×PBS Gentle vortex, 1600 rpm for 5 sec and incubate 5 min at RT.

22 QS to ~4.5 mL with 3 mM Mg Cl2 diluted with 1×PBS

23 Fix caps onto the OptiSeal bell top tubes.

24 Place correct spacer on top of each plugged tube.

25 Mark pellet area on the tubes, insure this marking is facing outwards from center.

26 Spin tubes at 120,000×g, 70 min, 4° C. (inner row 33,400 rpm) to pellet microvesicles 27 Check marking in still pointed away from center.

28 Completely remove supernatant from pellet, by collecting liquid from opposite side of pellet marker and using a 10 ml syringe barrel and 21G2 needle 29 Discard supernatant in appropriate biohazard waste container 30 Add 1 ml of 3 mM MgCl2 diluted with 1×PBS 31 Gentle vortex, 1600 rpm for 5 sec and incubate 5 min at RT.

32 QS to ~4.5 mL with 3 mM Mg Cl2 diluted with 1×PBS

33 Fix caps onto the OptiSeal bell top tubes.

34 Place correct spacer on top of each plugged tube.

35 Mark pellet area on the tubes, insure this marking is facing outwards from center.

36 Spin tubes at 120,000×g, 70 min, 4° C. (inner row 33,400 rpm) to pellet microvesicles 37 Check marking is still pointed away from center.

38 Save an aliquot of the supernatant (100 ul into a 1.5 ml tube)

39 Completely remove supernatant from pellet, by collecting liquid from opposite side of pellet marker and using a 10 ml syringe barrel and 21G2 needle 40 Add 50 ul of Rnase-free water to the side of the pellet 41 Leave for 15 min incubation on bench top 42 Cut top off tubes using clean scissors.

43 Resuspend pellet, pipette up and down on the pellet side

44 Measure the volume, make a note on the volume in order to normalize all samples 45 Transfer the measured resuspended eluted microvesicles with bound oligonucleotides to a Rnase free 1.5 ml Eppendorf tube 46 Normalize all samples to 100 ul to keep it even across samples and between experiments.

Next Generation Sequencing Sample Preparation:

I) Use 50 ul of sample from above, resuspended in 100 ul H2O and containing microvesicle/oligo complexes, as template in Transposon PCR, 14 cycles.

II) AMPure transposon PCR product, use entire recovery for indexing PCR, 10 cycles.

III) Check indexing PCR product on gel, proceed with AMPure if band is visible. Add 3 cycles if band is invisible, check on gel. After purification quantify product with QuBit and proceed with denaturing and diluting for loading on HiSeq flow cell (Illumina Inc., San Diego, Calif.).

IV) 5 samples will be multiplexed per one flow cell. 10 samples per HiSeq.

Example 7: Oligonucleotide Probe Library

This Example presents development of an oligonucleotide probe library to detect biological entities. In this Example, steps were taken to reduce the presence of double stranded oligonucleotides (dsDNA) when probing the patient samples. The data were also generated comparing the effects of 8% and 6% PEG used to precipitate microvesicles (and potentially other biological entities) from the patient samples.

Protocol:

1) Pre-chill tabletop centrifuge at 4° C.

2) Protease inhibition: dissolve 2 tablets of "cOmplete ULTRA MINI EDTA-free EASYpack" protease inhibitor in 1100 ul of $H_2O$ (20× stock of protease inhibitor).

3) Add 50 ul of protease inhibitor to the sample (on top of frozen plasma) and start thawing: 1 ml total ea.

4) To remove cells/debris, spin samples at 10,000×g, 20 min, 4° C. Collect 1 ml supernatant (SN).

5) Mix 1 ml supernatant from step 4 with 1 ml of 2×PBS 6 mM MgCl₃, collect 400 ul into 3 tubes (replicates A, B, C) and use it in step 6.

6) Add competitor per Table 5: make dilutions in 1×PBS, 3 mM MgCl₂, mix well, pour into trough, pipet using multichannel.

TABLE 5

Competitors

| units | Type of Competitor | Stock Concentration | Intermediate stock concentration | Number of samples | Volume from stock to make intermediate stock, ul | Buffer to make intermediate stock | Final Volume, ul | Final Concentration |
|---|---|---|---|---|---|---|---|---|
| ng/ul | Salmon DNA | — | 40 | — | — | — | 425.5 | 0.8 |
| ng/ul | tRNA | — | 40 | — | — | — | 425.5 | 0.8 |
| x | S1 | 20 | 0.5 | 280 | 65.5 | 2555.6 | 425.5 | 0.01 |

7) Incubate for 10 min, RT, end-over-end rotation

Pool of 6-3S and 8-3S oligonucleotide probing libraries is ready: 2.76 ng/ul (~185 ng). Save pool stock and dilutions. New pool can be made by mixing 171.2 ul (500 ng) of library 6-3S (2.92 ng/ul) with 190.8 ul (500 ng) of library 8-3S (2.62 ng/ul). Aliquot pooled library into 30 ul and store at −80 C.

Add ssDNA oligonucleotide probing library to the final concentration 2.5 pg/ul for binding. Make dilutions in 1×PBS, 3 mM MgCl₂.

TABLE 6

Probe library calculations

| Original stock, ng/ul | Lib Name | Required working stock (ng/ul) | ul from original stock to make working | ul of buffer to make working | Final volume, ul | Number of samples | Volume per sample from working stock | Final concentration (pg/ul) |
|---|---|---|---|---|---|---|---|---|
| 2.76 | Pooled library 6-3S/8-3S | 0.1 | 26.1 | 694.1 | 720.2 | 60 | 10.9 | 2.5 |

8) Binding: Incubate for 1 h at RT with rotation.

9) Prepare polymer solution: 20% PEG8000 in 1×PBS 3 mM MgCl2 (dilute 40% PEG8000 with 2×PBS with 6 mM MgCl2). Add 20% PEG8000 to sample to the final concentration 6%. Invert few times to mix, incubate for 15 min at 4 C

TABLE 7

PEG calculations

| PEG MW | PEG stock, % | Final conc., % | Final volume, ul | Volume 20% PEG to add, ul | Volume of buffer to adjust final volume, ul | Sample volume before adding PEG | Total samples | Total 20% PEG needed, ml |
|---|---|---|---|---|---|---|---|---|
| 8000 | 20 | 6 | 622.8 | 186.9 | −0.4 | 436.4 | 60 | 11.2 |

10) Spin at 10,000×g for 5 min, RT.

11) Remove SN, add 1 ml 1×PBS, 3 mM MgCl2 and wash pellet by gentle inversion with 1 ml aptamer buffer.

12) Remove buffer, Re-suspend pellets in 100 ul H2O: incubate at RT for 10 min on mixmate 900 rpm to re-suspend.

13) Make sure each sample is re-suspended by pipetting after step 13. Make notes on hardly re-suspendable samples.

14) 50 ul of re-suspended sample to indexing PCR→next generation sequencing (NGS).

15) Keep leftover at 4 C

Technical Validation:

The current protocol was tested versus a protocol using 8% PEG8000 to precipitate microvesicles. The current protocol further comprises steps to reduce dsDNA in the oligonucleotide probing libraries.

Figure 5A:
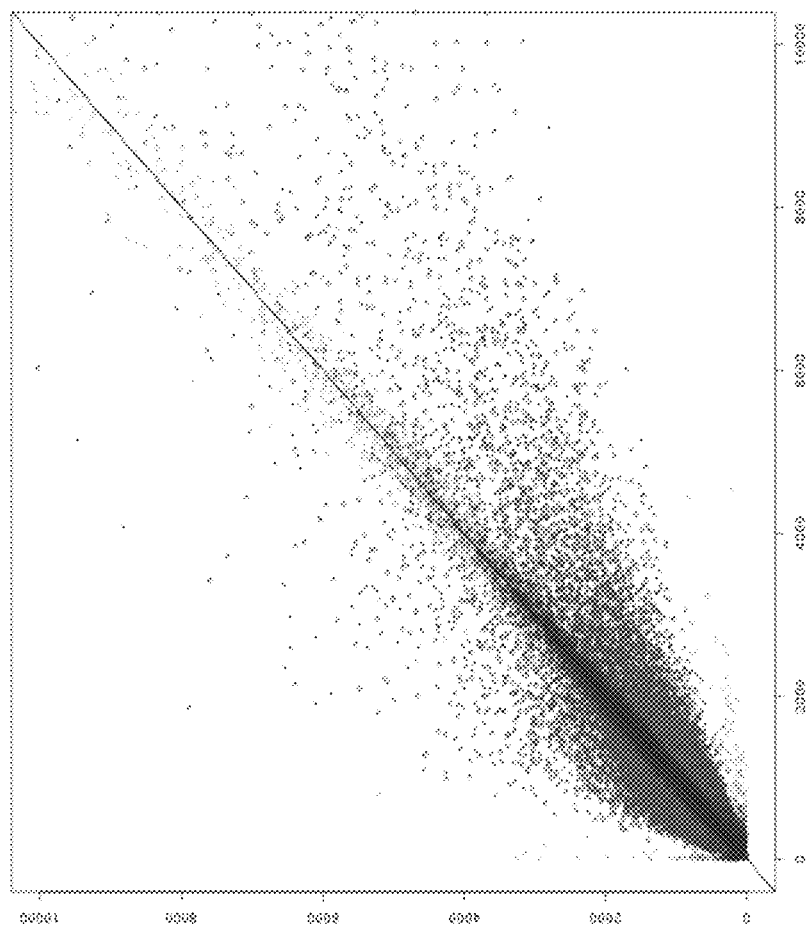

FIG. 5A shows the within sample variance (black) between binding replicates and the between sample variance (grey). Black is on top of grey, thus any observable grey oligo is informative about differences in the biology of two patient samples. This evaluation of Sources of Variance shows that the technical variances is significantly smaller than the biological variance.

Figure 5B:
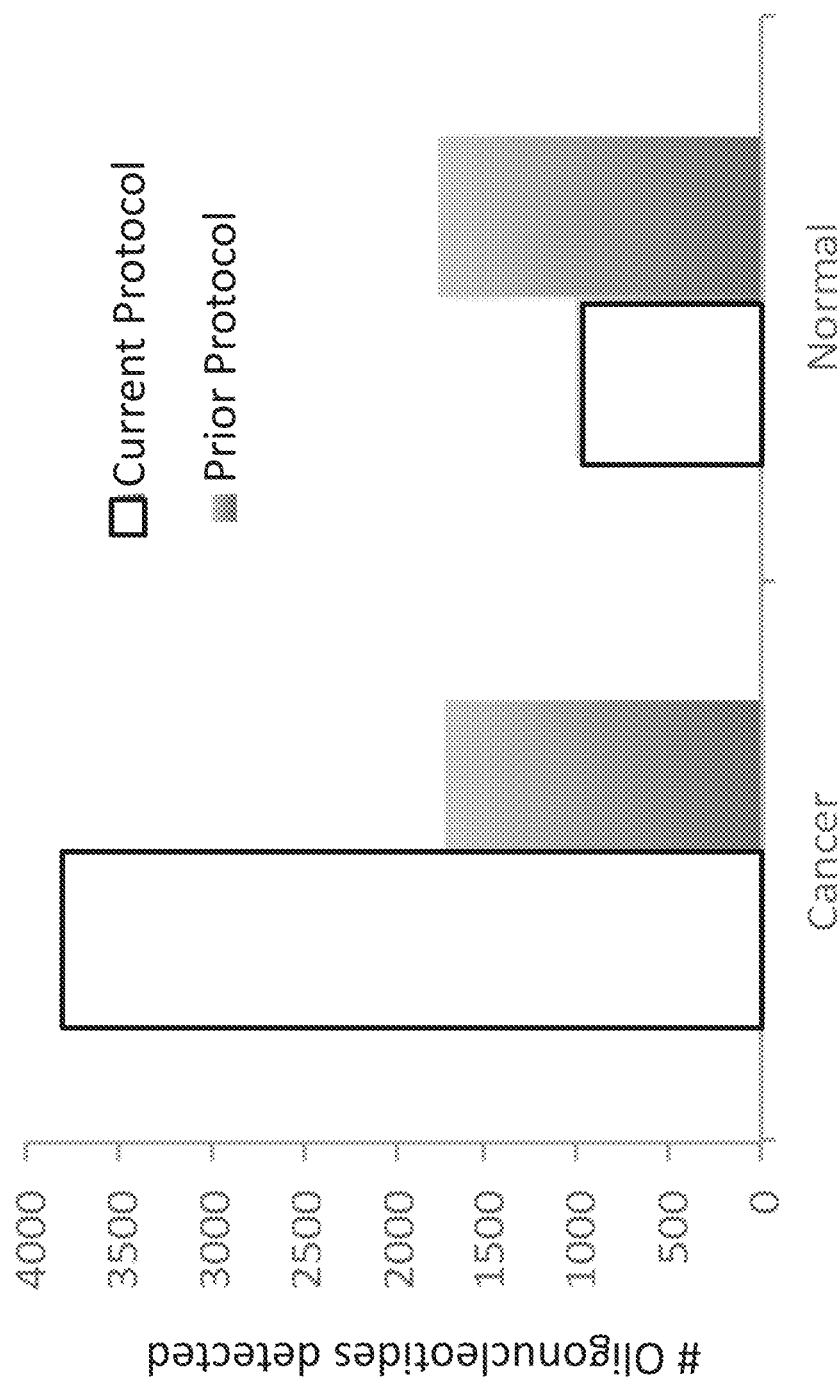

FIG. 5B shows the impact of using a higher proportion of single stranded DNA and PEG 6% isolation (white bars) compared to when there is a higher amount of double stranded DNA and 8% PEG (grey). This data indicates that the protocol in this Example improves biological separation between patients.

The plots in FIG. 5C show the difference between an earlier protocol (PEG 8% with increased dsDNA) and a modified protocol of the Example (PEG 6% no dsDNA).

The black is the scatter between replicates (independent binding events) and the grey is the difference between patients. This data shows that the signal to noise increased significantly using the newer protocol.

Patient Testing:

The protocol above was used to test patient samples having the following characteristics:

TABLE 8

Patient characteristics

| Sample Type | Description |
|---|---|
| Cancer | Mixed type carcinoma; Malignant; |
| Cancer | Invasive, predominant intraductal component (8500/3) |
| Cancer | Fibrocystic Changes; Invasive lobular carcinoma - 8520/3; Lobular carcinoma in situ - 8520/2; Benign; In situ and grade 3 intraepith; Malignant; Fat necrosis, periductal inflammation, malignant cellsFat necrosis; Inflammation; Benign; |
| Cancer | Invasive, predominant intraductal component (8500/3) |
| Cancer | Mucinous (colloid) adenocarcinoma (8480/3) |
| Cancer | Invasive lobular carcinoma - 8520/3; Microcalcifications; Benign; Malignant; |
| Cancer | Otherfibrocystic changeInvasive, NOS (8500/3) |
| Cancer | Invasive ductal carcinoma, not otherwise specified (NOS) - 8500/3; Malignant; |
| Cancer | Invasive ductal carcinoma, not otherwise specified (NOS) - 8500/3; Malignant; |
| Cancer | Intraductal carcinoma, non-infiltrating, NOS (in situ) (8500/2) |
| Cancer | Atypical lobular hyperplasia Otherfibrocystic changes, inter and intralobular fibrosis, apocrine metaplasia, columnar cell change, microcalcificationsInvasive, NOS (8500/3) |
| Cancer | FibroadenomaInvasive, NOS (8500/3) |
| Cancer | Ductal carcinoma in situ - 8500/2; Invasive ductal carcinoma, not otherwise specified (NOS) - 8500/3; Microcalcifications; Benign; In situ and grade 3 intraepith; Malignant; |
| Cancer | Ductal carcinoma in situ - 8500/2; Invasive lobular carcinoma - 8520/3; Lobular carcinoma in situ - 8520/2; In situ and grade 3 intraepith; Malignant; |
| Cancer | Ductal carcinoma in situ - 8500/2; Invasive ductal carcinoma, not otherwise specified (NOS) - 8500/3; Microcalcifications; Benign; In situ and grade 3 intraepith; Malignant; Focal Micropapillary Features, invasive ductal carcinoma with micropapillary features, invasive ductal carcinoma with mucinous and micropapillary featInvasive ductal carcinoma with micropapillary and mucinous features; Invasive micropapillary carcinoma - 8507/3; Malignant; |
| Cancer | Invasive, predominant intraductal component (8500/3) |
| Cancer | Invasive ductal carcinoma, not otherwise specified (NOS) - 8500/3; Malignant; |
| Cancer | Invasive, NOS (8500/3) |
| Cancer | Infiltrating duct and lobular carcinoma (8522/3) |
| Cancer | Invasive, predominant in situ component (8522/3) |
| Non-Cancer | Otherusual ductal hyperplasia, apocrine metaplasia, microcysts, elastosis |
| Non-Cancer | Otherstromal fibrosis, fibrous cyst wall |
| Non-Cancer | Otherfibrocystic change, stromal fibrosis, cyst formation, microcalcifications, apocrine metaplasia, sclerosing adenosis, usual ductal hyperplasia |
| Non-Cancer | Otherfibrocystic changes, apocrine metaplasia, cystic change, usual ductal hyperplasia |
| Non-Cancer | Otherfibrocystic change, microcalcifications |
| Non-Cancer | Fibroadenoma |
| Non-Cancer | Otherintraductal papilloma, sclerosis, microcalcifications, stromal fibrosis |
| Non-Cancer | Fibroadenoma |
| Non-Cancer | Otherfat necrosis |
| Non-Cancer | Otherstromal fibrosis, microcalcifications |
| Non-Cancer | Otherfibrocystic change, microcystic change, focal secretory features |
| Non-Cancer | Otherstromal fibrosis |
| Non-Cancer | Fibroadenoma Otheradenosis, columnar cell change/hyperplasia, usual ductal hyperplasia |
| Non-Cancer | OtherFNA - insufficient material for diagnosis |
| Non-Cancer | Otherintraductal papilloma |
| Non-Cancer | Otherfibrocystic changes, duct ectasia, usual ductal hyperplasia, apocrine metaplasia, microcalcifications |

Microvesicles (and potentially other biological entities) were precipitated in blood (plasma) samples from the above patients using polymer precipitation with PEG as indicated above. The protocol was used to probe the samples with the oligonucleotide probe libraries. Sequences that bound the PEG precipitated samples were identified using next generation sequencing (NGS).

Figure 5D:
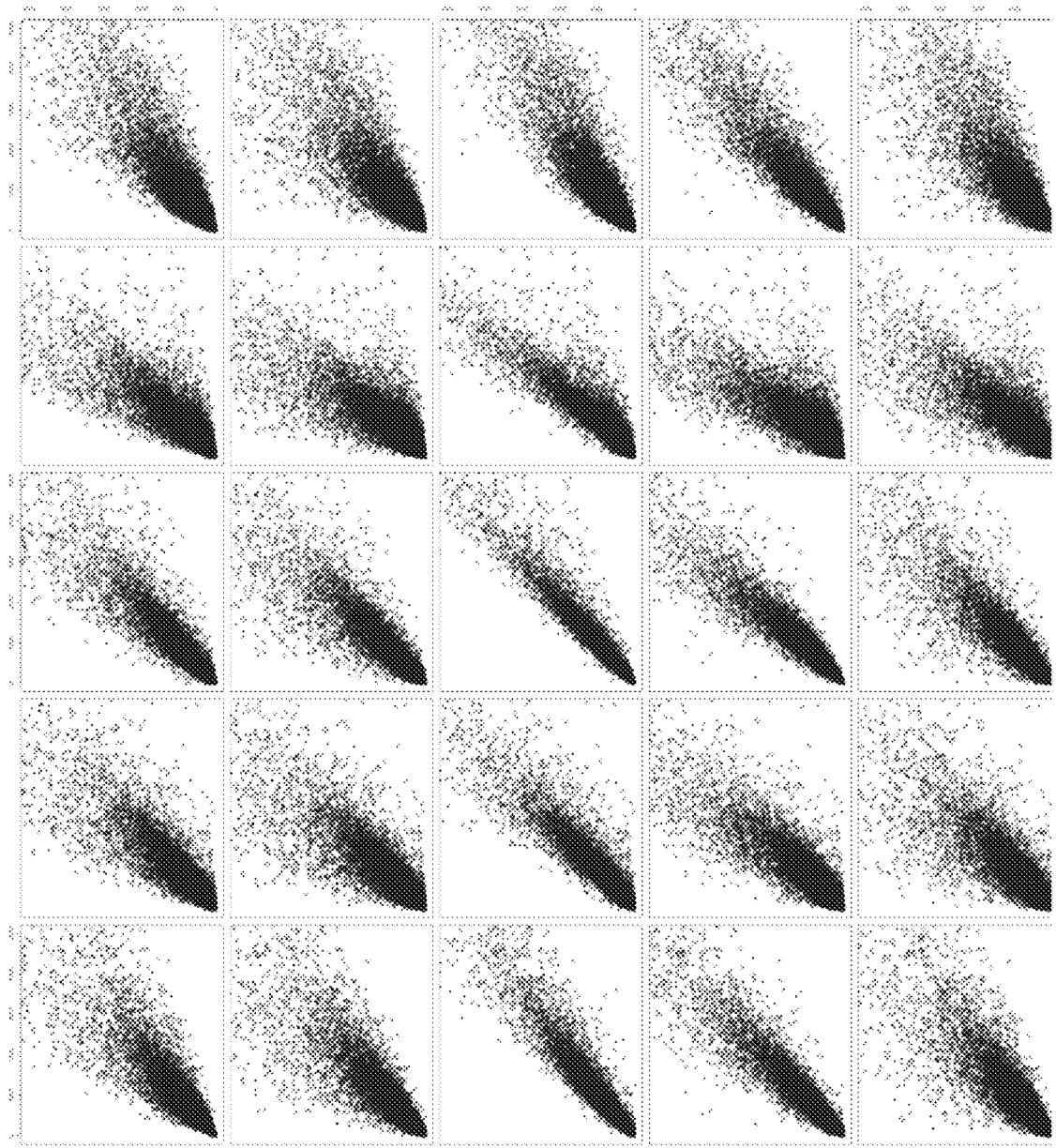

FIG. 5D shows scatter plots of a selection of results from testing the 40 patients listed previously. The spread in the data indicates that large numbers of oligos were detected that differed between samples. The number of significant oligos found is much greater than would be expected randomly as shown in Table 9. The table shows the number of oligonucleotides sorted by copy number detected and p-value. The d-# indicates the number copies of a sequence observed for the data in the rows.

TABLE 9

Expected versus observed sequences

| | Total Number | P-0.1 | P-0.05 | P-0.01 | P-0.005 |
|---|---|---|---|---|---|
| d-50 | 83,632 | 47,020 | 30,843 | 5,934 | 2,471 |
| d-100 | 52,647 | 29,106 | 19,446 | 3,893 | 1,615 |
| d-200 | 28,753 | 14,681 | 9,880 | 2,189 | 914 |
| d-500 | 10,155 | 4,342 | 2,927 | 725 | 315 |

TABLE 9-continued

Expected versus observed sequences

| | Total Number | P-0.1 | P-0.05 | P-0.01 | P-0.005 |
|---|---|---|---|---|---|
| d-50 | 100.0% | 56.2% | 36.9% | 7.1% | 3.0% |
| d-100 | 100.0% | 55.3% | 36.9% | 7.4% | 3.1% |
| d-200 | 100.0% | 51.1% | 34.4% | 7.6% | 3.2% |
| d-500 | 100.0% | 42.8% | 28.8% | 7.1% | 3.1% |
| Maximum expected | | 10.0% | 5.0% | 1.0% | 0.5% |

As a control, the cancer and non-cancer samples were randomly divided into two groups. Such randomization of the samples significantly reduced the number of oligos found that differentiate between sample groups. Indeed, there was a 50-fold increase in informative oligos between the cancer/non-cancer grouping versus random grouping. FIG. 5E shows data as in Table 9 and indicates the number of observed informative oligos between the indicated sample groups.

Figure 5F:
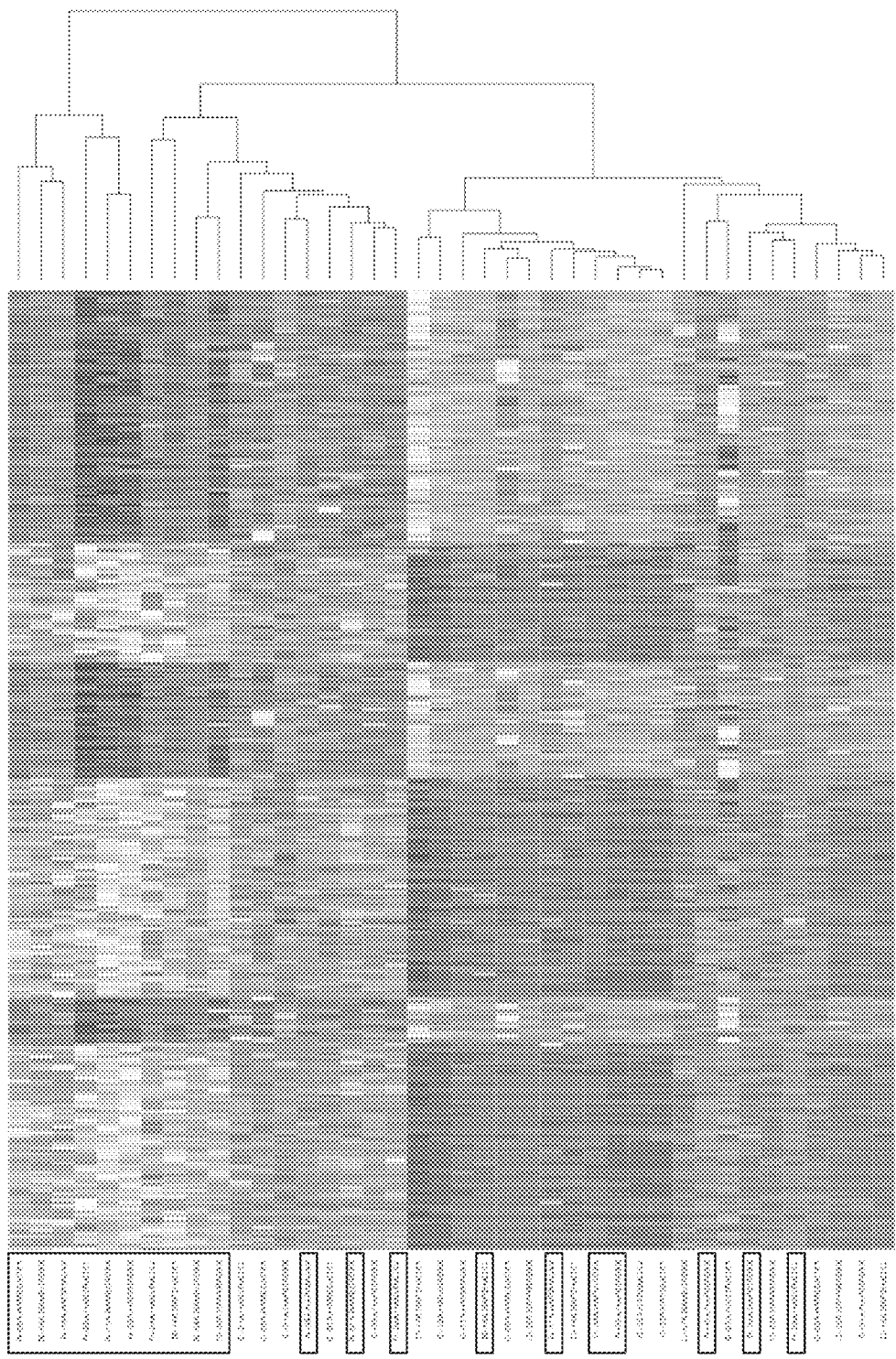
Figure 5G:
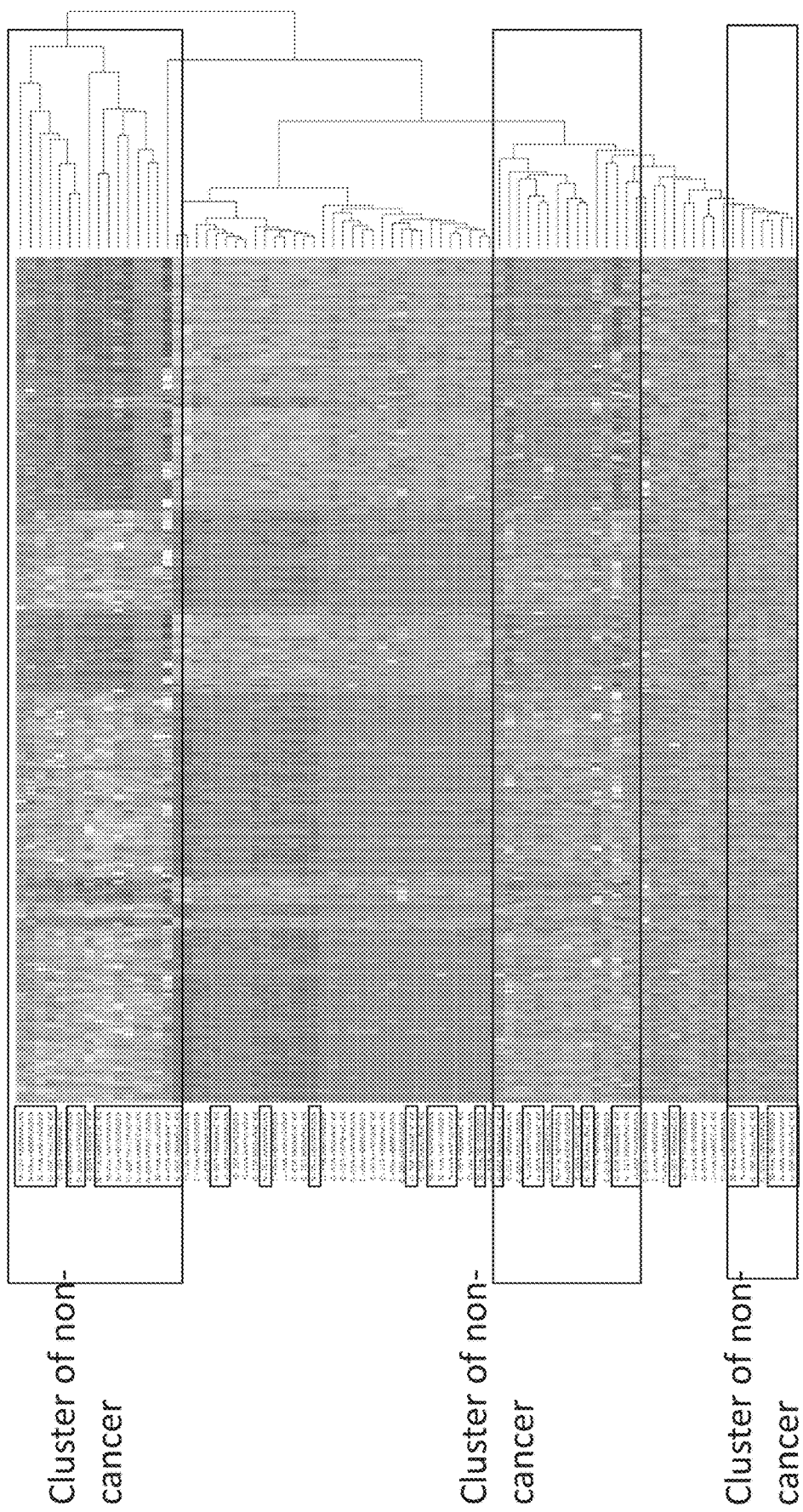

FIG. 5F shows distinct groups of oligos that differentiate between cancer and non-cancer samples. The figure shows a heatmap of the 40 samples tested with oligos selected that had more than 500 copies and p-value less than 0.005. There are clear subpopulations emerging with a distinct non-cancer cohort at the top. The non-cancer samples have boxes around them on the left axis. FIG. 5G is similar and shows results with an additional 20 cancer and 20 non-cancer samples. As shown, analysis with the 80 samples provides the emergence of more distinct and larger clusters.

The data for the additional 80 samples was also used to compare the consistency of informative oligos identified in different screening experiments. Of the 315 informative oligos identified using the first set of 40 patients, 86% of them showed fold-change in a consistent manner when tested on the independent set of 40 patients.

Example 8: Enrichment of Oligonucleotide Probes Using a Balanced Library Design

In this Example, a naïve ADAPT oligonucleotide library was screened to enrich oligonucleotides that identify microvesicles circulating in the blood of breast cancer patients and microvesicles circulating in the blood of healthy, control individuals (i.e., without breast cancer). The input library was the naïve F-TRin-35n-B 8-3s library, which comprises a 5' region (5' CTAGCATGACTGCAG-TACGT (SEQ ID NO. 4)) followed by the random naïve aptamer sequences of 35 nucleotides and a 3' region (5' CTGTCTCTTATACACATCTGACGCTGCCGACGA (SEQ ID NO. 5)). The "balanced" design is described in Example 23 of Int'l Patent Publication WO/2015/031694 (Appl. No. PCT/US2014/053306, filed Aug. 28, 2014), which is incorporated by reference herein in its entirety. The working library comprised approximately $2 \times 10^{13}$ synthetic oligonucleotide sequences. The naïve library may be referred to as the "L0 Library" herein.

Figure 12A:
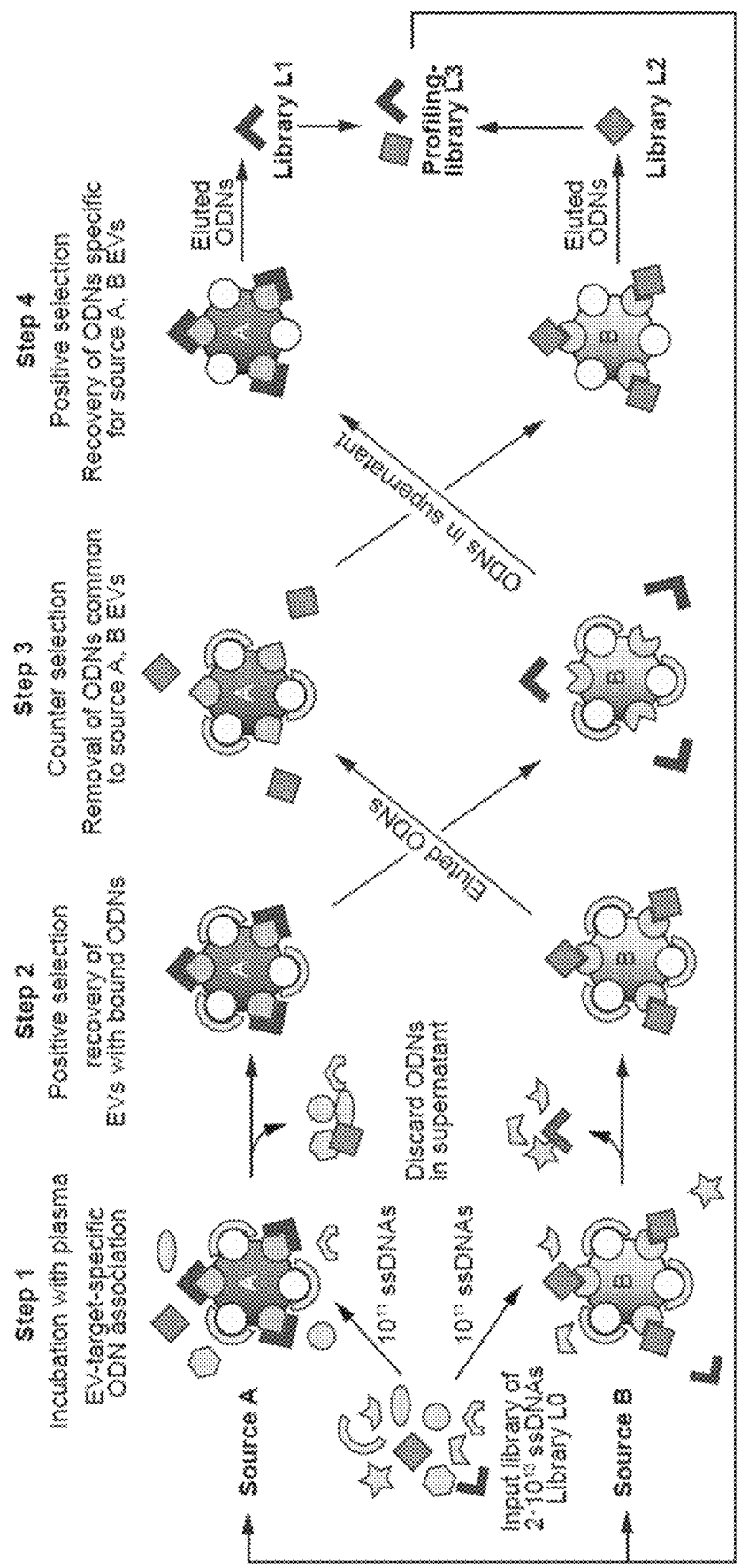
FIGS. 12A-C illustrate enriching a naïve oligonucleotide library with balanced design for oligonucleotides that differentiate between breast cancer and non-cancer microvesicles derived from plasma samples.

The L0 Library was enriched against fractionated plasma samples from breast cancer patients and from healthy (non-breast cancer) controls using the protocol shown in FIG. 12A. In Step 1, an aliquot of approximately $10^{11}$ sequences of PCR-amplified L0 was incubated with pooled blood-plasma from 59 breast cancer patients with positive biopsy (represented by "Source A" in FIG. 12A). In parallel, another aliquot of $10^{11}$ sequences was incubated with pooled blood-plasma from 30 patients with suspected breast cancer who proved negative on biopsy and 30 self declared healthy women (represented by "Source B" in FIG. 12A). In Step 2, microvesicles (extracellular vesicles, "EV") were precipitated using ultracentrifugation (UC) from both L0-samples. The EV-associated oligodeoxynucleotides (ODNs) were recovered from the respective pellets. In Step 3, a counter-selection step (Step 3) was carried out by incubation of each enriched library with plasma from the different cohorts to drive the selection pressure towards enrichment of ODNs specifically associated with each sample cohort. In this step, sequences contained in the EV pellets were discarded. In Step 4, a second positive selection was performed. In this step, the sequences contained in the respective supernatants (sn) from Step 3 were mixed with plasma from another aliquot of each positive control sample-population, and EVs were again isolated. EV-associated ODNs were recovered, representing two single-round libraries called library L1 for positive enrichment of cancer (positive biopsy) patients, and library L2 for the positive enrichment against control patients. In a final step, L1 and L2 were amplified by PCR, reverted to single stranded DNA (ssDNA), and mixed to yield library L3.

This enrichment scheme was iterated two times more using L3 as the input to further reduce the complexity of the profiling library to approximately $10^6$ different sequences. In Step 2, UC was used for partitioning of microvesicles, which may increase the specificity for the EV fraction. In Steps 3 and 4, partitioning was performed using PEG-precipitation. This procedure enriches for ODNs specific for each biological source. Library L3 contains those ODNs that are associated with targets characteristic for EV-populations from both sources, i.e. ODNs acting as aptamers that bind to molecules preferentially expressed in each source. A total of biopsy-positive (n=59), biopsy-negative (n=30), and self-declared normal (n=30) were used in the first round of L3 enrichment, while only the cancer and non-cancer samples were used in the subsequent rounds.

Figure 12C:
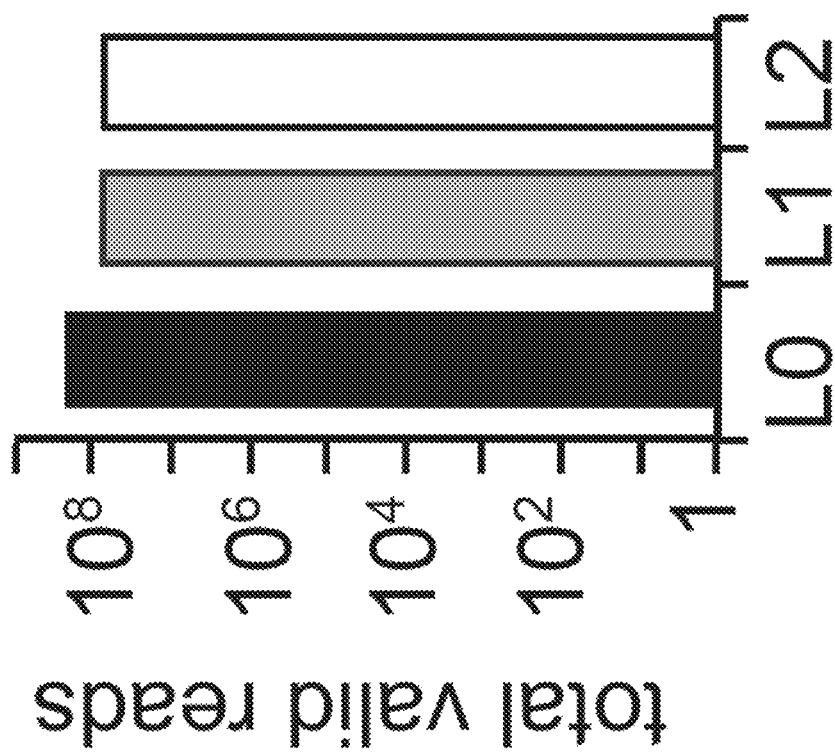
Figure 12B:
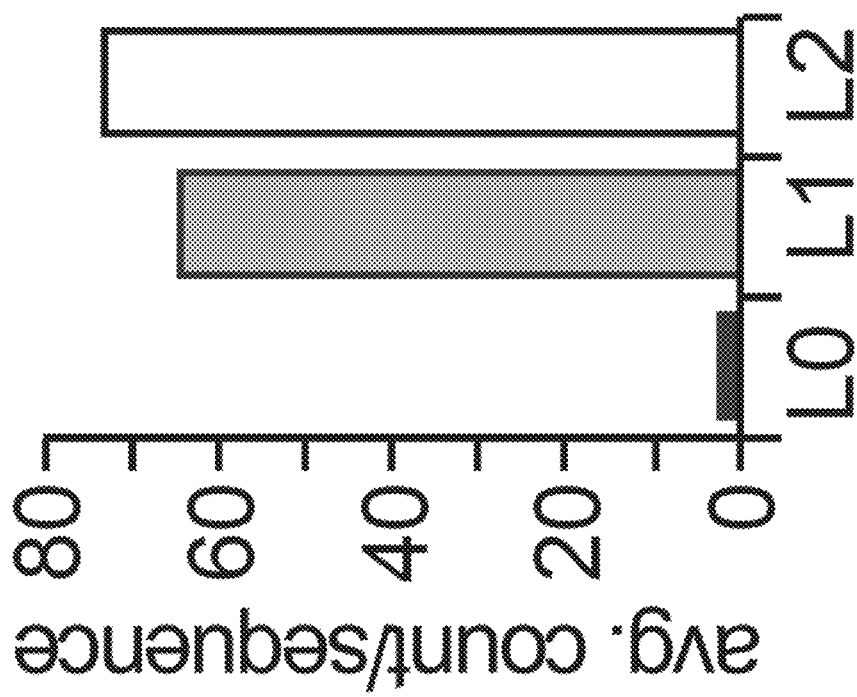

The enriched libraries were characterized using next-generation-sequencing (NGS) to measure copy numbers of sequences contained in each profiling library. NGS of L0 shows that the vast majority of sequences existed in low copy numbers, whereas libraries L1 and L2 showed significantly higher average counts per sequence (FIG. 12B) and a reduced amount of different sequences, with unaltered total valid reads, (FIG. 12C) consistent with an enrichment process.

Example 9: Analysis of ADAPT-Identified Biomarkers

As described herein, e.g., in the section entitled "Aptamer Target Identification," an unknown target recognized by an aptamer can be identified. In this Example, an oligonucleotide probe library (also referred to as Adaptive Dynamic Artificial Poly-ligand Targeting (ADAPT) libraries or Topographical Oligonucleotide Probe "TOP" libraries) was developed as described here and targets of the screened oligonucleotides were determined. This Example used a ADAPT library generated by enriching microvesicles collected from the blood of breast cancer patients and normal controls (i.e., non-cancer individuals). The enrichment protocols are described herein in Example 8.

Materials & Methods

SBED Library Conjugation

A naïve F-TRin-35n-B 8-3s library was enriched against microvesicles from normal female plasma. The naïve unenriched library comprised a 5' region (5' CTAGCATGACT-GCAGTACGT (SEQ ID NO. 4)) followed by the random naïve aptamer sequences of 35 nucleotides and a 3' region (5' CTGTCTCTTATACACATCTGACGCTGCCGACGA (SEQ ID NO. 5)). The naïve library may be referred to as the "L0 Library" herein and the enriched library referred to as the "L2 library." See Example 8. The screened library was PCR amplified with a C6-amine sense primer (C6 Amine-5' CTAGCATGACTGCAGTACGT 3' (SEQ ID NO. 4)) and a 5' phosphorylated anti-sense primer (5' Phos TCGTCG-GCAGCGTCA (SEQ ID NO. 6)), the purified product was strand separated and conjugated with sulfo-SBED (Thermo Scientific) according to Vinkenborg et al. (Angew Chem Int Ed Engl. 2012, 51:9176-80) with the following modifications: The reaction was scaled down to 5 μg C6-amine DNA library (8.6 μM) in 25 mM HEPES-KOH, 0.1M NaCl, pH 8.3 and incubated with either 100-fold molar excess of sulfo-SBED or DMSO in a 21 μL volume for 30 min at room temp in the dark. The SBED-conjugated library was immediately separated from the unconjugated library and free sulfo-SBED by injection onto a Waters X-Bridge™ OST C-18 column (4.6 mm×50 mm) and fractionated by HPLC (Agilent 1260 Infinity) with a linear gradient Buffer A: 100 mM TEAA, pH7.0, 0% ACN to 100 mM TEAA, pH7.0, 25% ACN at 0.2 ml/min, 65° C. There SBED-conjugated fractions were desalted into water with Glen Gel-Pak™ Cartridges and concentrated by speed-vac. SBED conjugation was confirmed by LC-MS and/or a dot blot with streptavidin-HRP detection.

Binding Reaction and Cross-Linking

SBED library functionalization was tested by performing the ADAPT assay with SBED vs DMSO mock conjugated control C6-amine library and sequenced on a HiSeq 2500™ (Illumina Corp.). The aptamer precipitation was performed with forty-eight ADAPT reactions incubated for 1hr with end-over-end rotation at room temp with a Sng input of SBED conjugated library per 200 CpL of plasma (pre-spun to remove cellular debris at 10,000 xg for 20 min, 4° C.) in 1×PBS, 3 mM MgCl$_2$, 0.01 mM dextran sulfate, 40 ng/μl salmon sperm DNA and 40 ng/μl yeast transfer RNA, and cOmplete ULTRA Mini EDTA-Free™ protease inhibitors (Roche) equivalent to ~240 ng library and 9.6 mls plasma. A duplicate set of 48 reactions was prepared with the DMSO control C6-amine library. Aptamer library-protein complexes were precipitated with incubation in 6% PEG8000 for 15 min at 4° C. then centrifuged at 10,000×g for 5 min. Pellets were washed with 1 ml 1×PBS, 3 mM MgCl2 by gentle inversion to remove unbound aptamers. The washed pellets were resuspended in 100 μL of water and subjected to photo-cross-linking at 365 nm with a hand-held 3UV (254NM/302NM/365NM) lamp, 115 volts (Thermo Scientific) for 10 min on ice with 1-2 cm between the 96-well plate and lamp.

Oligonucleotide Precipitation

Cross-linked reactions were subsequently pooled (~4.8 ml) per library or 4.8 ml of 1×PBS (AP bead only control) and incubated with 10 μL of Prepared Dynabeads® MyOne™ Streptavidin C1 (10 mg/ml) (Life Technologies) (pre-washed with 1×PBS, 0.01% Triton X-100) shaking for 1 hr at room temp. Beads were transferred to an eppendorf tube and lysed for 20 min with lysis buffer (50 mM Tris-HCl, 10 mM MgCl2, 200 mM NaCl, 0.5% Triton X-100, 5% glycerol, pH 7.5) on ice, washed 3 times with wash buffer 1 (10 mM Tris-HCl, 1 mM EDTA, 2M NaCl, 1% Triton X-100), followed by 2 times with wash buffer 2 (10 mM Tris-HCl, 1 mM EDTA, 2M NaCl, 0.01% Triton X-100) as described by Vinkenborg et al. (Angew Chem Int Ed Engl. 2012, 51:9176-80). Cross-linked proteins were eluted by boiling 15 min in 1×LDS sample buffer with reducing agent added (Life Technologies) and loaded on a 4-12% SDS-PAGE gradient gel (Life Technology). Proteins and DNA were detected with double staining with Imperial Blue Protein Stain (Thermo Scientific) followed by Prot-SIL2™ silver stain kit (Sigma) used according to manufacturer's instructions in order to enhance sensitivity and reduce background.

Protein Identification

Protein bands that appeared to differ between the cancer and normal were excised from the gradient gels and subjected to liquid chromatography-tandem mass spectrometry (LC-MS/MS).

Results

Figure 6:
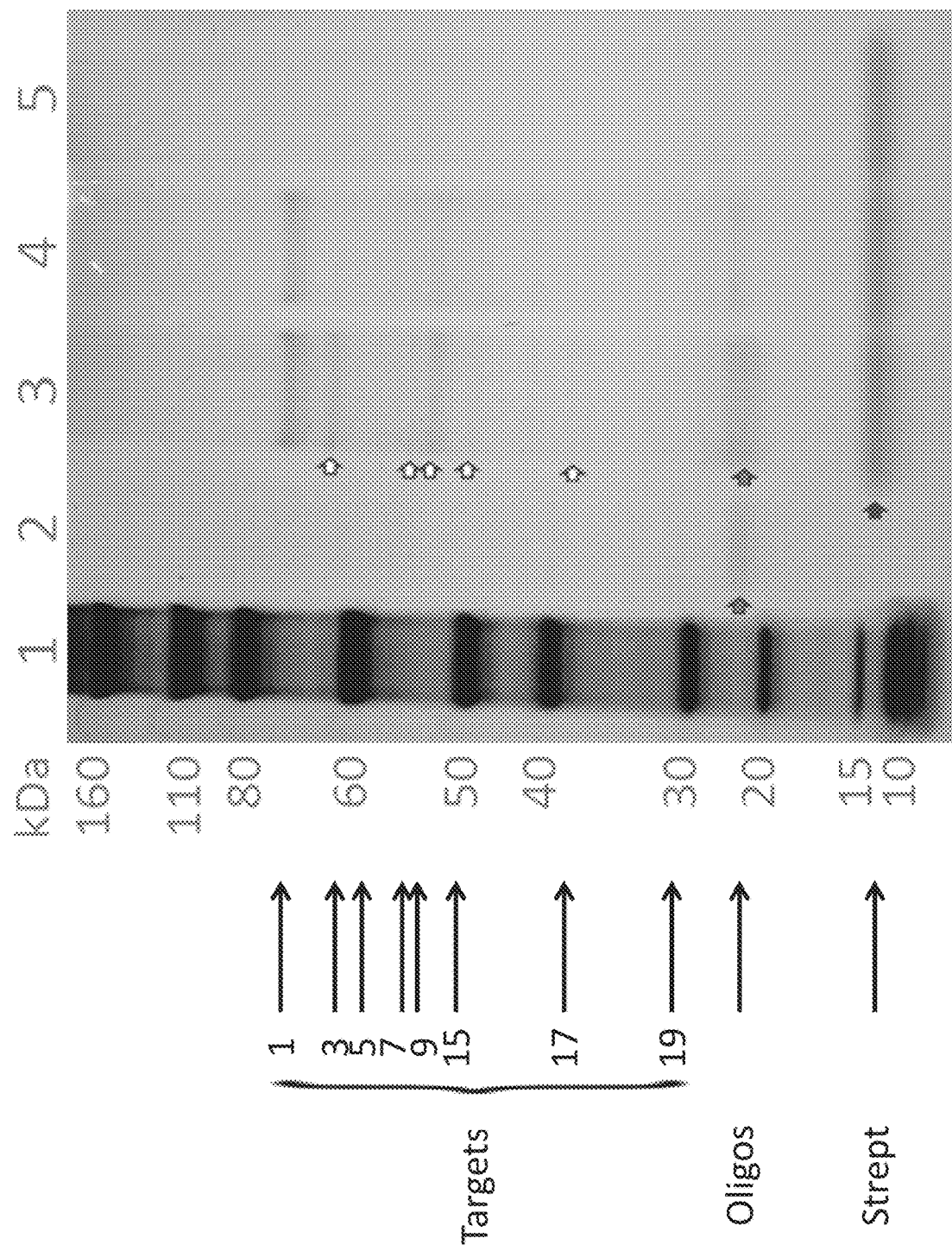
FIG. 6 shows protein targets of oligonucleotide probes run on a silver stained SDS-PAGE gel.

ADAPT protein targets were identified from bands cut from a silver stained SDS-PAGE gel (FIG. 6). Aptamer-SBED protein complexes (lane 3) or Aptamer-DMSO protein complexes (control-lane 4) were precipitated with 6% PEG8000, subjected to UV photo-cross-linking, and pulled-down with Streptavidin coated beads. Eluate was analyzed under reducing conditions by SDS-PAGE and silver staining. Aptamer library alone (5 ng) (lane 1) was loaded as a control for migration of the library (second to bottom arrows) and an equal volume of eluate from a bead only sample (lane 4) was loaded as a streptavidin control to control for potential leaching of the streptavidin monomer (bottom arrow) under the harsh elution conditions. Upper arrows ("Targets") indicate specific or more predominant bands identified with the SBED-conjugated library vs. the mock DMSO treated control C6-amine library. Indicated target protein bands were cut out and sent for LC-MS/MS protein identification or indicated DNA library bands were eluted, reamplified and sequenced. The identified proteins are those that appeared as upregulated in the normal samples.

Tables 10-17 list human proteins that were identified in 8 bands excised from the silver stained gel. In all tables the proteins are those identified in the oligo-SBED protein complexes with proteins identified in the corresponding control lanes removed. The band numbers in the tables indicate different bands cut from the gel (FIG. 6). Accession numbers in the table are from the UniProt database (www.uniprot.org). "GN=" is followed by the gene name. Various protein classifications indicated in the Tables 10-17 include Nucleic Acid Binding Proteins (NAB), Tumor suppressors (TS), cell adhesion/cytoskeletal (CA/CK) and abundant plasma proteins (ABP).

TABLE 10

| Band 3 | | |
|---|---|---|
| Accession number | Class | Protein name |
| P02538 | CA/CK | Keratin, type II cytoskeletal 6A GN = KRT6A |
| P15924 | CA/CK | Desmoplakin GN = DSP |
| P04259 | CA/CK | Keratin, type II cytoskeletal 6B GN = KRT6B |

TABLE 10-continued

Band 3

| Accession number | Class | Protein name |
|---|---|---|
| P60709 | CA/CK | Actin, cytoplasmic 1 GN = ACTB |
| P20930 | CA/CK | Filaggrin GN = FLG |
| P07476 | CA/CK | Involucrin GN = IVL |
| P31947 | TS | 14-3-3 protein sigma GN = SFN |
| Q7Z794 | CA/CK | Keratin, type II cytoskeletal 1b GN = KRT77 |
| P02545 | NAB | Prelamin-A/C GN = LMNA |
| P19012 | CA/CK | Keratin, type I cytoskeletal 15 GN = KRT15 |
| P47929 | CA/CK & TS | Galectin-7 GN = LGALS7 |
| P11142 | | Heat shock cognate 71 kDa protein GN = HSPA8 |
| P58107 | NAB | Epiplakin GN = EPPK1 |
| P08107 | | Heat shock 70 kDa protein 1A/1B GN = HSPA1A |
| Q02413 | CA/CK | Desmoglein-1 GN = DSG1 |
| P06396 | CA/CK | Gelsolin GN = GSN |
| O60814 | NAB | Histone H2B type 1-K GN = HIST1H2BK |
| P68104 | NAB | Elongation factor 1-alpha 1 GN = EEF1A1 |
| P05387 | NAB | 60S acidic ribosomal protein P2 GN = RPLP2 |
| Q7RTS7 | CA/CK | Keratin, type II cytoskeletal 74 GN = KRT74 |
| P31946 | TS | 14-3-3 protein beta/alpha GN = YWHAB |
| Q13835 | CA/CK | Plakophilin-1 GN = PKP1 |
| P14923 | CA/CK | Junction plakoglobin GN = JUP |
| P09651 | NAB | Heterogeneous nuclear ribonucleoprotein A1 GN = HNRNPA1 |
| P07900 | | Heat shock protein HSP 90-alpha GN = HSP90AA1 |
| Q96KK5 | NAB | Histone H2A type 1-H GN = HIST1H2AH |
| P04406- | CA/CK | Glyceraldehyde-3-phosphate dehydrogenase GN = GAPDH |
| P10412 | NAB | Histone H1.4 GN = HIST1H1E |
| P04792 | | Heat shock protein beta-1 GN = HSPB1 |
| Q9NZT1 | | Calmodulin-like protein 5 GN = CALML5 |
| P81605 | | Dermcidin GN = DCD |
| P27348 | TS | 14-3-3 protein theta GN = YWHAQ |
| P55072 | NAB | Transitional endoplasmic reticulum ATPase GN = VCP |
| Q09666 | NAB | Neuroblast differentiation-associated protein AHNAK GN = AHNAK |
| P23246 | NAB | Splicing factor, proline- and glutamine-rich GN = SFPQ |
| Q15149 | CA/CK | Plectin GN = PLEC |
| Q8NC51 | NAB | Plasminogen activator inhibitor 1 RNA-binding protein GN = SERBP1 |
| P07237 | | Protein disulfide-isomerase GN = P4HB |
| O60437 | CA/CK | Periplakin GN = PPL |
| P01717 | ABP | Ig lambda chain V-IV region Hil |
| P55884 | NAB | Eukaryotic translation initiation factor 3 subunit B GN = EIF3B |
| P11021 | | 78 kDa glucose-regulated protein GN = HSPA5 |
| P01024 | | Complement C3 GN = C3 |
| P04350 | CA/CK | Tubulin beta-4A chain GN = TUBB4A |
| P01857 | ABP | Ig gamma-1 chain C region GN = IGHG1 |
| P61247 | NAB | 40S ribosomal protein S3a GN = RPS3A |
| P62937 | | Peptidyl-prolyl cis-trans isomerase A GN = PPIA |
| O15020 | CA/CK | Spectrin beta chain, non-erythrocytic 2 GN = SPTBN2 |
| P30101 | | Protein disulfide-isomerase A3 GN = PDIA3 |
| Q6KB66 | CA/CK | Keratin, type II cytoskeletal 80 GN = KRT80 |
| Q9UJU6 | CA/CK | Drebrin-like protein GN = DBNL |
| P47914 | NAB | 60S ribosomal protein L29 GN = RPL29 |
| P39023 | NAB | 60S ribosomal protein L3 GN = RPL3 |
| A6NMY6 | CA/CK | Putative annexin A2-like protein GN = ANXA2P2 |
| P60174 | CA/CK | Triosephosphate isomerase GN = TPI1 |
| P35241 | CA/CK | Radixin GN = RDX |
| P07305 | NAB | Histone H1.0 GN = H1F0 |
| P15259 | CA/CK | Phosphoglycerate mutase 2 GN = PGAM2 |
| P0CG05 | ABP | Ig lambda-2 chain C regions GN = IGLC2 |
| Q92817 | CA/CK | Envoplakin GN = EVPL |
| P06733 | NAB | MBP-1 of Alpha-enolase GN = ENO1 |
| P22626 | NAB | Heterogeneous nuclear ribonucleoproteins A2/B1 GN = HNRNPA2B1 |
| P62424 | NAB | 60S ribosomal protein L7a GN = RPL7A |
| P60660 | CA/CK | Myosin light polypeptide 6 GN = MYL6 |
| P04083 | NAB | Annexin A1 GN = ANXA1 |
| Q14134 | NAB | Tripartite motif-containing protein 29 GN = TRIM29 |
| P39019 | NAB | 40S ribosomal protein S19 GN = RPS19 |
| Q8WVV4 | CA/CK | Protein POF1B GN = POF1B |
| Q02878 | NAB | 60S ribosomal protein L6 GN = RPL6 |
| Q9Y6X9 | NAB | MORC family CW-type zinc finger protein 2 GN = MORC2 |
| Q9NQC3 | NAB | Reticulon-4 GN = RTN4 |
| Q5T753 | CA/CK | Late cornified envelope protein 1E GN = CA/CK E |

TABLE 11

Band 9

| Accession number | Class | Protein name |
|---|---|---|
| P61626 | | Lysozyme C GN = LYZ |
| Q9HCK1 | NAB | DBF4-type zinc finger-containing protein 2 GN = ZDBF2 |

TABLE 12

Band 1

| Accession number | Class | Protein name |
|---|---|---|
| P01834 | ABP | Ig kappa chain C region GN = IGKC |
| P01765 | ABP | Ig heavy chain V-III region TIL |
| P04003 | NAB | C4b-binding protein alpha chain GN = C4BPA |
| P60709 | CA/CK | Actin, cytoplasmic 1 GN = ACTB |
| Q5T751 | CA/CK | Late cornified envelope protein 1C GN = LCE1C |

TABLE 13

Band 5

| Accession number | Class | Protein name |
|---|---|---|
| P01860 | ABP | Ig gamma-3 chain C region GN = IGHG3 |
| O60902 | NAB | Short stature homeobox protein 2 GN = SHOX2 |

TABLE 14

Band 7

| Accession number | Class | Protein name |
|---|---|---|
| Q04695 | CA/CK | Keratin, type I cytoskeletal 17 GN = KRT17 |
| Q7Z794 | CA/CK | Keratin, type II cytoskeletal 1b GN = KRT77 |
| Q6KB66 | CA/CK | Keratin, type II cytoskeletal 80 GN = KRT80 |
| P01833 | | Polymeric immunoglobulin receptor GN = PIGR |
| P01042 | | Kininogen-1 GN = KNG1 |
| Q02413 | CA/CK | Desmoglein-1 GN = DSG1 |
| P15924 | CA/CK | Desmoplakin GN = DSP |
| Q8TF72 | | Protein Shroom3 GN = SHROOM3 |
| P02671 | ABP | Fibrinogen alpha chain GN = FGA |
| Q5T749 | CA/CK | Keratinocyte proline-rich protein GN = KPRP |
| Q5VZP5 | | Inactive dual specificity phosphatase 27 GN = DUSP27 |
| Q5T751 | CA/CK | Late cornified envelope protein 1C GN = LCE1C |
| Q9UL12 | | Sarcosine dehydrogenase, mitochondrial GN = SARDH |
| P00698 | | Lysozyme C OS = Gallus gallus GN = LYZ |
| Q8N114 | | Protein shisa-5 GN = SHISA5 |

TABLE 15

Band 15

| Accession number | Class | Protein name |
|---|---|---|
| P08238 | | Heat shock protein HSP 90-beta GN = HSP90AB1 |
| P68104 | NAB | Elongation factor 1-alpha 1 GN = EEF1A1 |
| P02675 | ABP | Fibrinogen beta chain GN = FGB |
| Q8TF72 | | Protein Shroom3 GN = SHROOM3 |
| P0CG05 | ABP | Ig lambda-2 chain C regions GN = IGLC2 |
| P78386 | CA/CK | Keratin, type II cuticular Hb5 GN = KRT85 |

TABLE 15-continued

Band 15

| Accession number | Class | Protein name |
|---|---|---|
| Q7Z5Y6 | | Bone morphogenetic protein 8A GN = BMP8A |
| O14633 | CA/CK | Late cornified envelope protein 2B GN = LCE2B |

TABLE 16

Band 17

| Accession number | Class | Protein name |
|---|---|---|
| P02538 | CA/CK | Keratin, type II cytoskeletal 6A GN = KRT6A |
| P01834 | ABP | Ig kappa chain C region GN = IGKC |
| P06702 | | Protein S100-A9 GN = S100A9 |
| P68104 | NAB | Elongation factor 1-alpha 1 GN = EEF1A1 |
| P01024 | | Complement C3 GN = C3 |
| P81605 | | Dermcidin GN = DCD |
| P05109 | | Protein S100-A8 GN = S100A8 |
| Q5T751 | CA/CK | Late cornified envelope protein 1C GN = LCE1C |

TABLE 17

Band 19

| Accession number | Class | Protein name |
|---|---|---|
| P02768 | NAB | Serum albumin GN = ALB |
| P0CG05 | ABP | Ig lambda-2 chain C regions GN = IGLC2 |
| P06702 | | Protein S100-A9 GN = S100A9 |
| P08238 | | Heat shock protein HSP 90-beta GN = HSP90AB1 |
| P60709 | CA/CK | Actin, cytoplasmic 1 GN = ACTB |
| P13647 | CA/CK | Keratin, type II cytoskeletal 5 GN = KRT5 |
| P01616 | ABP | Ig kappa chain V-II region MIL |
| Q86YZ3 | CA/CK | Hornerin GN = HRNR |
| P01857 | ABP | Ig gamma-1 chain C region GN = IGHG1 |
| P62805 | NAB | Histone H4 GN = HIST1H4A |
| P59665 | | Neutrophil defensin 1 GN = DEFA1 |
| P61626 | | Lysozyme C GN = LYZ |
| P01024 | ABP | Complement C3 GN = C3 |
| Q8TF72 | | Protein Shroom3 GN = SHROOM3 |
| P83593 | ABP | Ig kappa chain V-IV region STH (Fragment) |
| P01700 | ABP | Ig lambda chain V-I region HA |
| P01877 | ABP | Ig alpha-2 chain C region GN = IGHA2 |
| Q9UL12 | | Sarcosine dehydrogenase, mitochondrial GN = SARDH |
| Q6NXT2 | NAB | Histone H3.3C GN = H3F3C |
| P02788 | NAB | Lactotransferrin GN = LTF |
| P02787 | ABP | Serotransferrin GN = TF |

Certain proteins were identified in multiple bands. For example, IGLC2 was identified in bands 3, 15 and 19 and SHROOM3 was identified in bands 7, 15, 19. This may be due to degradation products, isoforms or the like. These experiments identified 108 proteins (plus 2 lysozyme controls), comprising among others 34 Nucleic Acid Binding Proteins (NAB) where 7 of the 34 are putative tumor suppressors/repressors; 37 cell adhesion/cytoskeletal (CA/CK); and 14 abundant plasma proteins (ABP). All of the tumor suppressors/repressors are DNA/RNA binding proteins. Other proteins comprise chaperones, signaling molecules etc.

The biomarkers in this Example can be used to detect microvesicles that are indicative of cancer or non-cancer samples.

Example 10: Identification of Biomarkers Through Affinity Enrichment with an Enriched Oligonucleotide Library and Mass Spectrometry This Example continues upon the Example above. Identification of protein-protein and nucleic acid-protein complexes by affinity purification mass spectrometry (AP-MS) can be hampered in samples comprising complex mixtures of biological components (e.g., bodily fluids including without limitation blood and derivatives thereof). For example, it may be desirable to detect low abundance protein and nucleic acid-protein complexes in a complex milieu comprising various components that may interact promiscuously with specific binding sites such as high abundance proteins that interact non-specifically with the affinity resin. AP-MS has been used previously to enrich for pre-identified targets of interest using individual DNA or RNA aptamers or specific nucleic acid binding domains. In this Example, an enriched oligonucleotide probing library was used as the affinity reagent. This approach combined with mass spectrometry enables the identification of differentially expressed biomarker from different disease states or cellular perturbations without relying on a priori knowledge of the targets of interest. Such biomarker may comprise proteins, nucleic acids, miRNA, mRNA, carbohydrates, lipid targets, combinations thereof, or other components in a biological system.

The method comprises identification of an enriched oligonucleotide probe library according to the methods of the invention followed by target identification with affinity purification of the bound probing library and mass spectrometry. The members of the enriched oligonucleotide probing library comprise an affinity tag. A biological sample is probed with the oligonucleotide probe library, affinity purification of the oligonucleotide probe library via the affinity tag is performed which will accordingly purify biological entities in complex with various members of the probe library, and read-out of targets that purified with the members of the probe library is performed using liquid chromatography-tandem mass spectrometry (LC-MS/MS) for proteins or oligonucleotide targets (e.g., miRNA or mRNA) with next generation sequencing (NGS). Confirmation of protein targets is performed using quantitative mass spectrometry (MS), e.g., using MRM/SRM or SWATH based methods.

The method of the Example lends itself to various options. For example, any appropriate affinity tags can be used for affinity pull-down, including without limitation anti-sense oligonucleotides, biotin, polyhistidine, FLAG octapeptide (i.e., N-DYKDDDDK-C(SEQ ID NO. 7), where N stands for Amino-terminus and C stands for Carboxy terminus), 3X FLAG, Human influenza hemagglutinin (HA)-tag (i.e., N-YPYDVPDYA-C(SEQ ID NO. 8)), myc-tag (N-EQKLI-SEEDL-C(SEQ ID NO. 9)), other such as known in the art, and combinations thereof. Similarly, any appropriate enrichment support can be used in addition to the magnetic streptavidin beads exemplified herein, including without limitation other bead systems, agarose beads, planar arrays or column chromatography supports. It follows that the various supports can be coupled with the various affinity reagents appropriate for the oligonucleotide library, including without limitation streptavidin, avidin, anti-His tag antibodies, nickel, and the like. The different affinity tags and supports can be combined as desired. This Example includes cross-linking but in certain cases such cross-linking is not necessary and may even be undesirable, e.g., to favor identification of high affinity complex formation. When cross-linking is desired, any appropriate cross-linkers can be used to carry out the invention, including BS2G, DSS, formaldehyde, and the like. Other appropriate cross-linkers and methods are described herein. See, e.g., Section "Aptamer Target Identification." Lysis buffers and wash stringencies can be varied, e.g., depending on whether complexes are cross-linked or not. Less stringent lysis/wash conditions may produce a wider array of potential protein complexes of interest whereas more stringent lysis/wash conditions may favor higher affinity oligo-target complexes and/or targets comprising specific proteins (e.g., by disassociating larger complexes bound to the oligos). One of skill will further appreciate that qualitative and/or quantitative LC-MS/MS may be used for target detection and verification. Similarly, metabolic labeling and label-free approaches may be used for quantitative MS, including without limitation spectral counting, SILAC, dimethyl labeling, TMT labeling, Targeted MS with SRM/MRM or SWATH, and the like.

REFERENCES

Vickenborg et al. "Aptamer based affinity labeling of proteins", Angew Chem Int. 51 (36):9176-80 (2012).
Tacheny, M, Arnould, T., Renard, A. "Mass spectrometry-based identification of proteins interacting with nucleic acids", Journal of Proteomics 94; 89-109 (2013).
Faoro C and Ataide SF. "Ribonomic approaches to study the RNA-binding proteome.", FEBS Lett. 588(20):3649-64 (2014).
Budayeva H G, Cristea, I M, "A mass spectrometry view of stable and transient protein inteeractions." Adv Exp Med Biol. 806:263-82 (2014).

Example 11: Protocol for Affinity Capture Using Oligonucleotide Probing Library This Example presents a detailed protocol for the method of affinity capture using an oligonucleotide probing library presented in the Example above.

Protocol:

The oligonucleotide probe library comprises F-TRin-35n-B-8-3s described herein either desthiobiotin labeled or unlabeled library and binding to normal (i.e., non-cancer) female plasma. The oligonucleotide probe library is enriched against the plasma samples as described elsewhere (e.g., in Example 7). The plasma samples are processed separately against the desthiobiotin labeled or unlabeled oligonucleotide libraries. General parameters included the following:

48 normal plasma samples are pooled for enrichment of each oligonucleotide library (Desthiobiotin or Unlabeled)
200 µl input plasma per sample
Ultracentrifugation (UC) is used to pre-clear the samples
5 ng of each aptamer library is added to each sample
Binding competitors for all library samples include 0.01× S1 (dextran sulfate), 340 ng for tRNA and 340 ng Salmon sperm DNA as described elsewhere herein
6% PEG 8000 is used for precipitation of microvesicles within the samples
Affinity purification is performed with C1 Streptavidin beads (MyOne Strptavidin Beads C1-65001, lot 2 ml (10 mg/ml))
Buffer:
Plasma dilution: 6 mM MgCl2 in 2×PBS
Pellet Wash Buffer: 1×PBS, 3 mM MgCl2
PEG Ppt Buffer: 20% Peg8000 in 1×PBS, 3 mM MgCl2
Bead Prep Buffer: 1×PBS containing 0.01% Triton X-100

Lysis Buffer: prepare a 2× stock solution consisting of 100 mM Tris-HCl, 20 mM MgCl2, 400 mM NaCl, 1% Triton X-100, 10% glycerol, pH 7.5. Diluted to 1× with water 1:1 prior to using.

AP Wash buffer 1: 10 mM Tris-HCl, 1 mM EDTA, 2M NaCl, 1% Triton X-100, pH 7.5

AP wash buffer 2: 10 mM Tris-HCL, 1 mM EDTA, 2M NaCl, 0.01% Triton X-100, pH 7.5

Biotin Elution buffer 1: 5 mM Biotin, 20 mM Tris, 50 mM NaCl, pH 7.5

1×LDS, 1× Reducing buffer 2

Reagent/Instrument Prep:

Pre-chill Ultracentrifuge to 4° C.

Protease inhibition: dissolve 2 tablets of "cOmplete ULTRA MINI EDTA-free EASYpack" protease inhibitor in 1100 µl of H2O (20× stock of protease inhibitor).

Plasma Preparation (for Each of Desthiobiotin or Unlabeled Oligonucleotide Libraries):

1. Add 50 µl of protease inhibitor to each ml of sample (on top of frozen plasma) in a room temperature (RT) water bath. Will use 20 mls of pooled plasma, so 1100 µl inhibitor.

2. To remove cell/debris, spin samples at 7500×g 20 min, 4° C. in the Ultracentrifuge.

3. Collect the supernatant, pool and measure volume & record.

4. Add an equal volume of 2×PBS, 6 mM MgCl$_2$ to the plasma.

5. Label low-retention eppendorf tubes 1-96.

6. Transfer 400 µl of each sample to eppendorf tubes based on appropriate tube map 7. Using an electronic P200, add competitors: 8.6 µl of 40 ng/µl Salmon sperm DNA; 8.6 µl of 40 ng/µl tRNA; 8.6 µl of 0.5×S1.

8. Incubate at RT with end over end rotation for 10 min.

9. Add 10 µL of appropriate oligo library, mix well. Save any leftover diluted library for gel control (see below).

10. Incubate 1 hr at RT with end over end rotation.

11. Using an electronic repeat P100, add 187l of 20% PEG 8000 to sample for a final 6% concentration to the 435.5 µl of sample/oligo library. Invert a few times to mix and incubate for 15 min at 4° C.

12. Spin each sample in table top centrifuge at 10,000×g for 5 min.

13. Remove supernatant and discard, add 1 ml 1×PBS, 3 mM MgCl$_2$ to pellet.

14. Wash pellet by gentle inversion

15. Remove buffer, re-suspend pellets in 100 µl 1×PBS, 3 mM MgCl$_2$: incubate at RT for 10 min on mixmate @ 900 rpm to re-suspend. Make sure each sample is well re-suspended by pipetting.

16. Pool all desthiobiotin library samples into one 50 ml falcon tube, and the unlabeled library into another, total volume for each should be 4800 µl.

17. Take 10 µL aliquot for the input into AP sample for gel (add 10 µL of 2×LDS buffer w/2× reducing agent.

Affinity Purification:

18. Prepare 10 µL of MyOne Strep-coated Magnetic beads per each condition into a 1.5 ml eppendorf tube and place on a magnetic bead rack. Have a Bead only control as well (n=3)

19. Remove supernatant and wash 1×500 µl with Bead buffer.

20. Discard Supernatant

21. Resuspend beads in an equal volume of 1×PBS, 3 mM MgCl$_2$ (equal vol to what was taken out originally=10 µl)

22. Add the 10 µl of beads directly to the 4780 µL from step 19. To Bead only control add PBS.

23. Incubate samples with streptavidin beads 1 hr RT on plate shaker (taped).

24. Place on the large magnetic stand for 1 min and remove supernatant

25. Add 1.5 mL of 1× lysis buffer to the samples (do 3×500 µl with a good rinse of the 50 mL falcon tube for each to collect all the beads) and transfer to a new set of eppendorf tubes.

26. Incubate for 20 min on ice.

27. Place tubes in magnetic bead rack, let equilibrate 1 min and remove the supernatant.

28. Wash the beads with wash buffer #1 via vortexing. Resuspend well.

29. Place tubes on magnetic bead rack, let equilibrate 1 min and remove the supernatant 30. Wash 2 additional times as with wash buffer #1 steps 27-29 (total 3 washes with wash buffer #1)

31. Repeat steps 27-29 (2) additional times with wash buffer #2

32. During the last wash transfer beads to a new eppendorf tube. (to reduce non-specific binding)

33. Do one dry spin to make sure all residual wash buffer is removed.

34. Add 10 µl of Biotin Elution buffer 1 to beads

35. Incubate for 15 minutes at 37° C.

36. Place on magnetic stand for 1 min, collect sup and transfer to a new tube, add 10 µL of 2×LDS, 2× Reducing agent to eluted sample. Save as Elution #1.

37. Add 10 µl of 1×LDS Sample Buffer, 1× Reducing buffer to magnetic beads.

38. Boil the samples for 15 min at 90° C. The boiling time is 15 minutes to essure the streptavidin on the beads unfolds and releases the biotinylated aptapmer-protein complex.

39. Place samples on magnetic stand on ice and collect the eluted sample. This is Elution #2. Discard the beads.

40. Gel 1 layout:

Lane 1: 5 ng Desthiobiotin library

Lane 2: 1×LDS

Lane 3: Marker

Lane 4: Desthiobiotin Elution #1

Lane 5: Unlabeled Elution #1

Lane 6: Bead only Elution #1

Lane 7: Desthiobiotin Elution #2

Lane 8: Unlabeled Elution #2

Lane 9: Bead only Elution #2

Lane 10: Input for AP (saved from step 17)

Running Reducing SDS gel:

Prepare 1×MOPS SDS Running Buffer from 20×MOPS SDS Buffer

Use 10 or 12 well 4-12% Bis Tris gel

Peel off tape seal and place in the gel box. Insert spacer for second gel cassette if needed Fill the inside/upper chamber with running buffer MOPS (IX) and 500 ul Antioxidant Remove the comb carefully, not disturbing the wells Rinse the wells with the running buffer to remove the storage buffer which can interfere with sample running Slowly load samples to each well carefully using L-20 tip Fill the outer/lower chamber with approximately 600 ml of running buffer MOPS (IX)

Place top portion of unit and secure correct electrodes

Run the gel to migrate proteins

100 V constant for samples to move through stack (until all samples line up) for 15 min Increase to 150 V constant for running (until visible sample buffer comes to bottom) for ~1 hr At the end of the run, stop the power supply and remove the gel cassettes from cell Disassemble the gel cassette by with gel knife.

Remove one side of cassette case. Trim off the gel foot and wells (avoid drying gel).

Transfer gel into container filled with Mili Q water and perform a quick wash.

Silver Staining:

Materials:

ProteoSilver TMSilver Stain Kit, Sigma Catalog No. PROT-SIL1, Lot No. SLBJO252V

Ethanol, Fisher Scientific Catalog No. BP2818-4, Lot No. 142224

Acetic acid, Acros organics Catalog No. 14893-0025, Lot No. B0520036

Water, Sigma Catalog No. W4502, Lot No. RNBD1581

Preparation:

1. Fixing solution. Add 50 ml of ethanol and 10 ml of acetic acid to 40 ml of ultrapure water.

2. 30% Ethanol solution. Add 30 ml of ethanol to 70 ml of ultrapure water.

3. Sensitizer solution. Add 1 ml of ProteoSilver Sensitizer to 99 ml of ultrapure water. The prepared solution should be used within 2 hours. A precipitate may form in the Proteo-Silver Sensitizer.

This precipitate will not affect the performance of the solution. Simply allow the precipitate to settle and remove 1 ml of the supernatant.

4. Silver solution. Add 1 ml of ProteoSilver Silver Solution to 99 ml of ultrapure water. The prepared solution should be used within 2 hours.

5. Developer solution. Add 5 ml ProteoSilver Developer 1 and 0.1 ml ProteoSilver Developer 2 to 95 ml of ultrapure water. The developer solution should be prepared immediately (<20 minutes) before use.

6. All steps should be carried out in the hood and waste needs to be collected in toxic designated container.

Procedure

A. Direct Silver Staining

• All steps are carried out at room temperature on an orbital shaker at 60 to 70 rpm.

1. Fixing—After electrophoresis of the proteins in the mini polyacrylamide gel, place the gel into a clean tray with 100 ml of the Fixing solution overnight in the hood. Cover tightly.

2. Ethanol wash—Decant the Fixing solution and wash the gel for 10 minutes with 100 ml of the 30% Ethanol solution.

3. Water wash—Decant the 30% Ethanol solution and wash the gel for 10 minutes with 200 ml of ultrapure water.

4. Sensitization—Decant the water and incubate the gel for 10 minutes with 100 ml of the Sensitizer solution.

5. Water wash—Decant the Sensitizer solution and wash the gel twice, each time for 10 minutes with 200 ml of ultrapure water.

7. Silver equilibration—Decant the water and equilibrate the gel for 10 minutes with 100 ml of the Silver solution.

8. Water wash—Decant the Silver solution and wash the gel for 1 to 1.5 minutes with 200 ml of ultrapure water.

9. Gel development—Decant the water and develop the gel with 100 ml of the Developer solution. Development times of 3 to 7 minutes are sufficient to produce the desired staining intensity for most gels. Development times as long as 10 to 12 minutes may be required to detect bands or spots with very low protein concentrations (0.1 ng/mm2).

10. Stop—Add 5 ml of the ProteoSilver Stop Solution to the developer solution to stop the developing reaction and incubate for 5 minutes. Bubbles of $CO_2$ gas will form in the mixture.

11. Storage—Decant the Developer/Stop solution and wash the gel for 15 minutes with 200 ml of ultrapure water. Store the gel in fresh, ultrapure water and take picture for documentation.

Protein Identification

Protein bands of interest were excised from the gradient gels and subjected to liquid chromatography-tandem mass spectrometry (LC-MS/MS) as above.

Example 12: Use of an Oligonucleotide Probe Library to Characterize Breast Cancer Samples An oligonucleotide probe library comprising approximately 2000 different probe sequences was constructed and used to probe approximately 500 individual breast cancer and non-cancer samples. The probe sequences were derived from different screening experiments and are listed herein in SEQ ID NOs 10-2921. The oligonucleotides listed in these tables were synthesized and pooled together. The samples were plasma samples from 212 breast cancer patients, 177 biopsy confirmed non-cancer patients, and 117 normal control patients (self-reported as non-cancer). The plasma samples were contacted with the oligonucleotide probe library and microvesicles were isolated using PEG precipitation. Oligonucleotides that were recovered with the microvesicles were isolated. Next Generation Sequencing (Illumina HiSeq) was used to identify the isolated sequences for each sample.

Analysis of significance of difference identified 18 aptamers with p-values below 0.01 when compared Cancer/Normal, 15 aptamers with p-values below 0.001 when compared cancer/Non-Cancer, 28 aptamers with p-values below 0.001 when compared Non-Cancer/Normal.

Multi-oligonucleotide panels were next constructed using a cross-validation approach. Briefly, 50 samples were randomly withheld from the sample cohort. The performance of individual oligonucleotides to distinguish the remaining cancers and non-cancer/normals was determined using logistic regression methodology. Additional oligonucleotides were added iteratively and performance was assessed using logistic regression until further performance improvements were no longer obtained with additional oligonucleotides. The approach generally led to panels of approximately 20-100 different probe sequences. The contructed panels were then used to classify the 50 withheld samples and diagnostic performance was assessed using Receiver Operating Curve (ROC) analysis and estimation of the Area under the Curve (AUC).

In approximately 300 rounds of cross-validation, the average AUC was 0.6, thus showing that the average performance was statistically better than random (i.e., AUC of 0.5) and that the probe library could distinguish breast cancer and non-breast cancer/normal patient samples. AUC values as high as 0.8 were observed for particular cross validations. FIGS. 7A-B illustrate a model generated using a training (FIG. 7A) and test (FIG. 7B) set from a round of cross validation. The AUC was 0.803. The variable regions of the sequences used to build this model are shown in Table 18. Another exemplary round of cross-validation is shown in FIGS. 7C-D. The AUC was 0.678.

The SEQ ID NOs. of the sequences used in the model in FIGS. 7A-B are listed in rank in Table 18. The oligonucleotides were synthesized with a 5' region consisting of the sequence (5'-CTAGCATGACTGCAGTACGT (SEQ ID NO. 4)) and a 3' region consisting of the sequence (5'-CTGTCTCTTATACACATCTGACGCTGCCGACGA (SEQ ID NO. 5)) flanking the variable regions.

TABLE 18

Oligonucleotide Probe Variable Regions
Rank Ordered SEQ ID NOs 88, 1057, 834, 1608, 653, 1090, 2803, 499, 2587, 1082, 237, 2873, 2886, 759, 287, 390, 472, 119, 289, 96, 380, 459, 1226, 1331, 1012, 2542, 1284, 2765, 2528, 334, 1688, 949, 172, 1180, 832, 658, 195, 509, 1015, 538, 465, 696, 41, 954, 2771, 55, 407, 1351, 2524, 2760, 1728, 2600, 1731, 729, 2920, 156, 1322, 1745, 478, 236, 139, 2911, 2013, 1077, 525, 507, 2534, 1041, 1499, 766, 1037, 1143, 912, 1502, 968, 1420

The data presented in this Example demonstrate that an oligonucleotide pool comprising members having the variable regions listed in SEQ ID NOs 10-2921, e.g., a pool of probes having the variable regions listed in Table 18, can be used to distinguish plasma from individuals having breast cancer versus plasma from non-breast cancer individuals.

Example 13: Single Stranded DNA (ssDNA) Oligonucleotide Library Preparation for Library Development The preparation of high yield and high quality ssDNA libraries is a critical step in SELEX (Systematic Evolution of Ligands by Exponential enrichment) [1, 2] as well as in other biological applications, such as DNA chips and microarrays [3], and single-stranded conformation polymorphism technique (SSCP) [4]. The standard approach for preparing ssDNA libraries includes PCR amplification to first generate a double stranded (dsDNA) library, followed by ssDNA separation and purification. Several strategies of ssDNA preparation have been developed to date, each with advantages and disadvantages:

Lambda Exonuclease Digestion [2, 5-7]

The dsDNA standard PCR product is followed by Lambda exonuclease to digest the complementary strand and leave the target ssDNA. ssDNA purification is then performed to remove enzymes and unwanted buffer.

Advantages: Regular PCR amplification has high yield in generating dsDNA.

Disadvantages: The purity of final ssDNA is limited by enzyme digestion efficiency. Also dsDNA needs to be purified prior to digestion, together with post-digestion purification there will be two purifications, which results in substantial loss of input material. The digestion usually requires at least 2 hours. The digestion rate may not be consistent.

Asymmetric PCR [8, 9]

The procedure generates target ssDNA as the main product and less dsDNA products and non-target ssDNA. The band corresponding to the target ssDNA is cut from a native gel.

Advantages:

The final ssDNA product potentially has high purity.

Disadvantages:

Separation of strands is possible in the native gel, but the yield is typically low and the presence of non-target strand cannot be excluded. The yield cannot be increased on denaturing gel because the strands have the same length.

Biotin-Streptavidin Magnetic Beads Separation [10, 11]

The non-target PCR primer is biotinylated so final PCR products are Biotinylated-dsDNA, which can be captured by streptavidin magnetic beads and denatured to release the non-biotin labeled target ssDNA.

Advantages:

The final ssDNA product has relatively high purity.

Disadvantages:

In most cases, the input library needs to be biotinylated, but it may be difficult to replace or release the captured target strands from streptavidin beads. Post-denaturing purification is required to remove NaOH and/or acid used for neutralization.

Unequal Primer Length PCR [12]

The non-target PCR primer has a chemical modified spacer and a few extra nucleotides following.

In the PCR reaction, the DNA polymerase will stop at the spacer, resulting in unequal length of PCR dsDNA product. Then target ssDNA can be cut from a denaturing PAGE gel.

Advantages:

The final ssDNA product has high purity because the target ssDNA is not mixed with non-target strands.

Disadvantages:

ssDNA cannot be seen on native gel. Requires time consuming denaturing PAGE gel. It may be difficult to denature some dsDNA library, which can limit the final yield.

Indirect Purification Method [13]

The indirect purification strategy combines Asymmetric PCR and Biotin-streptavidin magnetic beads separation. In short, regular PCR is used to generate sufficient template, then asymmetric PCR with excess of target primer and less biotinylated complementary primers, followed by biotin-streptavidin separation.

Advantages:

May increase yield and purity of ssDNA product.

Disadvantages:

It cannot produce biotinylated target ssDNA library. The process is relatively long and complicated and may be prone to generate mutants of the original sequence.

The invention provides methods of enriching oligonucleotide probe libraries against a target of interest. As the probes comprise ssDNA, the process may comprise PCR amplification then conversion back into ssDNA after each round of enrichment. In this Example, we developed a strategy for preparation of a ssDNA oligonucleotide library. The goals were to develop a process that is efficient and quick, while delivering high quality/purity ssDNA. We aimed to combine PCR and ssDNA prep in one step, remain efficient in the presence of selection buffer, target molecules, other sample components (e.g., highly abundant proteins for plasma samples) and other assay components (e.g., PEG precipitation solution that may be used to precipitate microvesicles). In addition, we desired the method to be able to generate ssDNA library with any modification, including without limitation Biotin.

We have used an optimized version of Lambda exonuclease digestion protocol for preparation of ssDNA oligonucleotide library. However, the digestion yield limits the overall recovery and is not consistent between different library preparations. In some cases, the ssDNA band is hardly visible on the gel following digestion. We have also observed incomplete digestion of dsDNA in the ssDNA product. In this Example, we developed an alternative protocol, termed "ssDNA by Unequal length PRimer Asymmetric PCR," or SUPRA. It lacks disadvantages from the known methods listed above, and provides high quality and yield up to 10× higher yield of ssDNA oligonucleotide library as compared to the previous methods. It is relatively fast and convenient technically, since target ssDNA can be distinguished from non-target DNA on a gel.

Figure 9A:
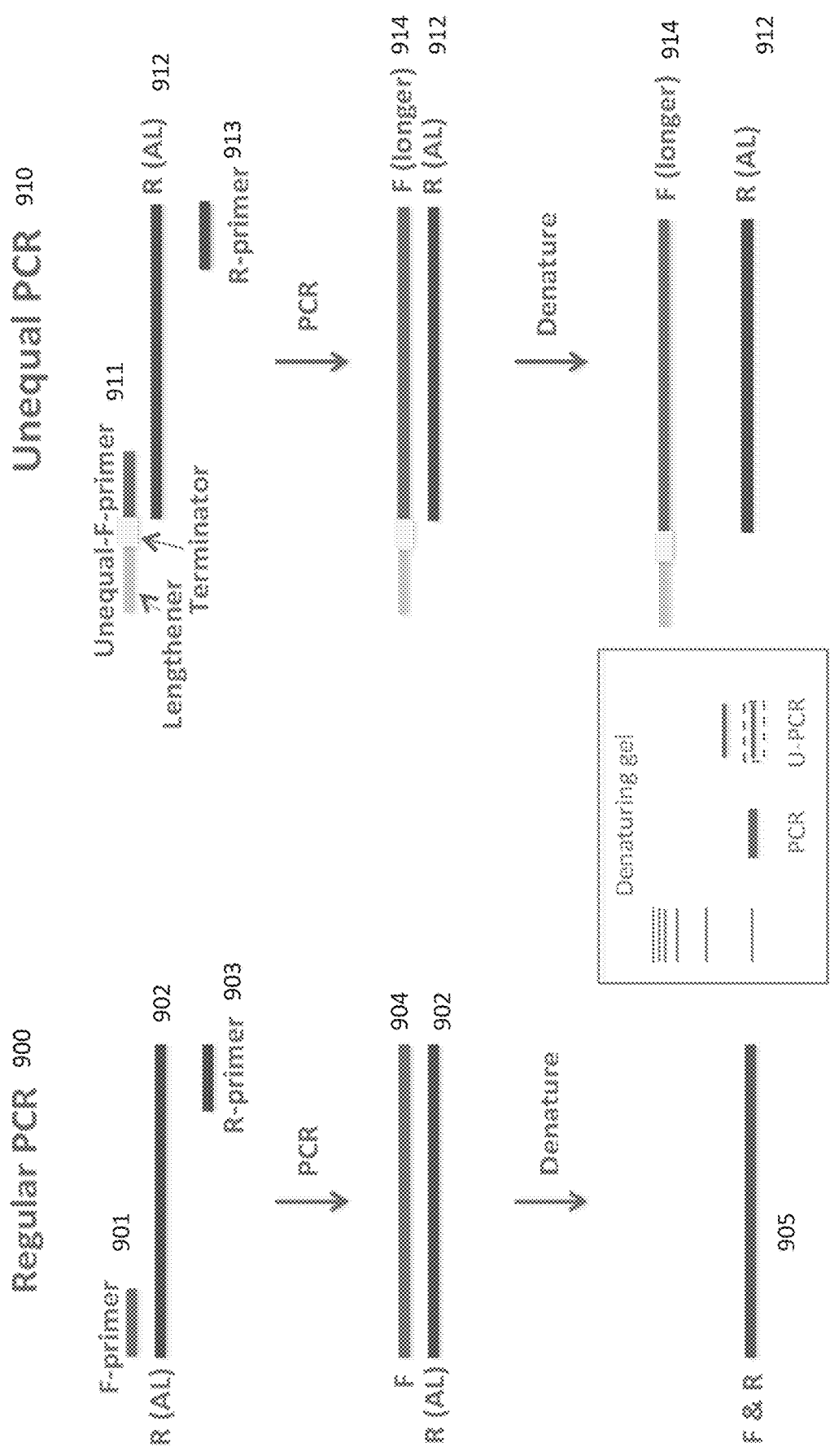
FIGS. 9A-C illustrate SUPRA (SsDNA by Unequal length PRimer Asymmetric PCR), a protocol for single stranded DNA (ssDNA) oligonucleotide library preparation.

A schematic comparing standard PCR 900 and unequal length PCR 910 is shown in FIG. 9A. In regular PCR 900, a formard primer 901 and reverse primer 903 are hybridized with the reverse strand of an aptamer library 902. The PCR reaction is performed, thereby creating equal length forward 904 and reverse strands 902. The strands are denatured in equal length single strands 905. In unequal length PCR 901, a formard primer 911 having a lengthener segment and terminator segment and a reverse primer 913 are hybridized with the reverse strand of an aptamer library 912. The PCR reaction is performed, thereby creating unequal length forward 914 and reverse strands 912. The strands are denatured into unequal length single strands 914 and 912 that can be separated by size, e.g., on a denaturing gel.

The steps of SUPRA include: (i) Modification of regular non-target primer with two Isp9 (Internal Spacer 9; triethylene glycol spacer) as terminator and 32 extra nucleotides (e.g., poly-A) as lengthener. It is referred as Unequal-Forward-Double isp9 primer (UF-D9); (ii) Perform asymmetric PCR, by mixing DNA template, UF-D9 and regular target (reverse) primer at ratio that favors the reverse primer, e.g., 1:37.5. The PCR program has longer elongation step (e.g., 3 min instead of standard 1 min) and more cycles due to linear amplification mode (instead of exponential). The PCR product contains a majority of target ssDNA and small portion of dsDNA. (iii) Mix PCR reaction products 1:1 with denaturing buffer (e.g., 180 mM NaOH and 6 mM EDTA) and denature samples by heating (e.g., 70° C. for 10 min) and cooling (e.g., incubation on ice for 3 min); (iv) Run denatured products in denaturing buffer on an agarose gel stained with SybrGold. The non-target strand, which is longer due to the lengthener, will appear as upper band (if visible) and the target strand (strong lower band) is cut and purified. The process can include optional steps, including without limitation: (v) Weigh the gel pieces and purify ssDNA from the gel pieces (e.g., using the ssDNA Nucleospin kit or the like); (vi) quantification of the yield and native gel can be used to check the purity and yield of final product (e.g., using the ssDNA Qubit kit or the like).

Figure 9B:
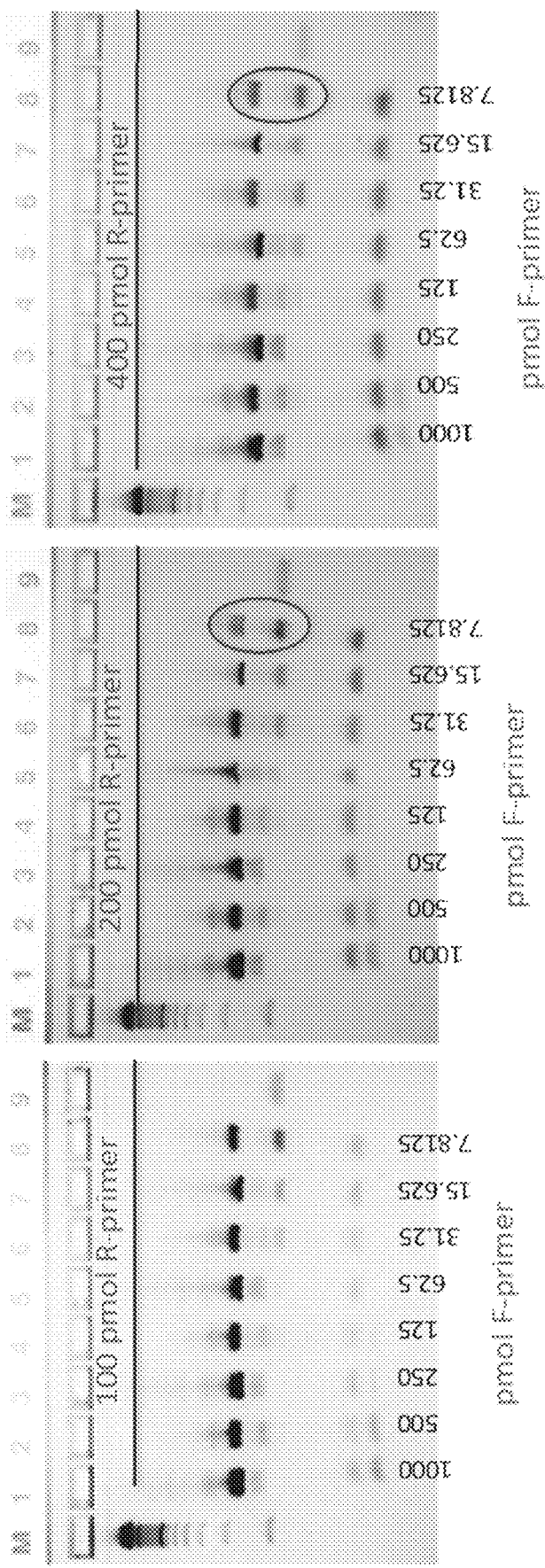

The first step (i) uses a specific design of the forward primer with efficient terminator and lengthener, which creates non-target strand of unequal length. The DNA polymerase used to build the target strand will stop polymerization once it reaches the terminator, and the lengthener facilitates differentiation between the target and non-target strands. In the second step (ii), the ratio between the two primers is shifted toward the reverse primer, to produce a majority of target ssDNA. The ratio, however, should not limit double strand templates production to keep reaction running. FIG. 9B is a gel showing titration of forward and reverse primers input in asymmetrical PCR The optimal condition, at which target strand is clearly visible, is in the range 1:20-1:50 F:R primers ratio. As shown in the figure, the ratio between two primers in asymmetric PCR can affect dsDNA and ssDNA amount in final products. The PCR thermocycler program is also adjusted to provide efficiency in the asymmetric PCR. In the third step (iii), a reliable denaturing method is used to separate target ssDNA to ensure the final yield and high purity.

As desired, the final step (vi) estimates the ratio of residual dsDNA, e.g., using ssDNA Qubit kit. In cases where the yield is not critical, the denaturing steps (iii and iv) can be skipped and the PCR products can be directly run on native gel. There will be a dsDNA band, but lower MW target ssDNA band can be distinguished and purified from gel. This is also a way to visualize the target band directly after PCR for a quality check or purification without denaturing. The purity of final product will be the same but yield will be lower.

Figure 9C:
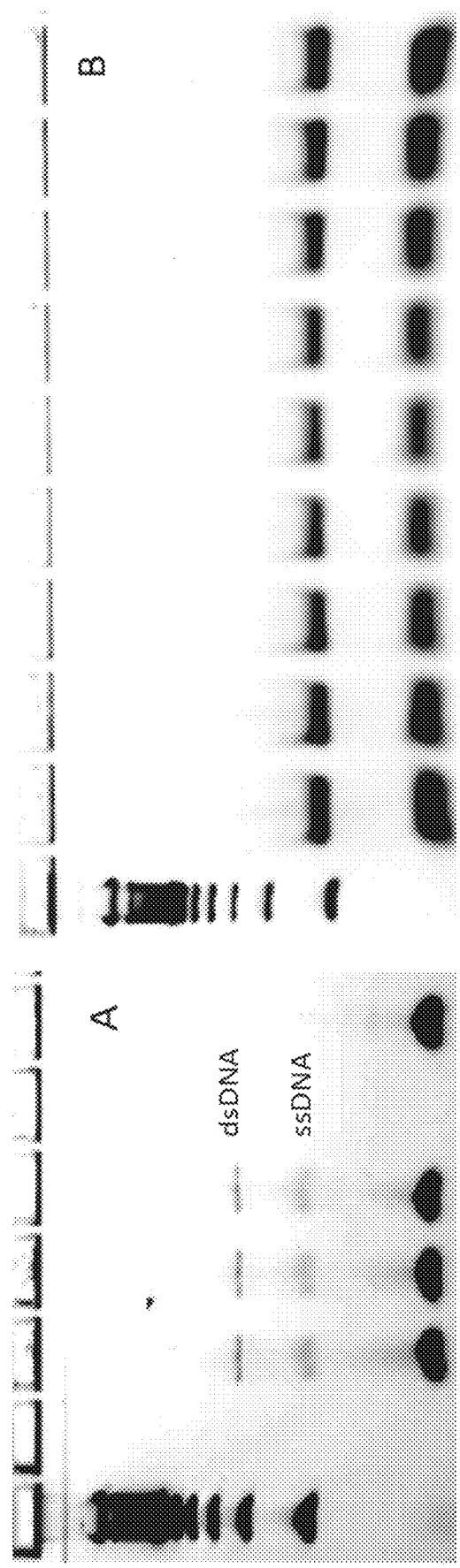

A comparison of native versus denatured gel purification is shown in FIG. 9C. A post-probing oligonucleotide probe library was PCRed using unequal length primers mixed at a ratio of 1:38 (Forward/Reverse). In the figure, the left lane on each gel is a 50 bp molecular weight ladder and the lower band is the reverse primer. The positions of the dsDNA and ss DNA are indicated. A native gel showed the presence of both dsDNA and ssDNA (target strand) (FIG. 9C, panel A). Here, part of the target reverse strand is migrating in dsDNA. Thus, using the native gel, one can purify target ssDNA with moderate recovery. When a higher yield is desired, the PCR products can be run on denaturing agarose gel as described above. This approach provides maximal recovery wherein only target strand is visible, and can be cut from gel and purified (FIG. 9C, panel B). In this case, the reverse strand ssDNA, which is part of the dsDNA on native gel (FIG. 9C, panel A), is denatured and migrates together with other free molecules of target ssDNA strand, while forward strand becomes invisible due to limited amplification.

Compared to standard asymmetric PCR, which has relatively low yield and does not allow to distinguish target and non-target strands on denaturing gel, SUPRA delivers different lengths of target and non-target that can be purified on both native gel and denaturing gels. Compared to unequal primer length PCR, which uses lengthy Urea-PAGE protocol and produces only dsDNA, SUPRA has less dsDNA and free target ssDNA can be cut even from native gel if yield is not critical.

SUPRA has been used in the oligonucleotide probe library enrichment methods provided by the invention. The method is robust. In the presence of enrichment buffer, target/non-target molecules, proteins, exosomes/microvesicles, PEG and other components, SUPRA provides high quality and quantity of the ssDNA oligonucleotide library.

REFERENCES

1. Comparison of different methods for generation of single-stranded DNA for SELEX processes. Anal. Bioanal. Chem. 2012, 404, 835-842.
2. Upgrading SELEX Technology by Using Lambda Exonuclease Digestion for Single-Stranded DNA Generation. Molecules 2010, 15, 1-11.
3. Tang, K.; Fu, D. J.; Julien, D.; Braun, A.; Cantor, C. R.; Koster, H. Chip-based genotyping by mass spectrometry. Proc. Natl. Acad. Sci. USA 1999, 96, 10016-10020.
4. Kuypers, A. W.; Linssen, P. C.; Willems, P. M.; Mensink, E J. On-line melting of double-stranded DNA for analysis of single-stranded DNA using capillary electrophoresis. J. Chromatogr. B Biomed. Appl. 1996, 675, 205-211.
5. Higuchi, R. G.; Ochman, H. Production of single-stranded DNA templates by exonuclease digestion following the polymerase chain reaction. Nucleic Acids Res. 1989, 17, 5865.
6. Jones, L. A.; Clancy, L. E.; Rawlinson, W. D.; White, P. A. High-affinity aptamers to subtype 3a hepatitis C virus polymerase display genotypic specificity. Antimicrob. Agents Chemother. 2006, 50, 3019-3027.
7. S. S. Oh, K. Ahmads, M. Cho, Y. Xiao, H. T. Soh, "Rapid, Efficient Aptamer Generation: Kinetic-Challenge Microfluidic SELEX," presented in the 12th Annual UC Systemwide Bioengineering Symposium, Jun. 13-15, 2011, Santa Barbara, U.S.A.

8. Gyllensten, U. B.; Erlich, H. A. Generation of single-stranded DNA by the polymerase chain reaction and its application to direct sequencing of the HLA-DQA locus. Proc. Natl. Acad. Sci. USA 1988, 85, 7652-7656.
9. Wu, L.; Curran, J. F. An allosteric synthetic DNA. Nucleic Acids Res. 1999, 27, 1512-1516.
10. Espelund, M.; Stacy, R. A.; Jakobsen, K. S. A simple method for generating single-stranded DNA probes labeled to high activities. Nucleic Acids Res. 1990, 18, 6157-6158.
11. A. Paul, M. Avci-Adali, G. Ziemer, H. P. Wendel. Streptavidin-coated magnetic beads for DNA strand separation implicate a multitude of problems during cell-SELEX. Oligonucleotides 2009, 19, 243-254.
12. Williams K., Bartel D. PCR product with strands of unequal length. Nucleic Acids Research, 1995, Vol. 23, No. 20.
13. Indirect purification method provides high yield and quality ssDNA sublibrary for potential aptamer selection. Anal. Biochem. 2015, online available.

Example 14: Oligonucleotide Pools to Characterize Cell Lines

In this Example, an oligonucleotide library was enriched using a combination of cells from different cancer cell lines to create cancer specific pools and against a pool of non-cancer cells. The enrichment is performed to identify cancer specific oligonucleotides and oligonucleotide pools that can be used in various applications, including without limitation diagnostic assays, as drugs or in drug delivery.

Figure 13:
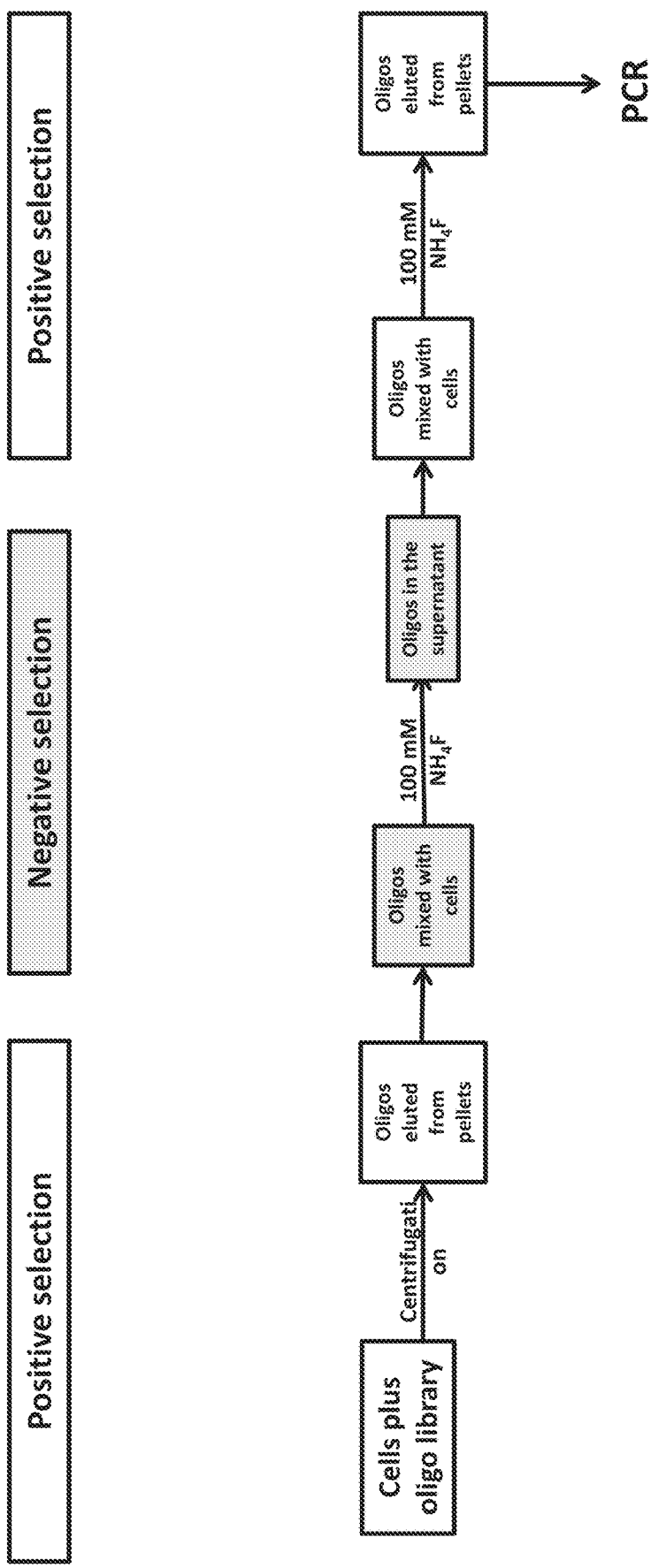
FIG. 13 shows a schematic for enriching an oligonucleotide library against cell lines.

The unscreened library comprised F-Trin-B primers (i.e., 5' CTAGCATGACTGCAGTACGT (SEQ ID NO 4) and 5' CTGTCTCTTATACACATCTGACGCTGCCGACGA (SEQ ID NO 5) as shown above) surrounding a region of randomly generated nucleotides. The enrichment was performed using methodology presented herein. See Examples above. Detailed protocols are below in Examples 15 and 16. One round of enrichment consisted of a series of positive, negative and positive selections before amplification via PCR of the enriched oligonucleotides. See FIG. 13, which shows a diagram of one round of enrichment. The amplified library (PCR) is used as the input into the next round or enrichment. The cell lines used consisted of nine lung cancer lines, five prostate cancer lines and nine non-cancer lines as listed in Table 19.

TABLE 19

| | | Cell Lines | | |
|---|---|---|---|---|
| Indication | Cell Line | Tissue | Disease | Morphology |
| Lung Pool | A549 | Lung | Carcinoma | Epithelial |
| | NCI-H1395 | Lung | Adenocarcinoma | Epithelial |
| | NCI-H1838 | Lung | Adenocarcinoma; Non-Small Cell Lung Cancer | Epithelial |
| | NCI-H1975 | Lung | Adenocarcinoma; Non-Small Cell Lung Cancer | Epithelial |
| | NCI-H2122 | Lung; Derived From Metastatic Site: Pleural Effusion | Adenocarcinoma; Non-Small Cell Lung Cancer | Rounded And Epithelial Cells |
| | NCI-H460 | Lung; Pleural Effusion | Carcinoma; Large Cell Lung Cancer | Epithelial |
| | H69AR | Lung | Carcinoma; Small Cell Lung Cancer | Epithelial |
| | HCC827 | Lung | Adenocarcinoma | Epithelial |
| | NCI-H1688 | Lung; Derived From Metastatic Site: Liver | Carcinoma; Small Cell Lung Cancer | Epithelial |
| Prostate Pool | 22RV1 | Prostate | Carcinoma | Epithelial |
| | DU145 | Prostate; Derived From Metastatic Site: Brain | Carcinoma | Epithelial |
| | LnCaP | Prostate; Derived From Metastatic Site: Left Supraclavicular Lymph Node | Carcinoma | Epithelial |
| | PC3 | Prostate; Derived From Metastatic Site: Bone | Carcinoma | Epithelial |
| | VCaP | Prostate; Derived From Metastatic Site: Vertebral Metastasis | Cancer | Epithelial |
| Non-Cancer Pool | CCD-16Lu | Lung | Normal | Fibroblast |
| | CCD-19Lu | Lung | Normal | Fibroblast |
| | CCD841CoN | Colon | Normal | Epithelial |
| | CCD-18Co | Colon | Normal | Fibroblast |
| | HCC1143BL | B Lymphoblast; Peripheral Blood Lymphocytes | Normal | Lymphoblast |
| | NCI-BL1395 | Peripheral Blood; B Lymphoblast; Epstein-Barr Virus (EBV) Transformed | Normal | Lymphoblast |
| | NCI-BL128 | Peripheral Blood; B Lymphoblast; Epstein-Barr Virus (EBV) Transformed | Normal | Lymphoblast |

TABLE 19-continued

Cell Lines

| Indication | Cell Line | Tissue | Disease | Morphology |
|---|---|---|---|---|
| | Primary Prostate Epithelial Cells | Prostate | Normal | Epithelial |
| | PNT2 | Prostate | Normal | Epithelial |

Nine rounds of enrichment were performed against the lung cancer sample pool. The variable regions of the top five most enriched sequences are shown in Table 20. The enriched libraries consisted of the Variable Region as shown in the table inserted between the flanking sequences shown above as 5' CTAGCATGACTGCAGTACGT (SEQ ID NO 4)—[Variable Region]—CTGTCTCTTATACACATCT-GACGCTGCCGACGA (SEQ ID NO 5). The sequences were also 5' biotinylated. 25 ng of starting library was used in the enrichment. As control sequences, the reverse complements were synthesized as shown in Table 20. These are reverse complements of the entire oligonucleotides including the flanking regions. S1LCa25-R9S1RC-5'biotin and S1LCa25-R9S3RC-5'biotin are the reverse complements of S1LCa25-R9S1-5'biotin and S1LCa25-R9S3-5biotin, respectively. The reverse complements can be used as negative controls as they should not specifically bind the targets of the enriched sequences.

TABLE 20

Lung Cancer Enriched Oligonucleotides

| | Sequence name | | SEQ ID NO. |
|---|---|---|---|
| | Variable Region (5'->3') | | |
| Most enriched sequences | S1LCa25-R9S1-5'biotin | GGGGTTGTTTTGGGATGCCTTTTTCTCTGTATTTCA | 2922 |
| | S1LCa25-R9S2-5'biotin | GTCCTCGCCCGGGCTTCTGTTTGTTTTTGGATTCGA | 2923 |
| | S1LCa25-R9S3-5'biotin | AACGCTTGATTTGGGTGGTTGGATTGACCTTTTTATGA | 2924 |
| | S1LCa25-R9S4-5'biotin | TTTTTTATTGGGTGCGCATAGGCGAGTGGTCTCTT | 2925 |
| | S1LCa25-R9S5-5'biotin | TGATTACATCGCCTGTATGGGTTGTTGTTTGTGTC | 2926 |
| | Full Sequence (5'->3') | | |
| Reverse complement sequences | S1LCa25-R9S1RC-5'biotin | TCGTCGGCAGCGTCAGATGTGTATAAGAGACAGTGAAAT ACAGAGAAAAAGGCATCCCAAAACAACCCCACGTACTGC AGTCATGCTAG | 2927 |
| | S1LCa25-R9S3RC-5'biotin | TCGTCGGCAGCGTCAGATGTGTATAAGAGACAGTCATAA AAAGGTCAATCCAACCACCCAAATCAAGCGTTACGTACT GCAGTCATGCTAG | 2928 |

Nine rounds of enrichment were also performed against the prostate cancer sample pool. The variable regions of various enriched sequences are shown in Table 21. The amount of starting library used in the enrichment is indicated in the table. The libraries consisted of the Variable Region as shown in the table inserted between the flanking sequences (SEQ ID NOs 4-5) as shown above. After the enrichment, the libraries were used to probe the cell pools and NGS was used to determine the identity and counts of the bound sequences. Table 21 shows the counts of sequences in prostate cancer (PCA) or non-PCA and the fold-change between PCA and non-PCA. Probing was performed in triplicate. The sequences in Table 30 had a coefficient of variation (% CV)≤20% across normalized counts for three probing replicates and fold changes cancer/non-cancer ≤0.6 or ≥1.4. The average percent variation (% CV) was ~11% for the PCA pools and ~12% for the non-PCA pools.

TABLE 21

Prostate Cancer Enriched Oligonucleotides

| | Variable Region (5'->3') | SEQ ID NO | PCA Average normalized counts | Non-PCA Average normalized counts | Fold Change - Cancer/Non-Cancer |
|---|---|---|---|---|---|
| Enrichment with 5 ng initially | GGTTTTATCGTTTCTTTAGTTGGGTTCTTGGGTGA | 2929 | 475 | 346 | 1.4 |
| | GGATCTTGGTTAGTATTTTTGGTATTTTCTGTGGT | 2930 | 415 | 300 | 1.4 |
| | GGATGCTGGTTAGTATTTTTGGTATTTTCTGTGGT | 2931 | 564 | 408 | 1.4 |
| | TATTTAGGGGTTGTGGGTCTAATTTTTGTTTGTTCGA | 2932 | 551 | 397 | 1.4 |
| Enrichment with 25 ng initially | TCCTGGTTTCTGGTGGTTTCATTTAGCTTGTTACCTGA | 2933 | 376 | 276 | 1.4 |
| | TCCTGGTTTCTGGTGGTTTAATTTTGCTTGTTACATGA | 2934 | 934 | 687 | 1.4 |
| | TCCTGGTTTCTGGTGGTTTCATTTTGATTGTTACCTGA | 2935 | 2036 | 1485 | 1.4 |
| | TTTGGTTGGTCCATGGGTAAGCTTGGTGATTCTCTTGA | 2936 | 438 | 315 | 1.4 |
| | TCCTGGTTTCTGGTGGTTTCATTTTGCTTGTTACATGA | 2937 | 2194 | 1565 | 1.4 |
| Enrichment with 50 ng initially | ACATGCACTGAGCCCGACACACCCGCCTGAACTAT | 2938 | 361 | 570 | 0.6 |
| | ACTAATTGTTTTGGGGGTAGTTGTTTTTTTTCTGT | 2939 | 3984 | 2893 | 1.4 |
| | GGATCCTGGTTAGTATTTTTGGTATATTCTGTGGT | 2940 | 277 | 201 | 1.4 |
| | TATGTTCTTTTTATTTTAGTGGTTGTGGCCTATCTA | 2941 | 506 | 367 | 1.4 |

The sequences above were 5' biotinylated for capture. As control sequences, reverse complements were synthesized as shown in Table 22. These are reverse complements of the entire oligonucleotides including the flanking regions. S1PCa5-R9S1RC-5'biotin and S1PCa25-R9S1RC-5'biotin are the reverse complements of the complete S1PCa5-R9S1-5'biotin and S1PCa25-R9S1-5'biotin sequences with flanking regions, respectively. The reverse complements can be used as negative controls as they should not specifically bind the targets of the enriched sequences.

TABLE 22

Prostate Cancer Enriched Oligonucleotides

| | Sequence name | Variable Region (5'->3') | SEQ ID NO. |
|---|---|---|---|
| Enrichment with 5 ng initially | S1PCa5-R9S1-5'biotin | GGTTTTATCGTTTCTTTAGTTGGGTTCTTGGGTGA | 2942 |
| | S1PCa5-R9S4-5'biotin | TATTTAGGGGTTGTGGGTCTAATTTTTGTTTGTTCGA | 2943 |
| Enrichment with 25 ng initially | S1PCa25-R9S1-5'biotin | TCCTGGTTTCTGGTGGTTTCATTTAGCTTGTTACCTGA | 2944 |
| | S1PCa25-R9S5-5'biotin | TCCTGGTTTCTGGTGGTTTCATTTTGCTTGTTACATGA | 2945 |
| Enrichment with 50 ng initially | S1PCa50-R9S1-5'biotin | ACATGCACTGAGCCCGACACACCCGCCTGAACTAT | 2946 |
| | S1PCa50-R9S3-5'biotin | GGATCCTGGTTAGTATTTTTGGTATATTCTGTGGT | 2947 |
| | | Full Sequence | |
| Reverse complement sequences to 5 ng library | S1PCa5-R9S1RC-5'biotin | /5Biosg/TCGTCGGCAGCGTCAGATGTGTATAAGAGACAGTCACCCAAGAACCCAACTAAAGAAACGATAAAACCACGTACTGCAGTCATGCTAG | 2948 |

TABLE 22-continued

Prostate Cancer Enriched Oligonucleotides

| | Sequence name | | SEQ ID NO. |
|---|---|---|---|
| Reverse complement sequences to 25 ng library | S1PCa25-R9S1RC-5'biotin | /5Biosg/TCGTCGGCAGCGTCAGATGTGTATAAGA GACAGTCAGGTAACAAGCTAAATGAAACCACCAGAA ACCAGGAACGTACTGCAGTCATGCTAG | 2949 |

Additional sequences as in Table 21 are shown in Table 23. Table 23 includes sequences with % CV>20%, as indicated.

TABLE 23

Additional Prostate Cancer Enriched Oligonucleotides

| | Variable Region (5'->3') | SEQ ID NO | Prostate Cancer Pool Average normalized counts | % CV | Non-Cancer Pool Average normalized counts | % CV | Fold Change - Cancer/Non-Cancer |
|---|---|---|---|---|---|---|---|
| Enrichment with 5 ng initially | AGTTCTTGGGGGTTTTGGTTGG TGCCTTGTATGTTA | 2950 | 670 | 10% | 266 | 41% | 2.5 |
| | AGTTCTTGGGGGTTTTGGTTGT TGCCTTGTCTATTA | 2951 | 11 | 60% | 1 | 0% | 10.7 |
| Enrichment with 25 ng initially | TTGCCGCCCTTTATGGTTTGTT TTTTGCGATGTGGGA | 2952 | 45 | 49% | 8 | 90% | 5.4 |

Assays such as qPCR, cell enzyme linked assay (ELA), confocal microscopy and cell viability assays are performed to verify binding of oligonucleotides to cells and identify potential cell killing properties of certain oligonucleotides.

Example 15: Enrichment Protocol

Re-amplification of original F-TRin-35n-B oligonucleotide library.

Samples for One Round of Enrichment 900,000 cells from pool of Prostate/Lung cell lines (split 3 times in 300,000 each)

900,000 cells from pool of Normal cell lines (split 3 times in 300,000 each)

Preparations

Pre-chill tabletop centrifuge at 4° C.

Bring 300,000 of Prostate/Lung cells to 140 ul with 1×PBS with 3 mM $MgCl_2$ (138.6 ul PBS+1.4 ul 300 mM $MgCl_2$), add competitors listed below and incubate for 20 min with end-over-end rotation.

Mixture of two competitors: Salmon DNA+tRNA.

Competitor salmon DNA: add 800 ng of salmon DNA (Stock 10 ug/ul→Dilute 1:250 with 1×PBS+3 mM $MgCl_2$ [40 ng/ul]→20 ul input).

Competitor tRNA: add 800 ng of tRNA (Stock 10 ug/ul→Dilute 1:250 with 1×PBS+3 mM $MgCl_2$ [40 ng/ul]→20 ul input).

Library/Sample Incubation (Positive Selection)

Prepare 5, 25, 50 ng for first round and same corresponding for following rounds of oligonucleotide library in 20 ul of 1×PBS with 3 mM $MgCl_2$. After heating the DNA for 3 min @ 95 C, put it on ice immediately for 5 min. Add DNA to the blocked cells and incubate them for 30 min at RT, with end-over-end rotation Spinning Cells Spin cells from step II at 500×g for 5 min (spin at 4 C) and discard supernatant by pipetting it out.

Re-suspend pellet in 1 ml of 1×PBS+3 mM $MgCl_2$; vortex/mix and centrifuge again at 500×g for 5 min (spin at 4 C)

Repeat the wash one more time.

Re-suspend pellet in 50 ul of water.

Use pellet in step IV.

Oligonucleotide Elution

Add 25 ul of 0.1N NaOH to cells from III, incubate for 10 min at 50 C, mixmate and agitate for 10 sec at 550 rpm→Add 25 ul of 0.1N HCL→Spin at 12000×g for 10 min at 4 C→proceed with NucleoSpin ssDNA purification MAKE SURE TO USE CORRECT BUFFER TO BIND (NTC) ssDNA (number of columns to be identified)→Elute, each column in 20 ul of water (incubation time before elution is 5 min). Add 4 ul of 5×PBS+15 mM MgCl2 solution, before proceeding to the next enrichment.

Library/sample incubation (negative selection)

Bring 300,000 of Normal cells (depending on number of steps) to 140 ul with 1×PBS with 3 mM $MgCl_2$ (138.6 ul PBS+1.4 ul 300 mM $MgCl_2$) and mix with the mixture of competitors as described above in step I.c (40 ul total), incubate for 20 min with end-over-end rotation. Then, add eluted oligonucleotide libraries (~20 ul) (heat treat 3 min@ 95 C, put it on ice immediately for 5 min) from step IV and incubate 30 min at RT.

Spinning Cells

Spin cells from step V at 500×g for 5 min (spin at 4 C) and collect supernatant.

Treatment of supernatant with NucleoSpin ssDNA purification. MAKE SURE TO USE CORRECT BUFFER TO BIND (NTC) ssDNA (number of columns to be identified)→Elute, each column in 20 ul of water (incubation time before elution is 5 min).

Add 4 ul of 5×PBS+15 mM MgCl2 solution, before proceeding to the next enrichment.

Library/Sample Incubation (Positive Selection)

Bring 300,000 of Prostate/Lung cells to 140 ul with 1×PBS with 3 mM $MgCl_2$ (138.6 ul PBS+1.4 ul 300 mM $MgCl_2$) and mix with the mixture of competitors as described above in step I.c (40 ul total), incubate for 20 min with end-over-end rotation. Mix with libraries from step VI (heat treat 3 min@95 C, put it on ice immediately for 5 min) and incubate for 30 min at RT with end-over-end rotation.

Spinning Cells

Spin cells from step VII at 500×g for 5 min (spin at 4 C) and discard supernatant by pipetting it out.

Re-suspend pellet in 1 ml of 1×PBS+3 mM $MgCl_2$; vortex/mix and centrifuge again at 500×g for 5 min (spin at 4 C).

Repeat the wash one more time.

Re-suspend pellet in 50 ul of water.

Follow the oligonucleotide elution (IV) and then nucleospin purification to get the ssDNA in 20 ul water.

The ssDNA in water (20 ul) will be used entirely for PCR amplification.

Example 16: Enrichment Protocol

Samples for One Round of Enrichment 900,000 cells from pool of Prostate/Lung cell lines (split 3 times in 300,000 each)

900,000 cells from pool of Normal cell lines (split 3 times in 300,000 each)

No cells enrichment for every library input

TABLE 24

| | Buffers |
|---|---|
| Exp. ID | Buffers |
| B1 | PBS + 3 mM MgCl2 |
| B2 | PBS + 3 mM MgCl2 + 0.5% F-127 + 0.5% PEG4000 |
| B3 | PBS + 3 mM MgCl2 + 0.5% F-127 + 1 mg/ml HSA |

Or the titers of buffer with F-127 and H SA-F-127 @ 0.5, 1 and 2%

Cells are available in 1×PBS+3 mM MgCl2 buffer and need to be transferred.

I. Preparations

Pre-chill tabletop centrifuge at 4° C.

Transfer 300,000 cancer cells—140 ul into 3 fresh tubes. Spin at 500×g for 5 mins. Remove the supernatant buffer and add 70 ul of the buffer B2.

Add competitors listed below and incubate for 20 min with end-over-end rotation.

Mixture of two competitors:
a. Competitor salmon DNA: add 800 ng of salmon DNA (Stock 10 ug/ul→Dilute 1:125 with B2 [80 ng/ul]→10 ul input).
b. Competitor t-RNA: add 800 ng of tRNA (Stock 10 ug/ul→Dilute 1:125 with B2 [80 ng/ul]→10 ul input).

Bring up the volume to 180 ul with 90 ul of Buffer B2, for the blocking.

II. Library/Sample Incubation (Positive Selection)

Prepare 5/25/50 ng of F-TRin-35n-B Starting Library for first round in 20 ul of buffer B2. After heating the DNA for 3 min @ 95 C, put it on ice for 5 min. Add DNA to the blocked cells and incubate them for 30 min at RT, with end-over-end rotation.

III. Spinning Cells

Spin cells from step II at 500×g for 5 min at 4 C and discard supernatant by pipetting it out.

Re-suspend pellet in 1 ml of B2; vortex and centrifuge again at 500×g for 5 min at 4 C.

Repeat the wash one more time. (Additional Wash)

Re-suspend pellet in 30 ul of buffer B2.

Use pellet in step IV.

IV. Oligonucleotide Elution

Add 10 ul of 0.25N NaOH to cells from III, incubate for 10 min at 50 C, mix-mate and agitate for 5-10 sec at 550 rpm→Add 10 ul of 0.25N HCL→Spin at 16000×g for 10 min at 4 C. Collect the supernatant; this will be used as library for the next step.

V. Library/Sample Incubation (Negative Selection)

Transfer 300,000 normal cells—140 ul into 3 fresh tubes. Spin @ 500×g for 5 mins. Remove the supernatant buffer and add 70 ul of the buffer B2.

Mix with the mixture of competitors (10 ul of Salmon sperm DNA @ 80 ng/ul+10 ul of Yeast t-RNA @ 80 ng/ul), bring up the volume to 150 ul (add 60 ul) of Buffer B2, incubate for 20 min with end-over-end rotation. Then, add eluted oligonucleotide libraries (~50 ul) (heat treat for 3 min@ 95 C, put it on ice immediately for 5 min) from step IV and incubate 30 min at RT.

VI. Spinning Cells

Spin cells from step V at 500×g for 5 min at 4 C and collect supernatant as library for next step (200 ul).

VII. Library/Sample Incubation (Positive Selection)

Transfer 300,000 cancer cells—140 ul into 3 fresh tubes. Spin at 500×g for 5 mins. Remove the supernatant buffer and add 70 ul of the buffer B2.

Mix with the mixture of competitors (10 ul of Salmon sperm DNA @ 80 ng/ul+10 ul of Yeast t-RNA @ 80 ng/ul), incubate for 20 min with end-over-end rotation. Mix with libraries from step VI (heat treat 3 min@ 95 C, put it on ice immediately for 5 min) and incubate for 30 min at RT with end-over-end rotation (total 290 ul).

VIII. Spinning Cells

Spin cells from step VII at 500×g for 5 min at 4 C and discard supernatant by pipetting it out.

Re-suspend pellet in 1 ml of B2; vortex and centrifuge again at 500×g for 5 min at 4 C.

Repeat the wash one more time. (Additional Wash)

Re-suspend pellet in 50 ul of water; it will be used entirely for PCR amplification.

Example 17: Oligonucleotide Pools to Characterize Cell Line Microvesides

In this Example, an oligonucleotide library was enriched using microvesicles shed from various cancer cell lines. The enrichment is performed as in Example 14 as above except that the sample comprised microvesicles as opposed to cells. This method can be performed to identify disease specific oligonucleotides and oligonucleotide pools that can be used in various applications, including without limitation diagnostic assays, as drugs or in drug delivery.

Figure 14A:
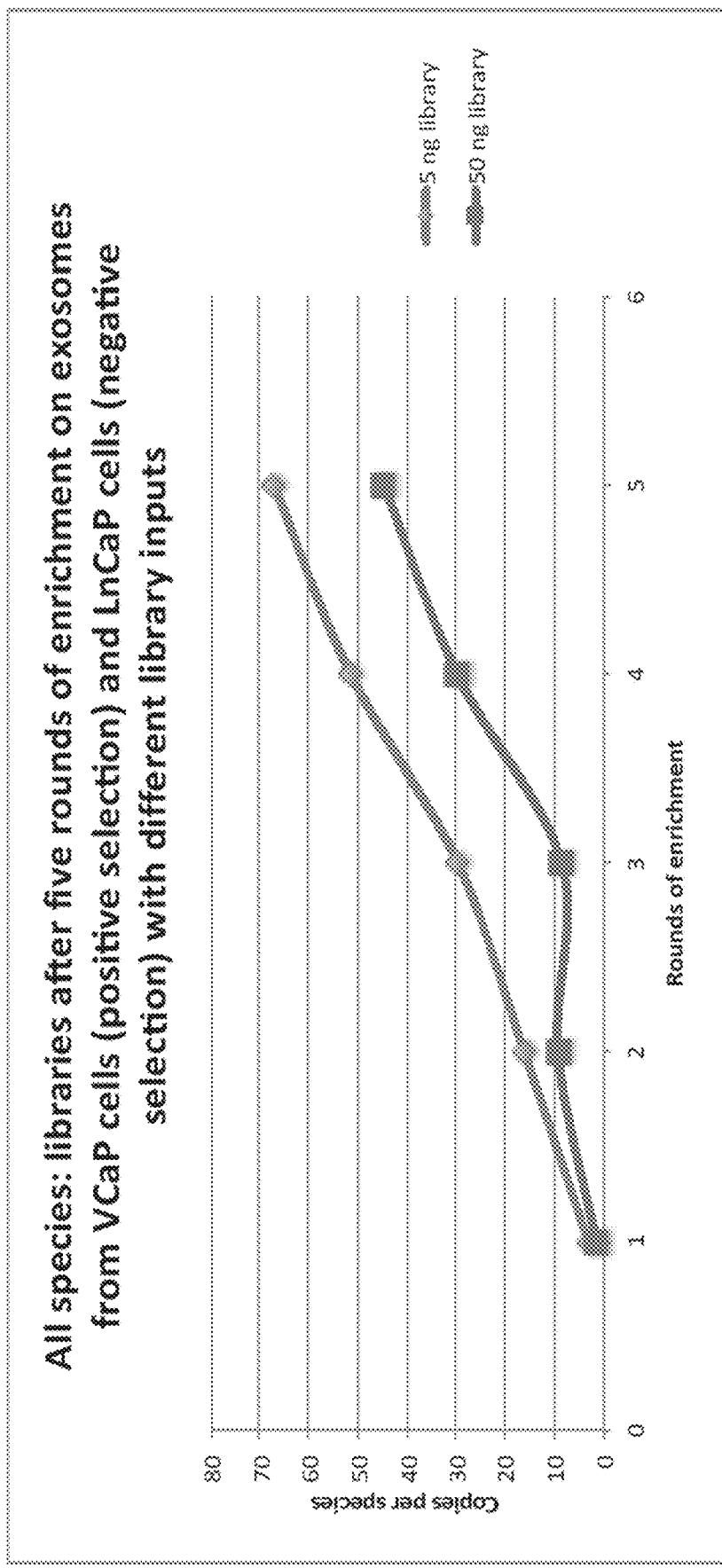
FIGS. 14A-C show oligonucleotide probes that recognize microvesicles (exosomes) shed by prostate cancer cell lines.
Figure 14B:
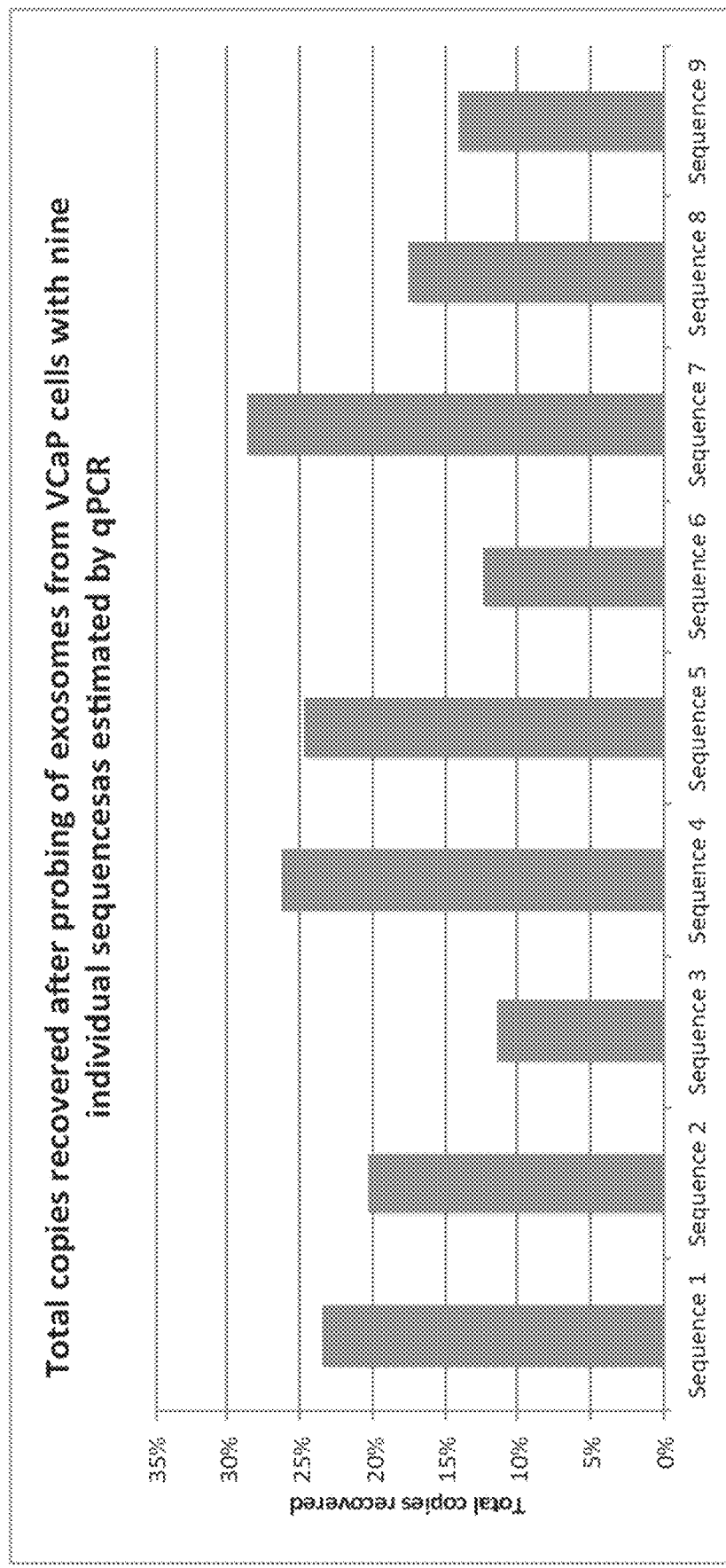

The unscreened library comprised F-Trin-B primers (i.e., 5' CTAGCATGACTGCAGTACGT (SEQ ID NO 4) and 5' CTGTCTCTTATACACATCTGACGCTGCCGACGA (SEQ ID NO 5)) flanking a random variable region. Enrichment was performed on microvesicles from cell lines as described further in Example 18 below. FIG. 14A shows copies per species of five rounds of enrichment on exosomes from VCaP and LNCaP cells as indicated in the figure. Positive selection was performed on VCAP microvesicles shed from VCAP cells and negative selection was performed on LNCaP microvesicles shed from LNCaP cells. The figure shows that the copies numbers of various oligonucleotide probe species increased with each round, indicating that the oligonucleotide probe library is being enriched with those species. The variable regions of several enriched oligonucleotide probes are shown in Table 25. The probes are 5' biotinylated. These probes are from the enrichment performed with 5 ng library on exosomes from VCaP and LnCaP cells. Table 25 shows nine sequences with fold changes of at least 4.0-fold elevated in VCaP versus LNCaP. Each sequence also had averaged normalized counts of at least 500 for probing on VCaP exosomes. Fold changes are shown in the table. FIG. 14B shows copies recovered after probing (see Example below for protocol) with the nine oligonucleotide probes in the table. Also as shown in the table, the reverse complement of the entire probe sequences (i.e., including the F-Trin-B primers shown above) are used as controls.

from LNCaP cells as seen by probing with a library of the nine individual DNA sequences in Table 25. The figure also shows probing with the reverse complement controls. As expected, these sequences showed little recovery with the exosomes as compared to the oligonucleotide probe sequences with variable regions SEQ ID NOs 2953-2961.

Several proteins have been identified by probing ofexosomes from VCaP cells with an aptamer having variable region 5'-TACTTAATTGGGGGGGGGGATTCTGTTTT-GTCTCT-3' (i.e., SEQ ID NO 2959) followed by pull downs and analysis by mass spectrometry. See Example 9 for methodology. Exemplary results are shown in Table 26. These experiments identified key proteins in the regulation of exosome biogenesis (ESCRT, Syntenin) and endocytic trafficking (chemokine CXCL11) overexpressed in Cancer. The ESCRT machinery (ESCRT-0, I, II and III) participates in exosomes biogenesis and the proteins have been observed to be overexpressed in human cancers. See, e.g., Kowal et

TABLE 25

Variable Regions of Oligonucleotide probes

| Variable Regions (5'->3') | SEQ ID NO | Fold Change (VCaP/LNCaP) |
|---|---|---|
| ATATGGGGTTTATGGGGATGGTGTTATGGGTGGAATGA | 2953 | 5.4 |
| ATGGGGAGGGGGGTAGGCTGTCTTAATTGGTGGTT | 2954 | 4.3 |
| ATTAATGGGTGGGGGGTTTAGCTTGATGTGGGTTGTGA | 2955 | 4.0 |
| GAATGGGGGGATACTGTTAGTGTGGGTCTGGGGGT | 2956 | 6.7 |
| GGGGGGGGCTTTTTATGGTTTCTGGGGGACCTGCT | 2957 | 4.9 |
| GGTGATGAATTAAATGGGGGGGGTATCAAGTGTGGA | 2958 | 6.5 |
| TACTTAATTGGGGGGGGGGATTCTGTTTTGTCTCT | 2959 | 6.2 |
| TAGCCTTTGGGGGTTGTTTTGGGGGATTGGGTTGTTGA | 2960 | 6.3 |
| TAGTGACTACGGGTATGGGGATTGGGGGTTTGGTTTGA | 2961 | 4.5 |

| Reverse Complements (5'->3') | SEQ ID NO |
|---|---|
| /5Biosg/TCGTCGGCAGCGTCAGATGTGTATAAGAGACAGTCATTCCACCCATAACACCATCCCCATAAACCCCATATACGTACTGCAGTCATGCTAG | 2962 |
| /5Biosg/TCGTCGGCAGCGTCAGATGTGTATAAGAGACAGAACCACCAATTAAGACAGCCTACCCCCCTCCCCATACGTACTGCAGTCATGCTAG | 2963 |
| /5Biosg/TCGTCGGCAGCGTCAGATGTGTATAAGAGACAGTCACAACCCACATCAAGCTAAACCCCCCACCCATTAATACGTACTGCAGTCATGCTAG | 2964 |
| /5Biosg/TCGTCGGCAGCGTCAGATGTGTATAAGAGACAGACCCCCAGACCCACACTAACAGTATCCCCCCATTCACGTACTGCAGTCATGCTAG | 2965 |
| /5Biosg/TCGTCGGCAGCGTCAGATGTGTATAAGAGACAGAGCAGGTCCCCCAGAAACCATAAAAAGCCCCCCCCACGTACTGCAGTCATGCTAG | 2966 |
| /5Biosg/TCGTCGGCAGCGTCAGATGTGTATAAGAGACAGTCCACACTTGATACCCCCCCATTTAATTCATCACCACGTACTGCAGTCATGCTAG | 2967 |
| /5Biosg/TCGTCGGCAGCGTCAGATGTGTATAAGAGACAGAGAGACAAAACAGAATCCCCCCCCCCAATTAAGTAACGTACTGCAGTCATGCTAG | 2968 |
| /5Biosg/TCGTCGGCAGCGTCAGATGTGTATAAGAGACAGTCAACAACCCAATCCCCCAAAACAACCCCCAAAGGCTAACGTACTGCAGTCATGCTAG | 2969 |
| /5Biosg/TCGTCGGCAGCGTCAGATGTGTATAAGAGACAGTCAAACCAAACCCCCAATCCCCATACCCGTAGTCACTAACGTACTGCAGTCATGCTAG | 2970 |

Figure 14C:
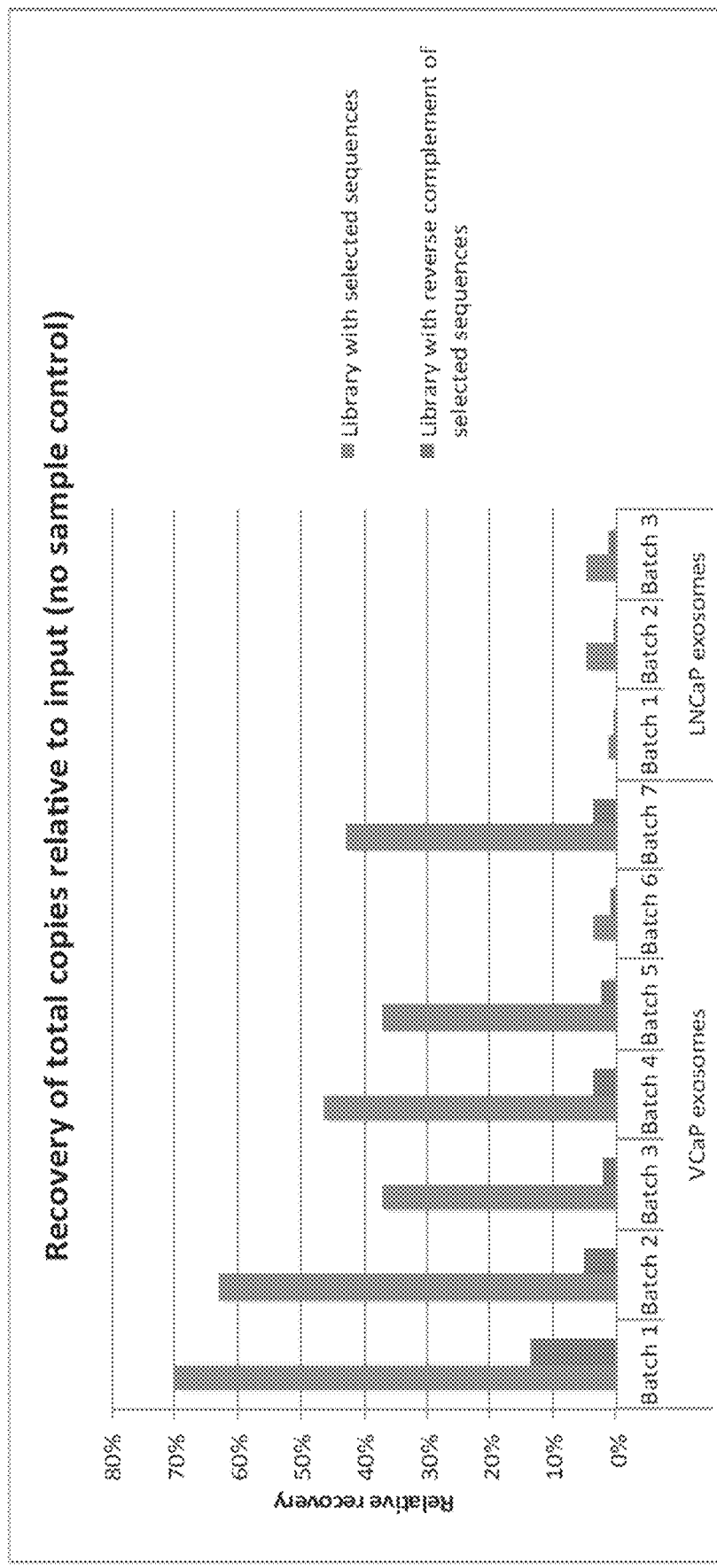

FIG. 14C shows higher recovery on six out of seven batches of isolated VCaP exosomes compared to exosomes al., Biogenesis and secrection of exosomes, *Current Opinion in Cell Biology,* 2014, 29:116-125; Hurley and Hanson, Membrane budding and scission by the ESCRT machinery: it's all in the neck, *Nat Rev Mol Cell Biol,* 2010 11:556-566; Raiborg and Stenmark, The ESCRT machinery in endosomal sorting of ubiquitylated membrane proteins, *Nature* 2009 458: 45-52, all of which proteins are incorporated by reference herein in their entirety. The experiments further identified cold shock proteins whose miRNA suppression sensitizes cells to chemotherapeutic agents.

Negative controls from the above enrichment with 5 ng library on exosomes from VCaP and LnCaP cells were also identified. Several are shown in Table 27. The Table shows 3 sequences with fold changes of at least 4.0 higher on LNCaP exosomes and 2 sequences with fold changes of 1 (indicating no fold change between VCaP and LNCaP exosomes). The variable regions are shown in Table 27. Also as shown in the table, the reverse complement of the entire probe sequences (i.e., including the F-Trin-B primers shown above) are used as controls.

TABLE 26

Proteins from VCaP exosomes pulled down with Sequence 7

| Accession | Description | Cellular role |
| --- | --- | --- |
| O14625 | C-X-C motif chemokine 11 GN = CXCL11 (also Interferon-inducible T-cell alpha chemoattractant (I-TAC)) | chemokine that is overexpressed in blood and tissue of men with advanced prostate adenocarcinomas |
| Q92616 | Translational activator GCN1 GN = GCN1 | |
| Q9H444 | Charged multivesicular body protein 4b GN = CHMP4B | ESCRT-III; membrane scission |
| Q14767 | Latent-transforming growth factor beta-binding protein 2 GN = LTBP2 | |
| P26599-3 | Isoform 3 of Polypyrimidine tract-binding protein 1 GN = PTBP1 (also Heterogeneous nuclear ribonucleoprotein I (hnRNP I)) | cancer associated splicing factor |
| P98179 | RNA-binding protein 3 GN = RBM3 | part of ESCRT-III; membrane scission; cold shock protein. Knock-down has been shown to enhance chemotherapeutic cell killing of prostate cells |
| O43633 | Charged multivesicular body protein 2a GN = CHMP2A | |
| P62888 | 60S ribosomal protein L30 GN = RPL30 | |
| Q9UK41-2 | Isoform 2 of Vacuolar protein sorting-associated protein 28 homolog GN = VPS28 | part of ESCRT-I; membrane budding with ESCRT-II |
| O60884 | DnaJ homolog subfamily A member 2 GN = DNAJA2 | |
| Q14011-3 | Isoform 3 of Cold-inducible RNA-binding protein GN = CIRBP (A18 hnRNP) | cold shock protein. Knock-down has been shown to enhance chemotherapeutic cell killing of prostate cells |
| Q8N684-3 | Cleavage and polyadenylation specificity factor subunit 7 GN = CPSF7 | |
| P05109 | Protein S100-A8 GN = S100A8 | |
| P05386 | 60S acidic ribosomal protein P1 GN = RPLP1 | |
| Q7LBR1 | Charged multivesicular body protein 1b GN = CHMP1B | associated to ESCRT-III; regulation of membrane scission and ESCRT-III disassembly |
| O00560-1 | Syntenin-1 GN = SDCBP | adaptor protein that binds to syndecans and ALIX which interacts with multiple ESCRT proteins |

TABLE 27

Variable Regions of Oligonucleotide probes

| Variable Regions (5'->3') | SEQ ID NO | Fold Change (VCaP/LNCaP) |
| --- | --- | --- |
| TCCGTTTATCTACTTTTCCGGTACTGTTCCCGTTT | 2971 | 0.2 |
| ATCGCGTCGCCCCCGGATATTATTGTTTCTTGTTC | 2972 | 0.2 |
| TTGCTTGCCCGGCCATAAACACGATCTTGTTCTCTA | 2973 | 0.2 |
| GATACGGTCTTTGGTGCTTGTGTGAATCTATGGGGTGA | 2974 | 1.0 |
| TCCTGGTTTCTGGTGGTTTATTTAGCTTGTTACCTGA | 2975 | 1.0 |
| AGTGGGTGGTGGGTTCGGTTTGCTTGGTTCCCTGTTGA | 2976 | |
| ATTGAGGTGGTTTTGAGGTGGGCTATCTGAGGGAT | 2977 | |

TABLE 27-continued

| Variable Regions of Oligonucleotide probes | |
|---|---|
| GGGGGGGGCTTTTTATGGTTTCTGGGGGACCTGCT | 2978 |
| ATATGGGGTTTATGGGGATGGTGTTATGGGTGGAATGT | 2979 |

| Reverse Complements (5'->3') | SEQ ID NO |
|---|---|
| /5Biosg/TCGTCGGCAGCGTCAGATGTGTATAAGAGACAGAAACGGGAACAGTACCGGAAA AGTAGATAAACGGAACGTACTGCAGTCATGCTAG | 2980 |
| /5Biosg/TCGTCGGCAGCGTCAGATGTGTATAAGAGACAGGAACAAGAAACAATAATATCC GGGGGCGACGCGATACGTACTGCAGTCATGCTAG | 2981 |
| /5Biosg/TCGTCGGCAGCGTCAGATGTGTATAAGAGACAGTAGAGAACAAGATCGTGTTTA TGGCCGGGCAAGCAAACGTACTGCAGTCATGCTAG | 2982 |
| /5Biosg/TCGTCGGCAGCGTCAGATGTGTATAAGAGACAGTCACCCCATAGATTCACACAA GCACCAAAGACCGTATCACGTACTGCAGTCATGCTAG | 2983 |
| /5Biosg/TCGTCGGCAGCGTCAGATGTGTATAAGAGACAGTCAGGTAACAAGCTAAATAAA CCACCAGAAACCAGGAACGTACTGCAGTCATGCTAG | 2984 |
| /5Biosg/TCGTCGGCAGCGTCAGATGTGTATAAGAGACAGTCAACAGGGAACCAAGCAAAC CGAACCCACCACCCACTACGTACTGCAGTCATGCTAG | 2985 |
| /5Biosg/TCGTCGGCAGCGTCAGATGTGTATAAGAGACAGATCCCTCAGATAGCCCACCTC AAAACCACCTCAATACGTACTGCAGTCATGCTAG | 2986 |
| /5Biosg/TCGTCGGCAGCGTCAGATGTGTATAAGAGACAGAGCAGGTCCCCCAGAAACCAT AAAAAGCCCCCCCCACGTACTGCAGTCATGCTAG | 2987 |
| /5Biosg/TCGTCGGCAGCGTCAGATGTGTATAAGAGACAGACATTCCACCCATAACACCAT CCCCATAAACCCCATATACGTACTGCAGTCATGCTAG | 2988 |

Assays such as qPCR, cell enzyme linked assay (ELA), confocal microscopy and cell viability assays are performed to verify binding of oligonucleotides to cells and identify potential cell killing properties of certain oligonucleotides.

Example 18: Enrichment Protocol for Microvesicles

Samples:

Experiment 1

(F98 cells: Organism: *Rattus norvegicus*; Cell Type: Glioblastoma; Tissue: brain; Disease: undifferentiated malignant glioma)

25 ug of microvesicles from transfected F98 cells (EGFR+) for each positive step 25 ug of microvesicles from parental F98 cells for each negative step Experiment 2: (Prostate Cancer Cell Lines)

25 ug of microvesicles from VCaP cells for each positive step 25 ug of microvesicles from LnCaP cells for each negative step Controls:

Reaction buffer with no microvesicles for each positive and negative step

Reaction Buffer: 1×PBS+3 mM MgCl2+0.5% F127+1 mg/ml HSA

Sample Preparation: prepare 25 ug of microvesicles in 35 ul 1×PBS and add 35 ul of 1×PBS+6 mM MgCl2+1% F127+2 mg/ml HSA to obtain 25 ug of microvesicles in 70 ul of 1×PBS+3 mM MgCl2+0.5% F127+1 mg/ml HSA Enrichment Scheme:

First round: only positive step

Second round: positive step→negative step→positive step

Third round: positive step→negative step→positive step

Fourth round: positive step→negative step→positive step

Each round ends with PCR followed by purification of ssDNA after gel electrophoresis I. Preparations a) Pre-chill tabletop centrifuge at 4° C.

b) Add competitors as listed below to each 25 ug of transfected F98 or VCaP microvesicles in 70 ul reaction buffer and incubate for 20 min with shaking at 500 rpm on mixmate.

c) Mixture of two competitors:

Competitor salmon DNA: add 800 ng of salmon DNA (Stock 10 ug/ul→Dilute 1:125 with reaction buffer [80 ng/ul]→10 ul input).

Competitor t-RNA: add 800 ng of tRNA (Stock 10 ug/ul→Dilute 1:125 with reaction buffer [80 ng/ul]→10 ul input).

d) Bring the volume to 180 ul with 90 ul of reaction buffer, for the blocking.

II. Library/Sample Incubation (Positive Selection)

Prepare 5 ng and 50 ng of F-TRin-35n-B Starting Library for first round in 20 ul of reaction buffer. After heating the DNA for 3 min @ 95C, put it on ice immediately for 5 min. Add DNA to the blocked cells and incubate them for 30 min at RT, with end-over-end rotation.

III. Precipitation Protocol with 6% PEG8000 a) Use microvesicles from step II as sample.

b) Add 200 ul of 12% PEG8000 to 200 ul of sample.

c) Leave sample on ice for 30 min.

d) Spin at 16000×g for 10 min and discard supernatant.

e) Re-suspend pellet in 200 ul reaction buffer and centrifuge again at 16000×g for 10 min f) Re-suspend pellet in 30 ul of reaction buffer.

g) First round: go straight to PCR. Following rounds: go to IV.

IV. Oligonucleotide Probe Elution

Add 10 ul of 0.25N NaOH to cells from III, incubate for 10 min at 50 C, mix-mate and agitate for 5-10 sec at 550 rpm→Add 10 ul of 0.25 N HCL→Spin at 16000×g for 10 min at 4 C. Collect the supernatant; this will be used as library for the next step.

V. Library/Sample Incubation (Negative Selection)

To each 25 ug of parental F98 or LnCaP exosomes in 70 ul reaction buffer add the mixture of competitors (10 ul of Salmon sperm DNA @ 80 ng/ul+10 ul of Yeast t-RNA @ 80 ng/ul), bring the volume to 150 ul by addition of 60 ul reaction buffer and incubate for 20 min with shaking at 500 rpm on mixmate. Then add eluted oligonucleotide probe libraries (~50 ul) (heat treat for 3 min@ 95C, incubate on ice immediately for 5 min) from step IV and incubate 30 min at room temperature (RT).

VI. Precipitation protocol with 6% PEG8000 (using sample from III)

a) Use microvesicles/DNA mixture from step V.
b) Add 200 ul of 12% PEG8000 to 200 ul of sample.
c) Leave sample on ice for 30 min.
d) Spin at 16000×g for 10 min and collect supernatant.

VII. Library/Sample Incubation (Positive Selection)

To each 25 ug of transfected F98 or VCaP exosomes in 70 ul reaction buffer add the mixture of competitors (10 ul of Salmon sperm DNA @ 80 ng/ul+10 ul of Yeast t-RNA @ 80 ng/ul) and incubate for 20 min with shaking at 500 rpm on mixmate. Then, add oligonucleotide probe libraries (~400 ul) (heat treat for 3 min@ 95 C, put it on ice immediately for 5 min) from step VI and incubate 30 min at RT (total volume of 490 ul).

VIII. Precipitation Protocol with 6% PEG8000 a) Use microvesicles from step VII as sample.
b) Add 490 ul of 12% PEG8000 to 490 ul of sample.
c) Leave sample on ice for 30 min.
d) Spin at 16000×g for 10 min and discard supernatant.
e) Re-suspend pellet in 200 ul reaction buffer and centrifuge again at 16000×g for 10 min
f) Re-suspend pellet in 30 ul of reaction buffer.
g) Go to PCR.

Probing

Exosomes can be probed with the enriched oligonucleotide probe libraries. For these experiments, exosomes are contacted with ssDNA enriched oligonucleotide probe libraries, precipitated with 6% PEG8000, and the co-precipitated oligonucleotide probes are amplified by qPCR.

Example 19: Oligonucleotide Enrichment on HER2+ Tissue Samples

Receptor tyrosine-protein kinase erbB-2 (ERBB2) is a protein encoded by the ERBB2 gene, which is also frequently called HER2 (human epidermal growth factor receptor 2) or HER2/neu. About 20% of breast cancers overexpress the HER2 gene, which causes cells to receive improper signals to grow and divide. HER2+ cancers tend to be aggressive and fast-growing. For individuals with HER2+ breast cancers, the anti-HER2 monoclonal antibody trastuzumab (trade name Herceptin) has been shown to dramatically reduce the risk of recurrence.

Figure 15A:
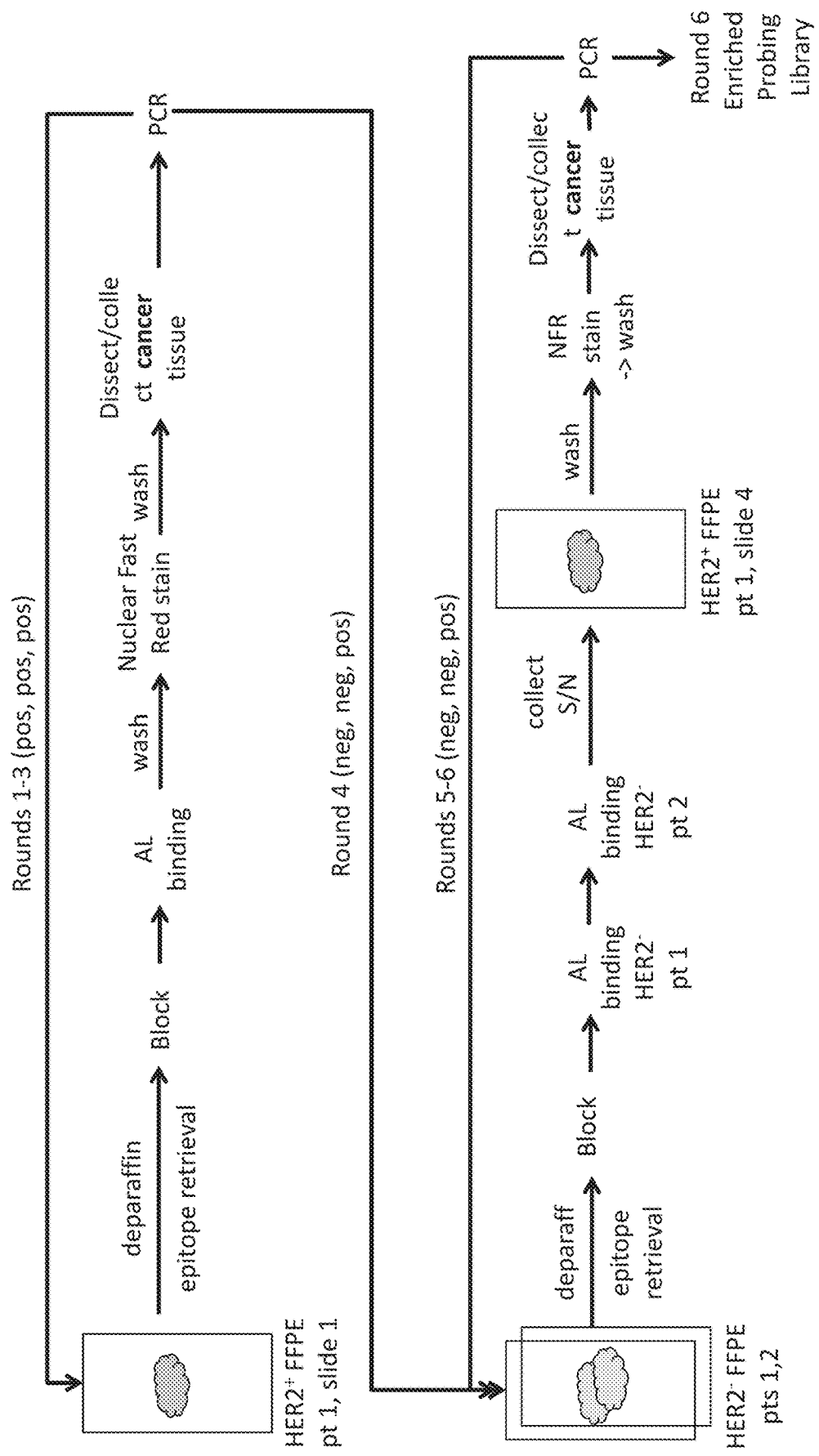
Figure 15B:
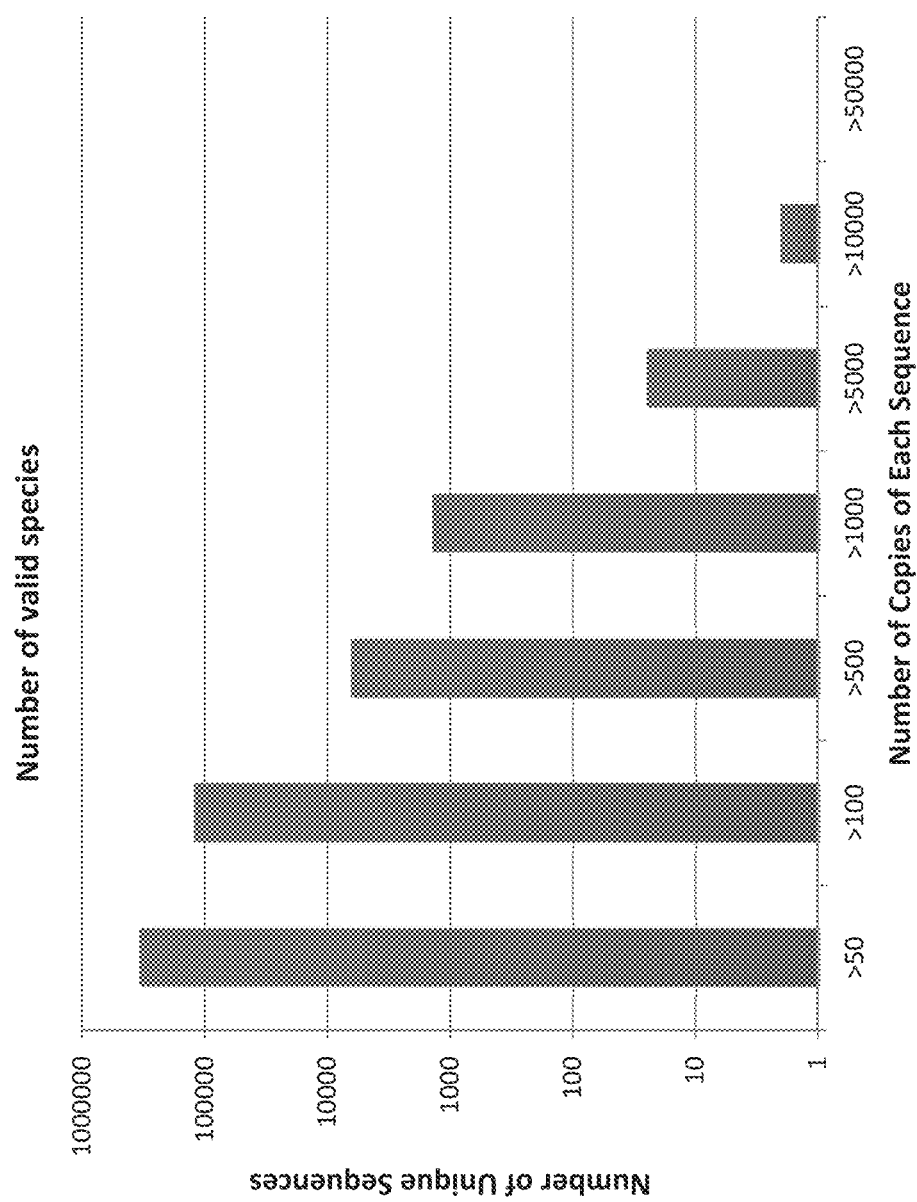

In this Example, we enriched a naïve F-Trin-B oligonucleotide probe library against HER2 positive (HER2+) fixed tissue samples. The probe library is as described herein, i.e., each member has a 5' primer CTAGCATGACT-GCAGTACGT (SEQ ID NO 4) and a 3' primer CTGTCTCTTATACACATCTGACGCTGCCGACGA (SEQ ID NO 5) surrounding a variable region. Enrichment was performed as described herein using six rounds of selection against FFPE (fresh frozen paraffin embedded) tissue from five patients with HER2+ invasive breast cancer (the HER2+ cohort) and six patients with HER2− invasive breast cancer (the HER2− cohort). HER2 status was determined by IHC assay. The blocking buffer used during selection comprised Salmon sperm DNA, tRNA, F127 polymer, and BSA protein. The enrichment scheme is detailed in FIG. 15A. As indicated in the figure, rounds 1-3 were performed using positive selection only (i.e., to enrich binders to the HER2+ samples). Rounds 4-6 used both positive selection against the HER2+ samples and negative selection against the HER2− samples. The enriched library at the end of round 6 was used in further studies as the Enriched Probing Library. Attributes of the Enriched Probing Library are shown in FIG. 15B, wherein the number of unique valid sequences is plotted against the numbers of copies of each sequence, as determined by NGS. The Enriched Probing Library comprised $3.6 \times 10^7$ unique sequences. The variable regions of the 50 most prevalent sequences are listed in order of highest prevalence to lower prevalence in SEQ ID NOs 2989-3038.

The Enriched Probing Library was used to stain HER2+ and HER2− breast cancer tissue. FIG. 15C shows representative staining of a HER2+ tumor sample after no enrichment (Round 0, "R0" in the figure, left panel) or after the six rounds of enrichment (post-Round 6, "R6" in the figure, right panel). As seen in the figure, much higher amounts of stain were observed with the enriched R6 probe library as compared to the naïve R0 library. Similarly, FIG. 15D shows representative staining of a HER2− tumor sample after no enrichment (R0, left panel) or after the six rounds of enrichment (R6, right panel). As seen in the figure, little to no staining was observed with either the enriched R6 probe library or the naïve R0 library.

Figure 15E:
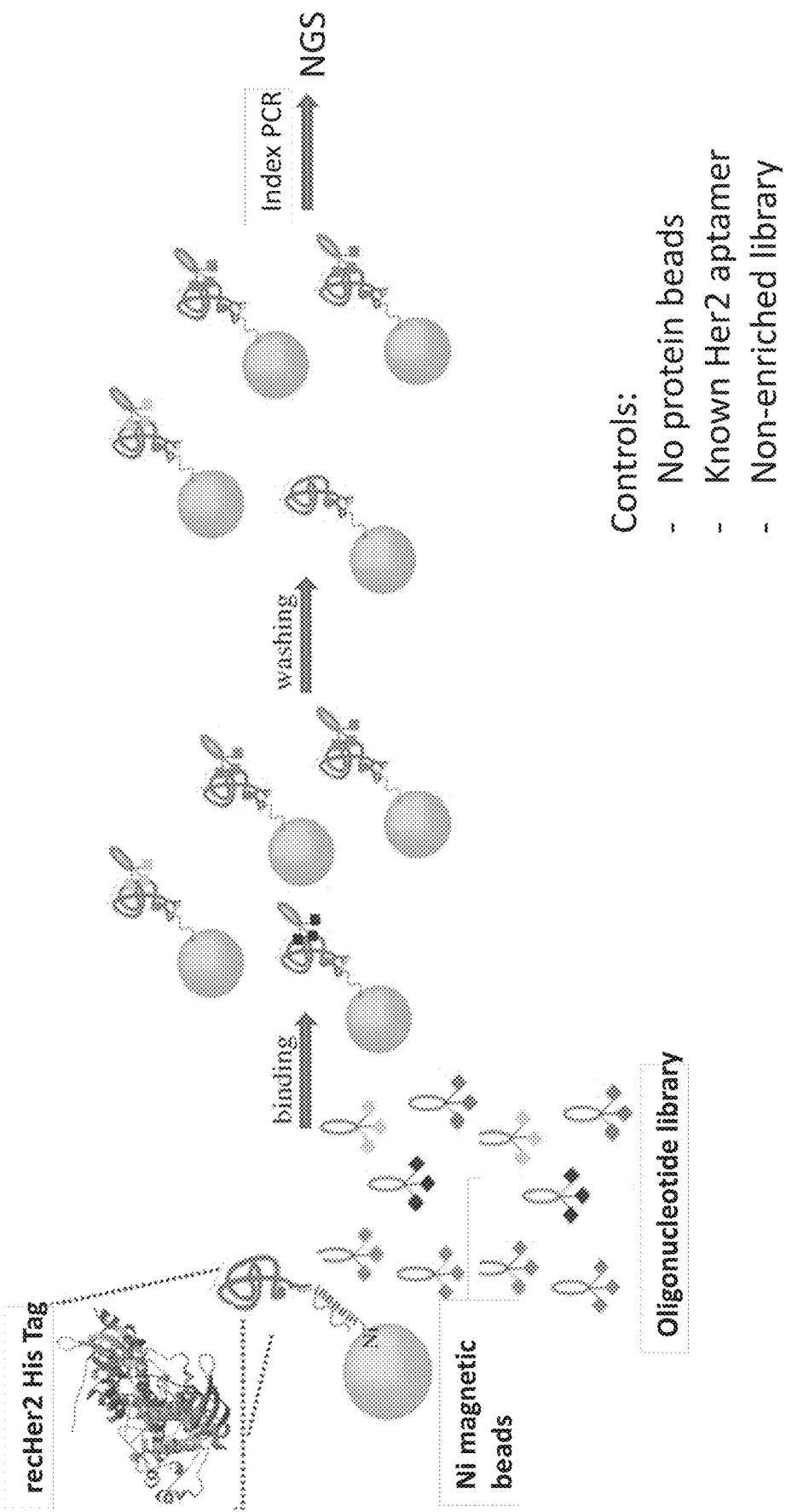

To identify specific members of the Enriched Probing Library that bind HER2, the experimental plan outlined in FIG. 15E was performed. Recombinant HER2 caring a histadine tag ("recHer2 His Tag") was conjugated to magnetic beads ("Ni magnetic beads"). The beads were mixed with the Enriched Probing Library ("Oligonucleotide library") and allowed to incubate to allow binding of probes to the HER2 beads. The bound beads were washed and probe binders were recovered and identified by next generation sequencing (NGS). Similar experiments were performed with negative controls to filter out probes that bind assay components, including No protein beads and Non-enriched library. A known HER2 aptamer was used as a positive control. The experiments were performed twice and a number of filters were applied, such as sequences that appeared in both sets of binding experiments and did not bind the protein beads. With all controls filtered out, there were 404 sequences remaining. The variable regions of the most prevalent sequences, ordered by prevalence, are listed as SEQ ID NOs 3039-3061. These sequences are ordered individually and used in an immunoassay format to identify HER2 binders.

We next explored targets of the R6 library. The R6 library and the unenriched R0 library were amplified with a Biotin-C3-C6-amine primer. The libraries were TBE gel purified, conjugated with the amine reactive diazirine crosslinker, Sulfo-NHS-SS-Diazirine (Sulfo-SDAD) (sulfosuccinimidyl 2-[(4,4'-azipentanamido)ethyl]-1,3'-dithiopropionate) (Thermo Scientific) and purified by HPLC to remove the unconjugated oligonucleotides. The SDAD conjugated library was then qualified for staining HER2+ or HER2− FFPE tissue slides compared to the biotinylated library used for enrichment as detailed above.

Binding of the conjugated library was done under similar conditions used for the selection on HER2+ or HER2− tissue on a Ventana Discovery Ultra instrument (Ventana Medical Systems, Tucson, Ariz.). One set of slides for each tissue (HER2+ or HER2) were stained with the R6 library, the R0 library, or no library to assess the level of specific binding. In parallel, nine slides per condition was removed prior to detection with Streptavidin-horse radish peroxidase (Strept-HRP) and were subjected to photocrosslinking 2 cm above the slide at 365 nm with a handheld UV light for 10 minutes on ice. Slides were then scraped into QProteome buffer without beta-mercaptoethanol added (Qiagen) and extracted according to manufacturer's instructions. Detergent was removed with HiPPR detergent removal columns (Thermo Fisher Scientific) and protein concentration was then determined with the BCA assay. Cross-linked protein-aptamer complexes were then affinity purified from 200 plg of FFPE tissue lysate by incubation with 10 L of Dynabeads® MyOne™ Streptavidin C1 (Thermo Scientific) for 30 mins at room temperature, washed twice with 1×TBS, washed twice with high stringency wash buffer (10 mM Tris, 2M NaCl, 1 mM EDTA, 1% Triton X-100), followed by two washes with low stringency wash buffer to remove the NaCl, resuspended in 1×PBS and eluted by boiling in 1× lauryl dodecyl sulfate (LDS) with reducing agent. Reducing the samples transfers the crosslinker from the aptamer to the protein targets. The reduced samples were run under reducing conditions in a 4-12% SDS-PAGE gel at 150 volts for 15 min. The entire lane was excised and subjected to in-gel trypsin digestion. Alkylation with iodoacetamide was replaced with Iodoacetyl Tandem Mass Tag™ (iodoTMT; Thermo Fisher Scientific) to facilitate identification of cross-linked targets by LC-MS/MS.

Results for one HER2+ case are shown in Table 28. These results were filtered to remove proteins that also cross-linked with the unenriched R0 library. Background binding with the R0 library appeared to be most prevalent in the nucleus. The table indicates whether the identified proteins have been reported in association with HER2 or breast cancer (BrCa) or a clinical trial (for any indication), or have been used or suggested as a drug target for any indication. References are noted in brackets.

TABLE 28

Targets of R6 Identified for One HER2+ Tissue Sample

| Accession | Gene ID | Description | Her2 or BrCa related? | Drug Target | Clinical Trial |
|---|---|---|---|---|---|
| P60709 | ACTB | Actin, cytoplasmic 1 | Her2 and ATPase2 in actin rich membrane domains [1] | | |
| P14618 | PKM | Pyruvate kinase PKM | Early marker for response to trastuzumab therapy-tumor M2-PK (alias for PKM) determination in the plasma of patients with metastasized breast cancer could be a helpful tool for monitoring therapeutic success. Dichloroacetate (DCA, an inhibitor of the mitochondrial pyruvate dehydrogenase kinase) was able to depolarize cancer (but not normal) mitochondria and induce apoptosis in cancer but not normal tissues [2] | Yes | Yes |
| P17858-1 | PFKL | ATP-dependent 6-phosphofructokinase, liver type | pentose phosphate pathway gene; hexokinase-2, a key mediator of aerobic glycolysis, and the downstream proteins PFKL and ENO1; activated by p53 [3] | Yes | Yes |
| P25705-1 | ATP5A1 | ATP synthase subunit alpha, mitochondrial | Ectopic ATP synthase is a drug target for breast cancer; ATP synthase inhibitor citreoviridin [4], [5] | Yes | Yes |
| P06576 | ATP5B | ATP synthase subunit beta, mitochondrial | Ectopic ATP synthase is a drug target for breast cancer; ATP synthase inhibitor citreoviridin [4], [5] | Yes | Yes |
| P47914 | RPL29 | 60S ribosomal protein L29 | up in MCF-7 with treated with recombinant bromelain vs untreated MCF-7 [6] | Yes | |
| P62917 | RPL8 | 60S ribosomal protein L8 | The RPL8 antigen may represent a relevant vaccine target for patients with melanoma, glioma, and breast carcinoma whose tumors express this protein [7] | Yes | |

TABLE 28-continued

Targets of R6 Identified for One HER2+ Tissue Sample

| Accession | Gene ID | Description | Her2 or BrCa related? | Drug Target | Clinical Trial |
|---|---|---|---|---|---|
| Q8TEJ3 | SH3RF3 | SH3 domain-containing RING finger protein 3 | E3 ligase activity, anti-apoptotic regulator for the c-Jun N-terminal kinase (JNK) pathway [8], [9] | Yes | |
| P21802 | FGFR2 | Fibroblast growth factor receptor 2 | Target for triple negative Bca therapies. Gain of function mutations in FGFRs were also identified in a variety of human cancers such as myeloproliferative syndromes, lymphomas, prostate and breast cancers as well as other malignant diseases [10], [11] | Yes | Yes |
| P02675 | FGB | Fibrinogen beta chain | High plasma fibrinogen is correlated with poor response to trastuzumab treatment in HER2 positive breast cancer [12] | Yes | Yes |
| O60506 | SYNCRIP | Heterogeneous nuclear ribonucleoprotein Q | Component of the hepatocyte exosomal machinery controlling microrna sorting | ? | |

References in Table 28:
[1] Jeong et al., PMCA2 regulates HER2 protein kinase localization and signaling and promotes HER2- mediated breast cancer, PNAS, E282-E290 (pub'd online Jan. 4, 2016).
[2] Hoopmann et al., Tumor M2 pyruvate kinase-determination in breast cancer patients receiving trastuzumab therapy. Cancer Lett. 2002 Dec. 10; 187(1-2):223-8.
[3] Liu et al, Comprehensive Proteomics Analysis Reveals Metabolic Reprogramming of Tumor-Associated Macrophages Stimulated by the Tumor Microenvironment. J Proteome Res. 2017 Jan. 6; 16(1):288-297.
[4] Chang et al., Combination therapy targeting ectopic ATP synthase and 26S proteasome induces ER stress in breast cancer cells, Cell Death and Disease (2014) 5, e1540
[5] Pan et al., ATP synthase ecto-α-subunit: a novel therapeutic target for breast cancer, Journal of Translational Medicine 2011, 9:211
[6] Fouz et al., Gene expression analysis in MCF-7 breast cancer cells treated with recombinant bromelain. Appl Biochem Biotechnol. 2014 August; 173(7):1618-39.
[7] Swoboda, et al., Shared MHC Class II-Dependent Melanoma Ribosomal Protein L8 Identified by Phage Display. Cancer Res 2007; 67: (8). Apr. 15, 2007
[8] Kärkkäinen et al., POSH2 is a RING finger E3 ligase with Rac 1 binding activity through a partial CRIB domain. FEBS Lett. 2010 Sep. 24; 584(18):3867-72
[9] Wilhelm et al., Sh3rf2/POSHER protein promotes cell survival by ring-mediated proteasomal degradation of the c-Jun N-terminal kinase scaffold POSH (Plenty of SH3s) protein. J Biol Chem. 2012 Jan. 13; 287(3):2247-56.
[10] Eswarakumar et al., Cellular signaling by fibroblast growth factor receptors. Cytokine Growth Factor Rev. 2005 April; 16(2):139-49
[11] Wang and Guda. Integrative exploration of genomic profiles for triple negative breast cancer identifies potential drug targets. Medicine (Baltimore). 2016 July; 95(30): e4321.
[12] Liu et al., High Plasma Fibrinogen is Correlated With Poor Response to Trastuzumab Treatment in HER2 Positive Breast Cancer, Medicine. 94(5) February 2015.
[13] Santangelo et al., The RNA-Binding Protein SYNCRIP Is a Component of the Hepatocyte Exosomal Machinery Controlling MicroRNA Sorting. Cell Rep. 2016 Oct. 11; 17(3):799-808.

This Example presents an approach wherein oligonucleotide probes can be identified using tissue sample input. The resulting oligonucleotides can be used to identify HER2+ tissue samples and distinguish HER2- tissues. General applications of this approach include without limitation identifying predictive biomarkers and identifying drug targets. In this specific case, oligonucleotide probes are identified that indicate aggressive phenotype (i.e., HER2+ tumors are known to be aggressive) but that can be targeted by anti-HER2 treatments. We also identified certain targets of the R6 library in a HER2+ breast cancer sample and specifically identified several drug targets. Moreover, the oligonucleotides themselves can be used to target these proteins, and thus comprise drug candidates at the same time they identify drug targets.

This approach in this Example can be used for any other appropriate biomarkers.

Figure 16A:
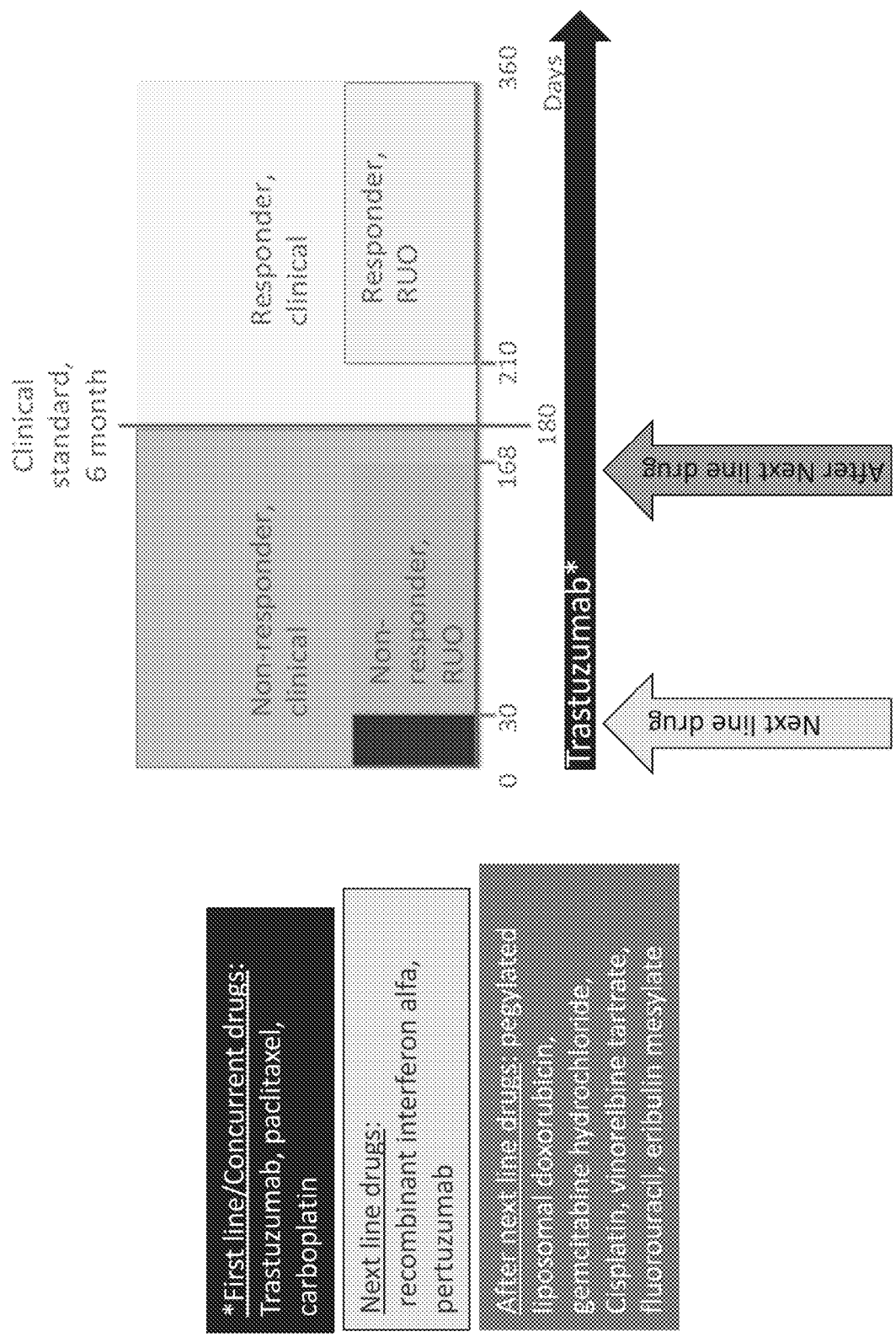

Example 20: Oligonucleotide Enrichment on Tissue Samples to Identify Drug Responders This Example follows the work presented in Example 19 above. The task was to develop an oligonucleotide library capable of distinguishing Breast Cancer (BCa) patients that respond or not to trastuzumab treatment. Often administered together with various chemotherapeutic agents, trastuzumab alone shows efficacy in some patients (<20%) that overexpress HER2 as determined by IHC assay. For purposes of this Example, responders and non-responders are based upon each patient's time-to-next-treatment ("TNT" or "TTNT") as a proxy for response. FIG. 16A illustrates treatment schemes for BCa along with a timeline differentiating between responders and non-responders. As shown the non-responders are treated with another chemotherapy treatment within six months of initiation of treatment with trastuzamab. The resulting oligonucleotides can be used to predict response and direct therapy to proper population of patients.

Figure 16B:
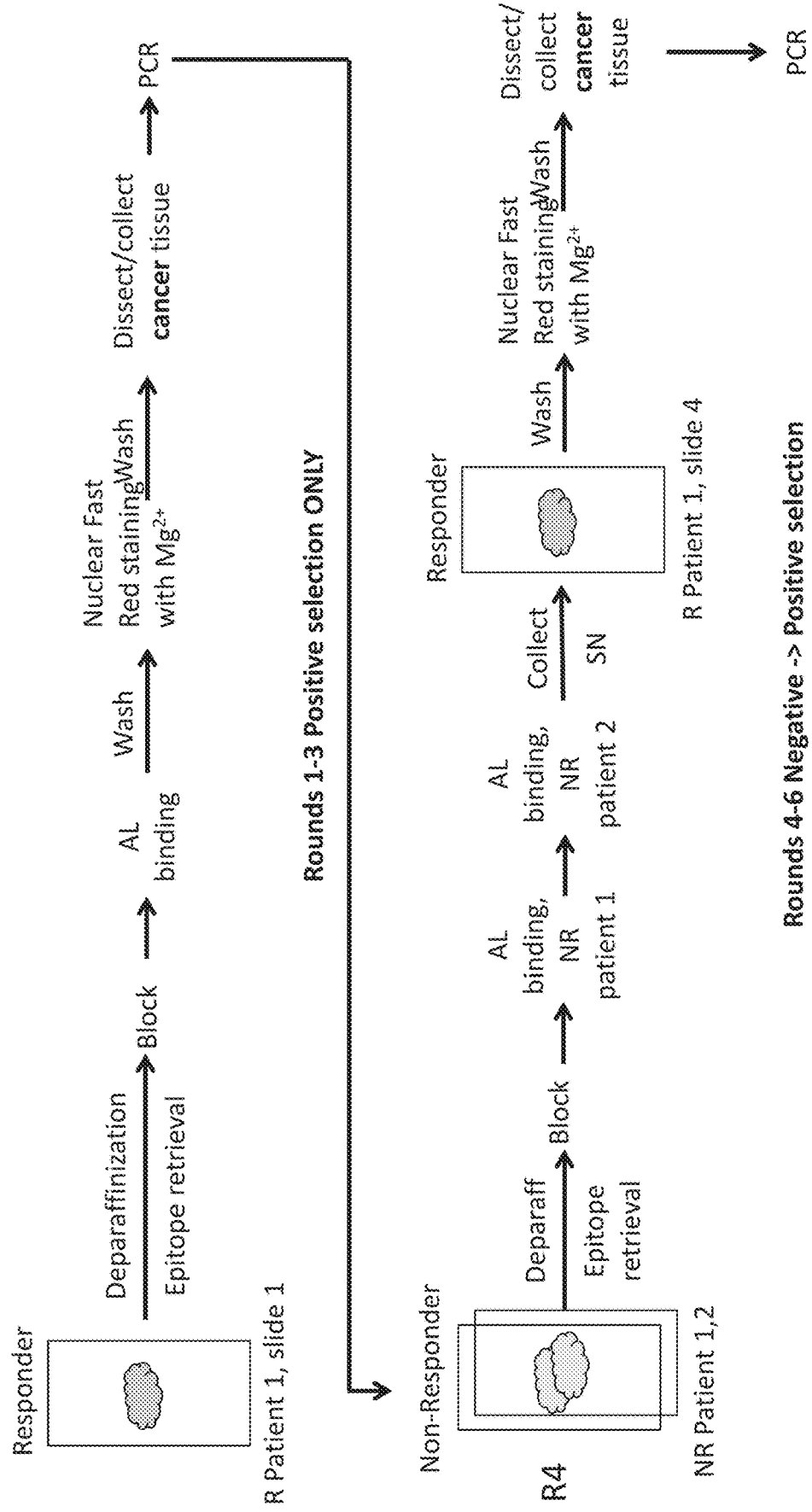

Methodology was similar to that described above in Example 19. A general scheme for enrichment of the naïve F-trin-35 library is shown in FIG. 16B (AL=aptamer library). In the figure, responders are shown as positive samples for selection, but enrichments were similarly performed with non-responders as the positive samples for enrichment. Six rounds of enrichment were performed. 17 enriched oligonucleotide libraries were obtained, wherein eight libraries were trained towards non-responder and nine libraries were trained toward responders. The 17 libraries are referred to as libraries A-S.

Figure 16D:
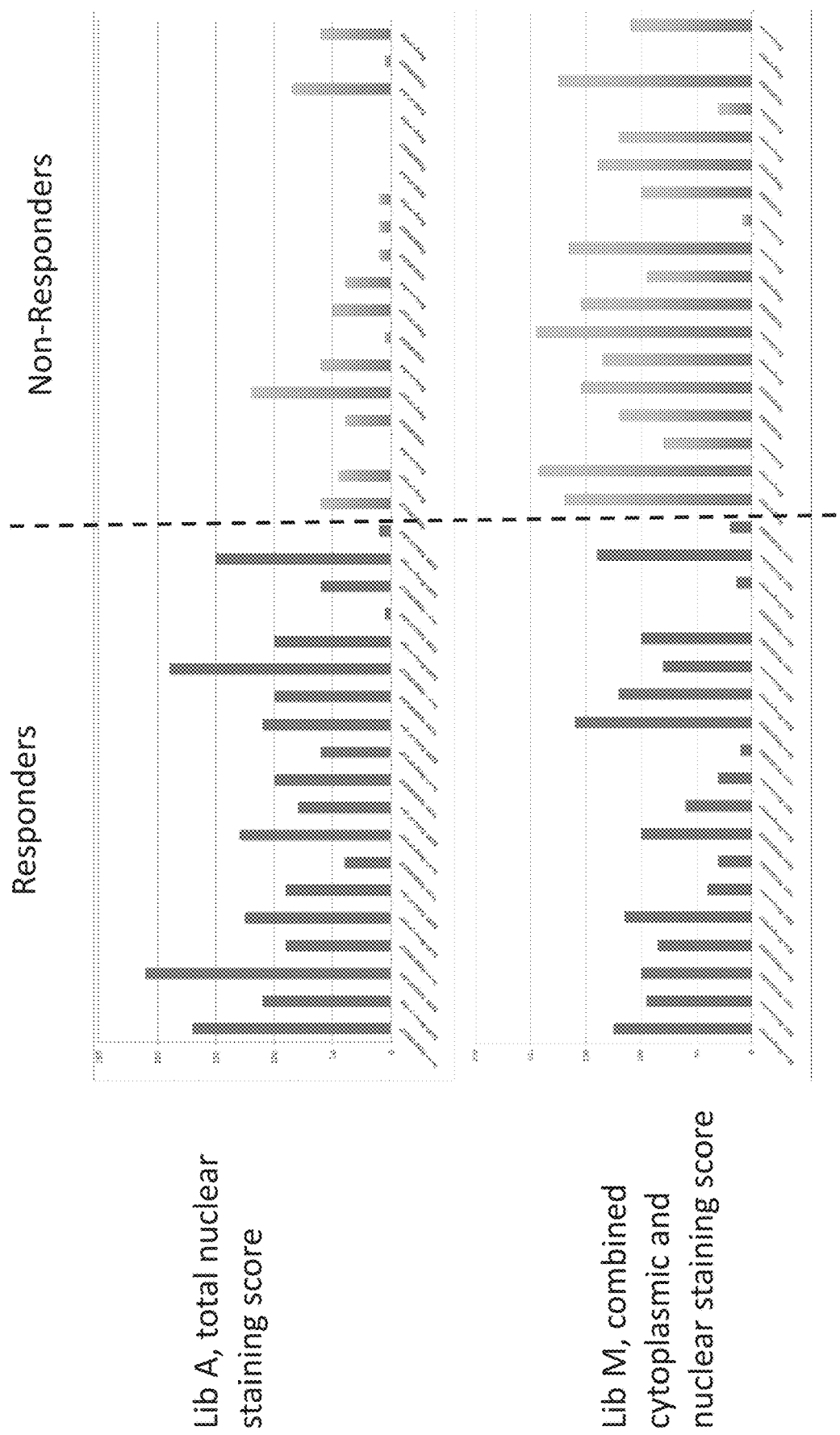
Figure 16E:
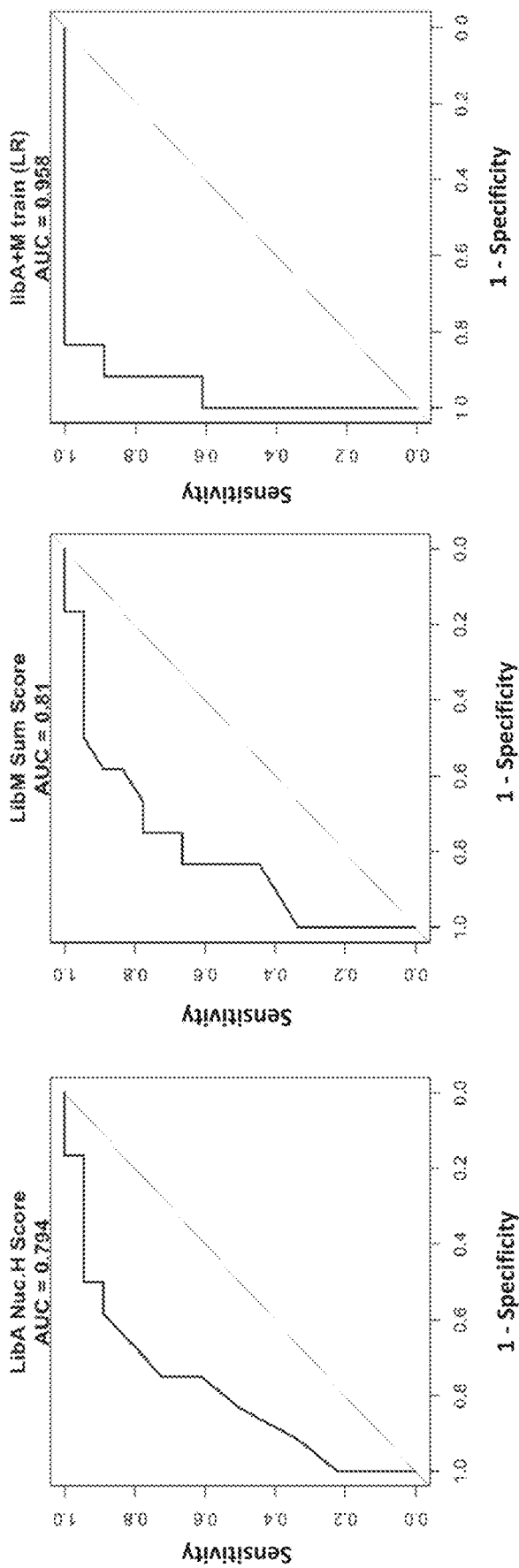
Figure 16F:
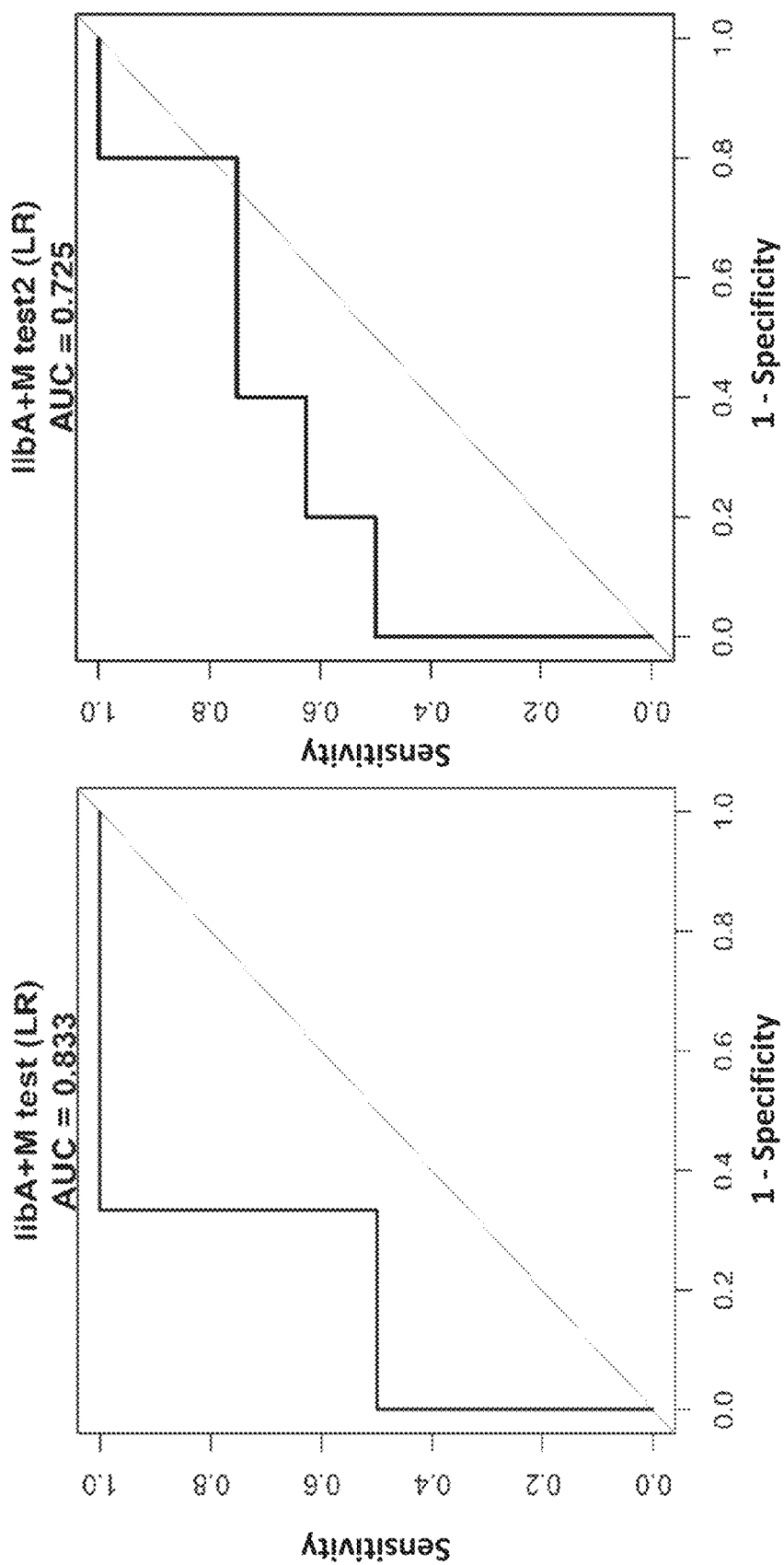

The libraries were trained on a set of 20 non-responders and 20 responders. Given this patient cohort, responders were defined as patients treated for 212 days and up with trastuzamab and non-responders were defined as those treated for 8-119 days with trastuzumab. FIG. 16C shows staining of non-responder and responder samples using oligonucleotide probe library A sorted by staining intensity. As can be observed in the figure, staining was more prevalent in the non-responder samples. Summary results for staining the training samples the Non-responder selected library A and responder selected library M are shown in FIG. 16D. The variable regions of the 100000 most prevalent sequences in library A are included herein as SEQ ID NOs. 3062-103061, ordered by prevalence. The variable regions of the 100000 most prevalent sequences in library M are included herein as SEQ ID NOs. 103062-203061, also ordered by prevalence. ROC curves generated for each library separately and the combined A & M libraries are shown in FIG. 16E. Joint performance was determined using logistic regression. Several non-responder samples without sufficient slides were removed from these data. As shown in FIG. 16E, the trained library A and library M had excellent performance for distinguishing the responder and non-responder samples. As a control, library A was used to stain slides from breast cancer cases that were not treated with trastuzumab. No differential staining patterns were observed (data not shown). FIG. 16F shows results of using the trained libraries to classify two small test sets with significant AUC values as shown. The combined AUC was 0.78, which indicates clinical utility.

Thus, the oligonucleotide probe libraries can be used to identify trastuzumab responder tissues instead of only HER2+ tissues per currently available companion diagnostics.

As in Example 19 above, targets are identified that are responsible for the response (or its absence) to trastuzumab and which can be used to develop more efficient treatment.

Example 21: Polyligand Profiling Differentiates Cancer Patients According to their Benefit of Treatment Patient response to specific cancer treatment is dependent upon subtle differences in tumor systems states that can be difficult to access. Highly multiplexed measurement techniques can be advantageous to assess these perturbations. In this Example, we used polyligand profiling with oligonucleotide probe libraries as described herein to perform such analysis. We generated two single-stranded oligodeoxynucleotide probe libraries that distinguish between tumor tissue from breast cancer patients who either did or did not derive benefit from trastuzumab-based regimens. Testing of an independent sample set verified the ability of the libraries to differentiate patients, as assessed by calculating AUC values from ROC curves in comparison to standard HER2-immunohistochemical scoring. Kaplan-Meier plots confirmed that outcomes were in accordance with test results: Test-positive patients had a median duration of 604 days of trastuzumab treatment, whereas test-negative patients had a median duration of 129 days of trastuzumab treatment. Thus, this Example demonstrates use of polyligand profiling to classify distinct clinical outcomes.

Precision oncology seeks to adapt the treatment of individual cancer patients to the specific mutations and unique molecular interaction networks of each tumor. The genomic complexity and heterogeneity of the underlying molecular signatures is vast and each tumor can have its unique profile, even within the same patient (1-3). Patients that benefit from specific treatment regimens often differ from those that do not in features other than merely the expression status of single or small numbers of biomarkers. Consequently, the current paradigms for precision oncology rely on three major pillars: First, the identification of mutations by DNA/RNA sequencing in patients' tumors; second, the quantification of known biomarkers in tumor tissue; third, the identification of new biomarkers and master regulator genes. However, based on the limited success of several recent clinical trials, the prospect and potential of precision oncology has recently been challenged (4, 5). Thus, limitations have become evident and call for a paradigm-shift to facilitate the identification of patients who will or will not benefit from a particular cancer treatment (6-8) and the development of improved companion diagnostic tests (CDx) (9). Because single or small numbers of biomarkers may not always adequately predict treatment benefit, in these cases a more effective CDx would simultaneously access the multitude of intricate molecular features that underlie the vastly complex and currently largely unpredictable phenotype of drug response. Accessing the phenotypic diversity conferred by tumor heterogeneity and the changes in the tumor microenvironment that are induced by tumor cells may require identification of subtle variations in the underlying molecular interaction network, or interactome, the complexity of which is estimated to consist of several hundred thousand, or even millions of multi-molecular complexes (10). Such identification may benefit from an unbiased, hypothesis-free approach to access informative and highly complex molecular characteristics, a challenge that could require an equal or greater number of potential detector molecules.

Here we report one approach to achieve this comprehensive goal: polyligand profiling. In this Example, we assessed the ability of polyligand profiling to differentiate between patients who do or do not derive benefit from a particular cancer treatment, which may also be referred to as responders or non-responders, respectively. We then compare polyligand profiling to immunohistochemical (IHC) analysis of HER2, one of the most successful and widely applied CDx. Her2 is overexpressed in fifteen to thirty percent of human breast cancers (11, 12). Because HER2 amplification is associated with increased tumor cell proliferation and poor prognosis, patients with HER2 positive (HER2+) breast cancer are candidates for treatment with trastuzumab. However, only 30% of patients with HER2+ breast cancer benefit from trastuzumab mono-therapy (13). Trastuzumab (Herceptin) is a monoclonal antibody that binds human epidermal growth factor receptor 2 (HER2, ErbB2) and inhibits its function (14-16).

Materials and Methods for the experiments described in this Example are provided in Example 22 below. Clinical information for patients included in this Example is provided in Tables 29-32. In the tables, "CPP" stands for cyclophosphamide. All samples were breast carcinomas.

TABLE 29

| | | | | Patient Information: Training toward Non-Benefiters (NB) | | | |
|---|---|---|---|---|---|---|---|
| Enrichment case ID | TTNT | HER2 ISH | HER2 IHC | First line regimen | Next line regimen | Additional treatments | Clinical |
| TL-NB+ | 158 | + | + | carboplatin paclitaxel trastuzumab | recombinant interferon alfa-2b pertuzumab | pegylated liposomal doxorubicin hydrochloride gemcitabine hydrochloride cisplatin vinorelbine tartrate fluorouracil eribulin mesylate | Diagnosis: Ultrasound-guided core biopsy, right breast: Infiltrating carcinoma involving all cores. Stage: Unknown Grade: 3/Poorly differentiated |
| TL-NB− | 335 | + | + | carboplatin docetaxel trastuzumab | | | Diagnosis: Left breast, lumpectomy: Invasive ductal carcinoma. Stage: I Grade: 2/Moderately differentiated |
| TL-NB− | 280 | + | + | carboplatin paclitaxel trastuzumab | ado-trastuzumab emtansine | | Diagnosis: Left breast and axilla (modified mastectomy): Invasive ductal carcinoma, poorly differentiated. Stage: IIIC Grade: 3/Poorly differentiated |
| Alt. lib.1+ | 119 | − | − | trastuzumab vinorelbine tartrate | eribulin mesylate | trastuzumab nab-paclitaxel | |
| Alt. lib.1− | 321 | − | − | trastuzumab vinorelbine tartrate | | | |
| Alt. lib.1− | 225 | + | + | trastuzumab vinorelbine tartrate | ado-trastuzumab emtansine | docetaxel pertuzumab nab-paclitaxel | |
| Alt. lib.2+ | 21 | + | + | trastuzumab | docetaxel carboplatin | | |
| Alt. lib.2− | 294 | + | + | trastuzumab | carboplatin gemcitabine hydrochloride | ado-trastuzumab emtansine | |
| Alt. lib.2− | 349 | + | − | trastuzumab | | | |
| Alt. lib.3+ | 15 | + | + | trastuzumab | docetaxel | carboplatin nab-paclitaxel | |
| Alt. lib.3− | 294 | + | + | trastuzumab | carboplatin gemcitabine hydrochloride | ado-trastuzumab emtansine | |
| Alt. lib.3− | 349 | + | − | trastuzumab | | | |
| Alt. lib.4+ | 109 | + | + | paclitaxel pertuzumab trastuzumab | cyclophosphamide doxorubicin hydrochloride | | |
| Alt. lib.4− | 263 | + | + | docetaxel pertuzumab trastuzumab | | | |
| Alt. lib.4− | 217 | − | +/− | nab-paclitaxel pertuzumab trastuzumab | letrozole fulvestrant | | |
| Alt. lib.5+ | 56 | − | +/− | nab-paclitaxel pertuzumab trastuzumab | carboplatin gemcitabine hydrochloride | ado-trastuzumab emtansine eribulin mesylate | |
| Alt. lib.5− | 263 | + | + | docetaxel pertuzumab trastuzumab | | | |
| Alt. lib.5− | 217 | − | +/− | nab-paclitaxel pertuzumab trastuzumab | letrozole fulvestrant | | |
| Alt. lib.6+ | 56 | + | +/− | trastuzumab vinorelbine tartrate | carboplatin | ado-trastuzumab emtansine trastuzumab fulvestrant cyclophosphamide methotrexate fluorouracil leuprolide acetate docetaxel gemcitabine hydrochloride | |

TABLE 29-continued

Patient Information: Training toward Non-Benefiters (NB)

| Enrichment case ID | TTNT | HER2 ISH | HER2 IHC | First line regimen | Next line regimen | Additional treatments | Clinical |
|---|---|---|---|---|---|---|---|
| Alt. lib.6– | 321 | – | – | trastuzumab vinorelbine tartrate | | | |
| Alt. lib.6– | 225 | + | + | trastuzumab vinorelbine tartrate | ado-trastuzumab emtansine | docetaxel pertuzumab nab-paclitaxel | |
| Alt. lib.7+ | 69 | n.p. | – | docetaxel pertuzumab trastuzumab | leuprolide acetate | docetaxel | |
| Alt. lib.7– | 263 | + | + | docetaxel pertuzumab trastuzumab | | | |
| Alt. lib.7– | 217 | – | +/– | nab-paclitaxel pertuzumab trastuzumab | letrozole fulvestrant | | |

TABLE 30

Patient Information: Training toward Benefiters (B)

| Enrichment case ID | TTNT | HER2 ISH | HER2 IHC | First line regimen | Next line regimen | Additional treatments | Clinical |
|---|---|---|---|---|---|---|---|
| Alt. lib.8+ | 364 | + | + | trastuzumab vinorelbine tartrate | ado-trastuzumab emtansine | | |
| Alt. lib.8– | 33 | + | + | trastuzumab vinorelbine tartrate | docetaxel | | |
| Alt. lib.8– | 85 | – | – | trastuzumab vinorelbine tartrate | docetaxel | docetaxel investigational agent cyclophosphamide fluorouracil | |
| Alt. lib.9+ | 369 | – | Equivocal | trastuzumab | docetaxel pertuzumab | ado-trastuzumab emtansine | |
| Alt. lib.9– | 56 | n.p. | + | trastuzumab | leuprolide acetate | vinorelbine tartrate eribulin mesylate bevacizumab nab-paclitaxel ado-trastuzumab emtansine trastuzumab | |
| Alt. lib.9– | 20 | – | – | trastuzumab | nab-paclitaxel | vinorelbine tartrate gemcitabine hydrochloride | |
| TL-B+ | 371 | + | + | carboplatin docetaxel trastuzumab | | | Diagnosis: Left breast, lumpectomy: Infiltrating ductal carcinoma, poorly differentiated/grade 3. Stage: IIIA Grade: 3/Poorly differentiated |
| TL-B– | 42 | + | + | carboplatin nab-paclitaxel trastuzumab | pegylated liposomal doxorubicin hydrochloride | cyclophosphamide | Diagnosis: Right breast mass, excision: Multifocal invasive ductal carcinoma. Stage: IV Grade: 3/Poorly differentiated |
| TL-B– | 91 | + | + | carboplatin docetaxel trastuzumab | letrozole | | Diagnosis: Breast, left, Mammotome biopsy: Infiltrating ductal carcinoma, no special type. High combined histologic grade (3, 3, 2). Stage: I Grade: 3/Poorly differentiated |

TABLE 30-continued

| | | Patient Information: Training toward Benefiters (B) | | | | | |
|---|---|---|---|---|---|---|---|
| Enrichment case ID | TTNT | HER2 ISH | HER2 IHC | First line regimen | Next line regimen | Additional treatments | Clinical |
| Alt. lib.10+ | 406 | + | + | trastuzumab | | | |
| Alt. lib.10− | 56 | n.p. | + | trastuzumab | leuprolide acetate | vinorelbine tartrate eribulin mesylate bevacizumab nab-paclitaxel ado-trastuzumab emtansine trastuzumab | |
| Alt. lib.10− | 20 | − | − | trastuzumab | nab-paclitaxel | vinorelbine tartrate gemcitabine hydrochloride | |
| Alt. lib.11+ | 598 | + | + | trastuzumab vinorelbine tartrate | vinorelbine tartrate trastuzumab | trastuzumab gemcitabine hydrochloride docetaxel pertuzumab eribulin mesylate | |
| Alt. lib.11− | 33 | + | + | trastuzumab vinorelbine tartrate | docetaxel | | |
| Alt. lib.11− | 85 | − | − | trastuzumab vinorelbine tartrate | docetaxel | docetaxel investigational agent cyclophosphamide fluorouracil | |
| Alt. lib.12+ | 604 | − | − | carboplatin docetaxel trastuzumab | gemcitabine hydrochloride | | |
| Alt. lib.12− | 42 | + | + | carboplatin nab-paclitaxel trastuzumab | pegylated liposomal doxorubicin hydrochloride | cyclophosphamide | |
| Alt. lib.12− | 91 | + | + | carboplatin docetaxel trastuzumab | letrozole | | |
| Alt. lib.13+ | 623 | + | + | nab-paclitaxel trastuzumab | gemcitabine hydrochloride | ado-trastuzumab emtansine | |
| Alt. lib.13− | 67 | + | + | docetaxel trastuzumab | pertuzumab | fulvestrant | |
| Alt. lib.13− | 70 | +/− | − | paclitaxel trastuzumab | nab-paclitaxel | cyclophosphamide doxorubicin hydrochloride docetaxel pertuzumab ado-trastuzumab emtansine docetaxel trastuzumab pertuzumab | |
| Alt. lib.14+ | 391 | + | + | trastuzumab | | | |
| Alt. lib.14− | 56 | n.p. | + | trastuzumab | leuprolide acetate | vinorelbine tartrate eribulin mesylate bevacizumab nab-paclitaxel ado-trastuzumab emtansine trastuzumab | |
| Alt. lib.14− | 20 | − | − | trastuzumab | nab-paclitaxel | vinorelbine tartrate gemcitabine hydrochloride | |
| Alt. lib.15+ | 1202 | − | − | paclitaxel trastuzumab | nab-paclitaxel gemcitabine hydrochloride | | |
| Alt. lib.15− | 67 | + | + | docetaxel trastuzumab | pertuzumab | fulvestrant | |

TABLE 30-continued

Patient Information: Training toward Benefiters (B)

| Enrichment case ID | TTNT | HER2 ISH | HER2 IHC | First line regimen | Next line regimen | Additional treatments | Clinical |
|---|---|---|---|---|---|---|---|
| Alt. lib.15- | 70 | +/- | - | paclitaxel trastuzumab | nab-paclitaxel | cyclophosphamide doxorubicin hydrochloride docetaxel pertuzumab ado-trastuzumab emtansine docetaxel trastuzumab pertuzumab | |

TABLE 31

Patient Information: Test Herceptin TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| ALx-R-18 | R | Mid chest wall, biopsy: Poorly differentiated carcinoma, involving dermis and subcutaneous fibroadipose tissue. | 219 | Y | trastuzumab nab-paclitaxel | | IV | Grade 3/ Poorly differentiated | Chest, NOS | 58 | NA | + | |
| ALx-NR-10 | NR | Liver; biopsy: Malignant epithelial neoplasm, consistent withn metastatic invasive lobular carcinoma. | 78 | N | gemcitabine hydrochloride trastuzumab docetaxel | carboplatin | IV | Unknown | Liver | 52 | - | - | - |
| ALx-R-20 | R | Left breast mass, excision: Invasive ductal carcinoma, grade 3. | 391 | Y | trastuzumab | | Unknown | Grade 3/ Poorly differentiated | Breast | 60 | + | + | - |
| ALx-R-10 | R | Breast, left, 3 o'clock, 7 cm from nippled (ultrasound guided core biopsy): Invasive ductal carcinoma. | 287 | Y | gemcitabine hydrochloride carboplatin trastuzumab | | Unknown | Grade 3/ Poorly differentiated | Breast | 52 | - | +/- | + |
| ALx-R-19 | R | Mass, left axilla, needle biopsy: Invasive adenocarcinoma, morphologically consistent with recurrent breast carcinoma. | 321 | Y | trastuzumab vinorelbine tartrate | | IV | Grade 3/ Poorly differentiated | Connective & Soft Tissue | 46 | - | - | + |
| ALx-R-14 | R | Left breast, mastectomy: In situ intraductal and infiltrating duct carcinoma. Tumor emboli in dermal lymphatics of skin and nipple. | 765 | N | fulvestrant carboplatin docetaxel trastuzumab | | IV | Grade 3/ Poorly differentiated | Breast | 65 | - | +/- | + |
| ALx-NR-20 | NR | Lymph node, right axillary (needle core biopsy): Metastatic high-grade carcinoma, consistent with breast primary. | 70 | N | trastuzumab paclitaxel | nab-paclitaxel | IV | Grade 3/ Poorly differentiated | Lymph Nodes | 40 | - | +/- | + |
| ALx-NR-18 | NR | Liver mass, biopsy: Metastatic adenocarcinoma, compatible with breast primary. | 67 | N | trastuzumab docetaxel | pertuzumab | IV | Grade 2/ Moderately differentiated | Liver | 63 | + | + | + |
| ALx-R-5 | R | Left breast, 2:00, lumpectomy: Infiltrating ductal carcinoma, moderately differentiated, grade III. | 339 | Y | CPP docetaxel trastuzumab | | I | Grade 2/ Moderately differentiated | Breast | 52 | + | + | + |

TABLE 31-continued

Patient Information: Test Herceptin TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| ALx-NR-7 | NR | Right supraclavicular lymph node: Single lymph node (3 cm), replaced by metastatic carcinoma. | 56 | N | trastuzumab nab-paclitaxel pertuzumab | gemcitabine hydrochloride carboplatin | IIIC | Unknown | Lymph Nodes | 47 | +/− | − | + |
| ALx-R-4 | R | Liver, partial hepatectomy, section 5: Metastatic invasive mammary carcinoma. | 294 | N | trastuzumab | gemcitabine hydrochloride carboplatin | IV | Unknown | Liver | 54 | + | + | + |
| ALx-R-16 | R | Right breast, 8:00 N + 10, biopsy: Invasive ductal carcinoma, no special type (1.1 cm). | 272 | N | trastuzumab docetaxel carboplatin | fulvestrant | IV | Grade 2/ Moderately differentiated | Breast | 49 | − | − | + |
| ALx-R-8 | R | Breast, right, core biopsy: Infiltrating ductal carcinoma. | 238 | Y | trastuzumab | | I | Grade 3/ Poorly differentiated | Breast | 55 | + | + | − |
| ALx-R-17 | R | Left breast mass, core biopsy: Poorly differentiated infiltrating ductal carcinoma. | 623 | N | trastuzumab nab-paclitaxel | gemcitabine hydrochloride | Unknown | Grade 3/ Poorly differentiated | Breast | 46 | + | + | − |
| ALx-R-9 | R | Left breast mastectomy: Invasive lobular carcinoma. | 604 | N | carboplatin docetaxel trastuzumab | gemcitabine hydrochloride | IIIC | Grade 2/ Moderately differentiated | Breast | 82 | − | − | + |
| ALx-R-15 | R | Left breast mass: Infiltrating ductal carcinoma, Nottingham combined histologic grade III. | 406 | Y | trastuzumab | | IV | Grade 3/ Poorly differentiated | Breast, NOS | 35 | + | + | + |
| ALx-NR-9 | NR | Metastatic carcinoma involving one out of seventeen (1/17) axillary lymph nodes. | 82 | N | trastuzumab pertuzumab trastuzumab docetaxel | CPP doxorubicin hydrochloride | I | Grade 2/ Moderately differentiated | Axillary lymph node | 46 | + | + | − |
| ALx-R-11 | R | Right breast, "masses" at 10 and 2 o'clock positions, resection: Invasive lobular carcinoma. | 1202 | N | trastuzumab paclitaxel | gemcitabine hydrochloride nab-paclitaxel | IV | Grade 3/ Poorly differentiated | Breast, NOS | 79 | − | − | + |
| ALx-R-7 | R | | 369 | N | trastuzumab | pertuzumab docetaxel | II | Grade 3/ Poorly differentiated | Breast, NOS | 52 | +/− | − | − |
| ALx-NR-14 | NR | Peritoneal mass, needle core biopsy: Metastatic carcinoma, with morphologic and immunohistochemical features consistent with the patient's known breast center. | 69 | N | trastuzumab docetaxel pertuzumab | leuprolide acetate | IV | Unknown | Peritoneal cavity | 35 | − | − | + |
| ALx-R-13 | R | Skin, "lesion" on right anterior chest wall, excisional biopsy: Metastatic carcinoma of mammaty origin with prominent apocrine features. | 598 | N | trastuzumab vinorelbine tartrate | trastuzumab vinorelbine tartrate | IV | Grade 3/ Poorly differentiated | Skin of chest wall | 62 | + | + | − |
| ALx-R-1 | R | Left axillary sentinel nodes, left breast: Invasive ductal carcinoma. Nottingham grade 3. | 301 | Y | fluorouracil CPP methotrexate trastuzumab | | Unknown | Grade 3/ Poorly differentiated | Breast, NOS | 66 | +/− | +/− | − |
| ALx-NR-12 | NR | Right chest wall mass excision: Invasive ductal carcinoma, grade 2. | 109 | N | trastuzumab paclitaxel pertuzumab | CPP doxorubicin hydrochloride | I | Grade 2/ Moderately differentiated | Chest wall, NOS | 53 | + | + | − |

TABLE 31-continued

Patient Information: Test Herceptin TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| ALx-R-6 | R | Breast, right, mastectomy: Infiltrating mammary carcinoma with mixed ductal and lobular phenotype. | 291 | Y | trastuzumab docetaxel CPP | | II | Grade 2/ Moderately differentiated | Breast, NOS | 56 | − | − | + |
| ALx-NR-11 | NR | Right adrenalectomy: Adenocarcinoma, consistent with metastatic mammary carcinoma. | 56 | N | vinorelbine tartrate trastuzumab | carboplatin | IV | Unknown | Adrenal gland, NOS | 54 | +/− | + | + |
| ALx-NR-4 | NR | Lymph node, right axillary, excision: Metastatic adenocarcinoma consistent with breast primary. | 113 | N | nab-paclitaxel carboplatin pertuzumab trastuzumab | capecitabine | IIIA | Grade 1/ Well differentiated | Axillary lymph node | 51 | +/− | − | − |
| ALx-R-41 | R | Left breast, simple mastectomy: Invasive ductal carcinoma, Nottingham grade III. | 190 | Y | pertuzumab docetaxel carboplatin trastuzumab | | II | Grade 3/ Poorly differentiated | Breast, NOS | 34 | +/− | − | + |
| ALx-R-42 | R | Right breast, core biopsy: Infiltrating ductal carcinoma. | 196 | Y | trastuzumab pertuzumab docetaxel | | I | Grade 3/ Poorly differentiated | Breast | 52 | − | − | + |
| ALx-R-43 | R | Right breast, simple mastectomy: Recurrent invasive grade 3 ductal carcinoma. | 375 | Y | trastuzumab docetaxel carboplatin trastuzumab | | II | Grade 3/ Poorly differentiated | Breast | 41 | + | + | − |
| ALx-R-44 | R | | 334 | Y | trastuzumab | | IV | Unknown | Liver | 64 | − | + | + |
| ALx-R-45 | R | Left breast scar revision: Invasive poorly-differentiated ductal carcinoma. | 406 | Y | trastuzumab fulvestrant | | I | Grade 3/ Poorly differentiated | Breast | 54 | − | + | + |
| ALx-R-47 | R | Left breast inframammary crease: Metastatic carcinoma involving dermal lymphovascular spaces. | 546 | Y | trastuzumab | | I | Unknown | Skin | 55 | + | + | − |
| ALx-R-48 | R | Left breast and axillary contents, modified radical mastectomy: Invasive ductal carcinoma. | 856 | Y | trastuzumab | | IV | Grade 3/ Poorly differentiated | Axillary lymph node | 40 | − | +/− | − |
| ALx-R-49 | NR | Liver, biopsy: Metastatic carcinoma. | 106 | N | trastuzumab | bevacizumab carboplatin | IV | Grade 3/ Poorly differentiated | Liver | 46 | + | + | + |
| ALx-R-50 | R | Skin, left breast, biopsy: Dermal intralymphatic tumor, consistent with inflammatory carcinoma. | 186 | N | trastuzumab | vinorelbine tartrate | I | Unknown | Connective & Soft Tissue | 41 | + | + | − |
| ALx-R-51 | R | Right axillary/pectoral tumor, excision: Infiltrating ductal carcinoma involving subcutaneous fibroadipose tissue and adjoining skeletal muscle. | 196 | N | trastuzumab | vinorelbine tartrate trastuzumab | I | Grade 3/ Poorly differentiated | Connective & Soft Tissue | 55 | + | + | + |
| ALx-R-52 | NR | Liver, segment VI, partial resection: Consistent with metastatic mammary carcinoma. | 80 | N | trastuzumab pertuzumab fulvestrant | octreotide acetate | IV | Unknown | Liver | 46 | + | + | − |
| ALx-R-53 | R | Right liver lobe, partial lobectomy: Metastatic carcinoma, consistent with breast primary. | 190 | N | trastuzumab | fulvestrant | IV | Unknown | Liver | 63 | − | − | + |

TABLE 31-continued

Patient Information: Test Herceptin TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| ALx-R-54 | R | Left breast mass: Infiltrating duct carcinoma with lobular features, grade 3. | 433 | N | leuprolide acetate docetaxel trastuzumab pertuzumab | paclitaxel | IV | Grade 3/ Poorly differentiated | Breast | 44 | | QNS | |
| ALx-R-55 | R | Pelvic mass, biopsy: Metastatic carcinoma. | 183 | N | trastuzumab vinorelbine tartrate | nab-paclitaxel | IV | Unknown | Pelvis, NOS | 42 | +/− | + | + |
| ALx-R-56 | R | Liver, needle biopsy (SS-13-01227): Mild steatosis and cholestasis. | 250 | N | trastuzumab pertuzumab docetaxel | ado-trastuzumab emtansine | IV | Unknown | Liver | 68 | + | + | − |
| ALx-R-57 | NR | Breast, left, simple mastectomy: Residual infiltrative mammary carcinoma with ductal and lobular features. | 49 | N | trastuzumab | ado-trastuzumab emtansine | II | Grade 2/ Moderately differentiated | Breast, NOS | 44 | + | + | − |
| ALx-R-58 | NR | SU-12-02676: Right breast (lumpectomy): Residual poorly differentiated adenocarcinoma, multifocal. | 154 | N | trastuzumab | docetaxel | Unknown | Grade 3/ Poorly differentiated | Breast, NOS | 41 | − | − | − |
| ALx-R-59 | NR | Right axillary mass: High grade infiltrating ductal carcinoma. | 128 | N | trastuzumab | docetaxel | Unknown | Grade 3/ Poorly differentiated | Breast, NOS | 62 | + | + | − |
| ALx-R-60 | NR | Bone, right distal femur tumor, excision: Metastatic adenocarcinoma, compatible with breast primary. | 129 | N | trastuzumab | pertuzumab docetaxel | IV | Unknown | Femur | 51 | + | + | + |

TABLE 32

Patient Information: Test Platinum/Taxane TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| Pl-1 | NR | Right breast and medial portion of inframammary bridge, simple mastectomy: Infiltrating ductal carcinoma, grade 2 (Nottingham classification). | 22 | N | docetaxel | CPP | Unknown | NA | Breast | 73 | − | − | − |
| Pl-2 | R | Left masectomy breast tissue: Invasive mammary carcinoma, | 822 | Y | nab-paclitaxel fluorouracil | | IIIA | Grade 2/ Moderately differentiated | Breast | 49 | − | − | + |
| Pl-3 | R | Right breast (simple mastectomy): Infiltrating ductal carcinoma. | 461 | N | nab-paclitaxel bevacizumab carboplatin | gemcitabine hydrochloride | II | Grade 3/ Poorly differentiated | Breast | 43 | − | − | + |
| Pl-4 | NR | Lymph node from left neck (biopsy): Metastatic poorly differentiated carcinoma involving one out of one lymph node (1/1). | 21 | N | nab-paclitaxel | eribulin mesylate | Unknown | NA | Lymph Nodes | 40 | − | +/− | + |
| Pl-5 | NR | Right axillary lymph node (biopsy): Metastatic carcinoma. | 40 | N | docetaxel | doxorubicin hydrochloride CPP | I | Unknown | Lymph Nodes | 43 | − | − | − |

TABLE 32-continued

Patient Information: Test Platinum/Taxane TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| Pl-6 | NR | Liver "mass" (percutaneous needle core biopsies): Metastatic adenocarcinoma, consistent with breast primary. | 29 | N | carboplatin nab-paclitaxel bevacizumab | gemcitabine hydrochloride | IV | Grade 2/ Moderately differentiated | Liver | 47 | – | others | – |
| Pl-7 | NR | Touch preps and core biopsy, left iliac crest: Positive for malignancy | 84 | N | nab-paclitaxel | patupilone | IV | Unknown | Bones & Joints | 60 | – | – | + |
| Pl-8 | NR | Breast, left, 12-3:00: Invasive lobular carcinoma, pleomorphic type. | 62 | N | docetaxel CPP | doxorubicin hydrochloride | II | Grade 3/ Poorly differentiated | Breast | 62 | – | – | + |
| Pl-9 | NR | Mass, retroperitoneum; biopsy: Metastatic carcinoma, consistent with breast primary. | 59 | N | nab-paclitaxel | patupilone | IV | Unknown | Retroperitoneum & Peritoneum | 55 | – | – | + |
| Pl-10 | NR | Left breast (182 grams), simple mastectomy: Infiltrating ductal carcinoma. | 98 | N | paclitaxel | CPP doxorubicin hydrochloride fluorouracil | II | Grade 3/ Poorly differentiated | Breast | 39 | – | – | – |
| Pl-11 | NR | Left breast, simple mastectomy: Infiltrating lobular carcinoma. | 70 | N | docetaxel patupilone | fluorouracil | IV | Grade 2/ Moderately differentiated | Breast | 44 | – | – | + |
| Pl-12 | R | Lymph nodes, right axillary, excision: Metastatic adenocarcinoma consistent with breast primary involving one of three lymph nodes (1/3). | 402 | N | paclitaxel bevacizumab nab-paclitaxel | gemcitabine hydrochloride | IV | Grade 2/ Moderately differentiated | Lymph Nodes | 56 | – | – | – |
| Pl-13 | R | Ascites fluid, cytology: Metastatic adenocarcinoma, consistent with lobular breast carcinoma. | 631 | N | gemcitabine hydrochloride docetaxel | gemcitabine | IV | Unknown | Peritoneal Fluid | 70 | – | – | + |
| Pl-14 | NR | Left breast, needle biopsies: Invasive ductal carcinoma, grade 3 (of 3). | 56 | N | nab-paclitaxel | doxorubicin hydrochloride CPP | IIIA | Grade 3/ Poorly differentiated | Breast | 62 | – | – | – |
| Pl-15 | R | Core needle biopsy, left lateral breast/axillary lymph node mass: Metastatic poorly differentiated adenocarcinoma, morphologically and immunohistochemically compatible with primary ductal breast origin. | 449 | N | CPP epimbicin hydrochloride paclitaxel | eribulin mesylate | IV | Grade 3/ Poorly differentiated | Lymph Nodes | 73 | – | – | – |
| Pl-16 | R | Right breast mass, excision: Invasive ductal carcinoma. | 343 | N | doxorubicin hydrochloride CPP docetaxel | gemcitabine hydrochloride | II | Grade 3/ Poorly differentiated | Breast | 44 | – | – | – |
| Pl-17 | NR | Supraclavicular node left: Lymph node totally replaced by metastatic carcinoma, consistent with primary breast carcinoma. The tumor extends completely through the node capsule to the surrounding fatty tissues. | 99 | N | docetaxel carboplatin | gemcitabine hydrochloride | IV | Unknown | Lymph Nodes | 57 | – | – | – |

TABLE 32-continued

Patient Information: Test Platinum/Taxane TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| Pl-18 | R | Chest wall mass, right posterior, biopsy: Metastatic carcinoma, favor mammary primary. | 341 | N | carboplatin docetaxel | eribulin mesylate | IV | Grade 2 / Moderately differentiated | Connective & Soft Tissue | 80 | +/− | − | + |
| Pl-19 | NR | Reamings, hip, right, biopsy: Metastatic poorly differentiated carcinoma consistent with breast origin. | 105 | N | paclitaxel carboplatin bevacizumab | gemcitabine hydrochloride | IV | Grade 3/ Poorly differentiated | Bones & Joints | 64 | − | − | − |
| Pl-20 | R | Right breast, 10 o'clock, lumpectomy: Infiltrating ductal adenocarcinoma. | 674 | Y | CPP docetaxel | | IIIA | Grade 3/ Poorly differentiated | Breast | 69 | − | − | + |
| Pl-21 | NR | Liver, needle biopsies: Metastatic carcinoma morphologically consistent with breast primary. | 21 | N | docetaxel | doxorubicin hydrochloride | IV | Grade 2/ Moderately differentiated | Liver | 45 | +/− | − | + |
| Pl-22 | NR | Left breast lumpectomy, 2 o'clock: Infiltrating ductal adenocarcinoma, Elston grade III, 4 cm maximum dimension, present 1 mm from the inferior margin. | 49 | N | docetaxel CPP | gemcitabine hydrochloride | IIIC | Grade 3/ Poorly differentiated | Breast | 71 | − | − | − |
| Pl-23 | R | Left breast mass, additional margins left breast, axillary contents, and additional axillary contents: Invasive lobular carcinoma. | 686 | Y | docetaxel therapeutic immune globulin CPP | | II | Grade 3/ Poorly differentiated | Breast | 72 | − | − | − |
| Pl-24 | NR | Breast, right, Mammotome biopsy: Infiltrating ductal carcinoma, no special type. | 22 | N | nab-paclitaxel carboplatin | pegylated liposomal doxorubicin hydrochloride | I | Grade 3/ Poorly differentiated | Breast, NOS | 43 | − | − | − |
| Pl-25 | NR | Duodenum, biopsy: Poorly-differentiated carcinoma, compatible with metastatic mammary carcinoma. | 63 | N | carboplatin gemcitabine hydrochloride | capecitabine | IV | Grade 3/ Poorly differentiated | Duodenum | 31 | +/− | − | − |
| Pl-26 | NR | Right breast mass core needle biopsies (image directed): Infiltrating duct carcinoma, high grade (grade 3). | 106 | N | paclitaxel | | IV | Grade 3/ Poorly differentiated | Breast, NOS | 56 | − | − | − |
| Pl-27 | NR | Right breast mass: Invasive ductal carcinoma. Nottingham grade 3. | 43 | N | carboplatin docetaxel | methotrexate | Unknown | NA | Breast, NOS | 59 | − | − | − |
| Pl-28 | NR | Left breast, modified radical mastectomy with level I/II node dissection: 3.5 cm poorly differentiated invasive ductal carcinoma with focal necrosis and foci of high grade ductal carcinoma in situ (comedo type). | 70 | N | carboplatin | Methotrexate fluorouracil | IIIA | Grade 3/ Poorly differentiated | Breast, NOS | 61 | − | − | − |
| Pl-29 | NR | Left breast mass, left breast core biopsy: Infiltrating ductal carcinoma. | 70 | N | nab-paclitaxel carboplatin | gemcitabine hydrochloride | Unknown | Grade 3/ Poorly differentiated | Breast, NOS | 53 | − | − | − |
| Pl-30 | NR | Left breast Mammotome biopsy: Infiltrating carcinoma. | 83 | N | nab-paclitaxel carboplatin | pegylated liposomal doxorubicin hydrochloride | II | Grade 3/ Poorly differentiated | Breast, NOS | 58 | − | − | − |

TABLE 32-continued

Patient Information: Test Platinum/Taxane TTNT

| ID | Type | Diagnosis | TTNT | Censored | First line | Next line | Stage | Grade | Specimen cite | Age | HER2 IHC | HER2 ISH | ER |
|---|---|---|---|---|---|---|---|---|---|---|---|---|---|
| Pl-31 | NR | Right breast segment, segmental mastectomy: Poorly-differentiated invasive ductal carcinoma. | 22 | N | carboplatin docetaxel | CPP | II | Grade 3/ Poorly differentiated | Breast, NOS | 62 | – | – | – |
| Pl-32 | NR | Right neck node, core biopsy: Metastatic poorly differentiated adenocarcinoma | 58 | N | nab-paclitaxel | eribulin mesylate | Unknown | NA | Connective, subcutaneous and other soft tissues of head, face and neck | 45 | NA | NA | |
| Pl-33 | NR | | 28 | N | carboplatin gemcitabine hydrochloride | pemetrexed disodium | IIIA | Grade 3/ Poorly differentiated | Breast, NOS | 57 | – | – | – |
| Pl-34 | R | Breast, left, core biopsy: Invasive carcinoma, grade 2 (of 3). | 630 | N | carboplatin | pegylated liposomal doxorubicin hydrochloride | IV | Grade 2/ Moderately differentiated | Breast, NOS | 78 | – | – | – |
| Pl-35 | NR | Left breast and axilla, modified radical mastectomy: Invasive ductal carcinoma, | 80 | N | carboplatin gemcitabine hydrochloride | doxorubicin hydrochloride | IIIC | Grade 3/ Poorly differentiated | Breast, NOS | 75 | – | – | – |
| Pl-36 | NR | Left breast biopsy: Infiltrating ductal carcinoma. High combined histologic grade (3, 3, 3). | 91 | N | nab-paclitaxel carboplatin | pegylated liposomal doxorubicin hydrochloride | Unknown | Grade 3/ Poorly differentiated | Breast, NOS | 50 | – | – | – |
| Pl-37 | NR | T9 bone, core biopsy: Metastatic carcinoma, compatible with breast primly. | 56 | N | bevacizumab paclitaxel | CPP doxorubicin hydrochloride | IV | Unknown | Bone, NOS | 45 | +/– | – | + |
| Pl-38 | NR | Breast, left 2:00 N10 (ultrasound-guided, vacuum-assisted biopsy): Invasive ductal carcinoma, grade 3. | 40 | N | carboplatin paclitaxel | doxorubicin hydrochloride CPP | I | Grade 3/ Poorly differentiated | Breast, NOS | 46 | – | – | – |
| Pl-39 | NR | Right breast, mastectomy: Infiltrating ductal carcinoma. | 63 | N | docetaxel carboplatin | Fluorouracil CPP | II | Grade 3/ Poorly differentiated | Breast, NOS | 83 | – | – | – |
| Pl-40 | NR | Left breast mass, core biopsy: Infiltrating ductal carcinoma, | 84 | N | paclitaxel | CPP doxorubicin hydrochloride | IV | Grade 3/ Poorly differentiated | Breast, NOS | 37 | – | – | – |
| Pl-41 | NR | Breast, left (biopsies): Infiltrating ductal carcinoma, grade 2. | 73 | N | gemcitabine hydrochloride carboplatin | doxorubicin hydrochloride CPP | IV | Grade 2/ Moderately differentiated | Breast, NOS | 56 | +/– | – | – |

In this Example, we subjected a library of $10^{13}$ unique single-stranded DNA oligodeoxynucleotides (ssODNs; which may also be referred to as aptamers or oligonucleotide probes herein) (17, 18) to several rounds of positive and negative selection in situ for subsets of sequences that preferentially bind to formalin-fixed and paraffin-embedded (FFPE) tumor tissue slices from breast cancer patients who did or did not derive benefit from regimens containing trastuzumab. We refer to this process as library training. Each patient's time to next therapy (TTNT), i.e. the time that elapsed until trastuzumab-based treatment changed defined whether a patient belonged to the group that derived benefit from trastuzumab containing treatment (B) or to the group that did not (NB) (19). The definition of treatment benefit (B) and no benefit (NB) by TTNT is consistent with recently published FDA guidance (20). For the purpose of library training, cases with TTNT greater than 180 days were considered as B and cases with TINT fewer than 180 days were considered NB. In total, 8 NB cases (see Table 29) and 9 B-cases (see Table 30) were used for the training of 17 different libraries. Among them were two best-performing trained libraries, TL-B and TL-NB (see "Enrichment case ID" in Tables 29-30), which we employed to generate a predictive assay based on polyligand profiling that differentiates B from NB patients.

Figure 17A:
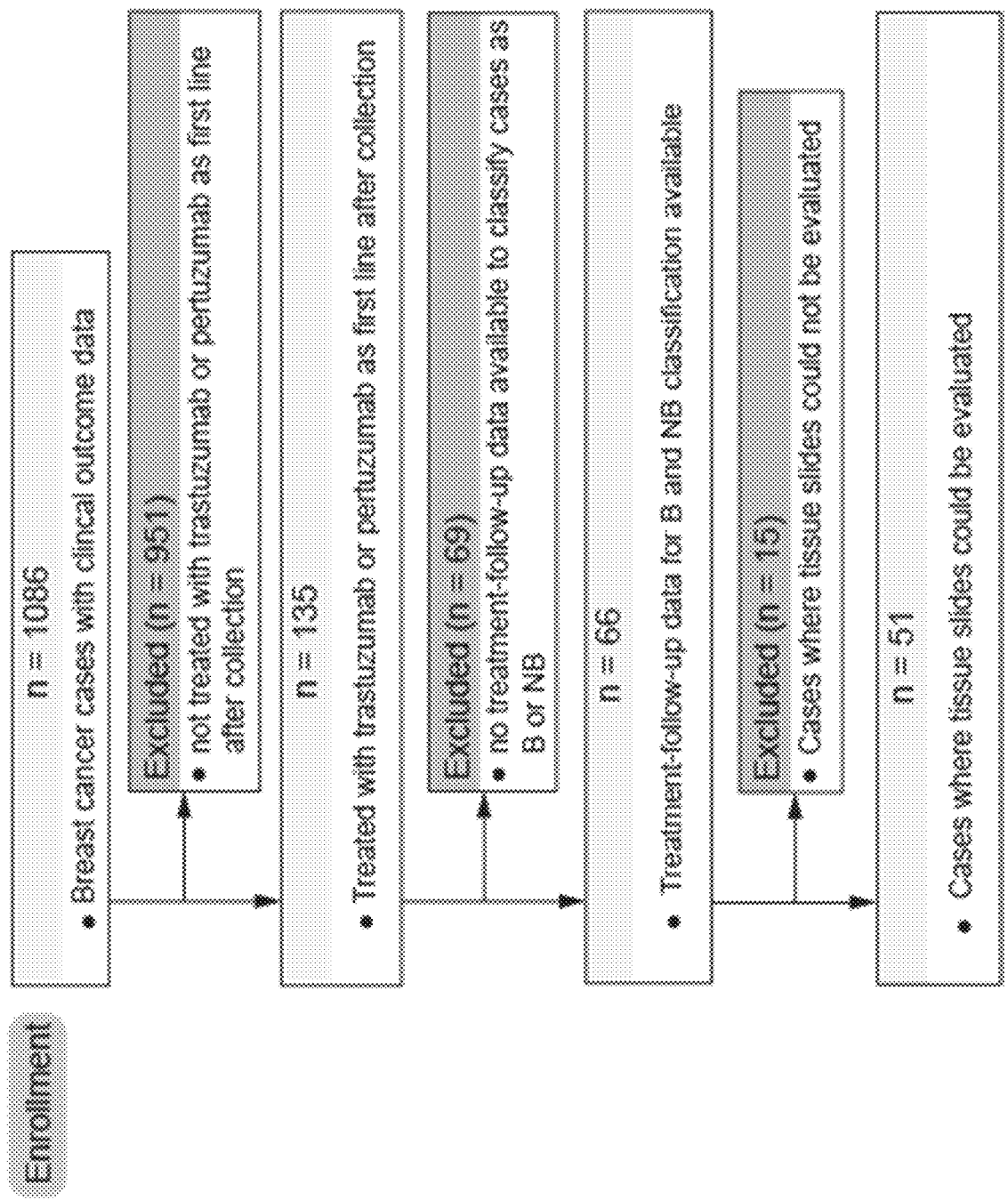
FIGS. 17A-P show oligonucleotide probes that distinguish trastuzumab responder breast cancer tissue samples.
Figure 17B:
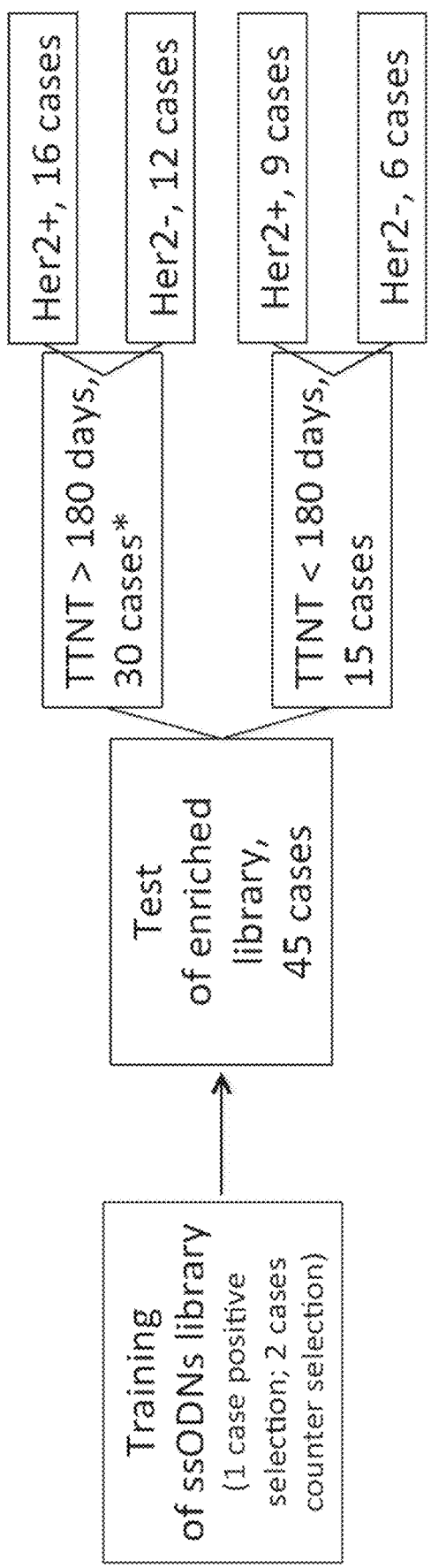

FIGS. 17A-B show the rationale for the selection of patients (FIG. 17A) and the workflow of the training and testing procedure of the ssODN library, including the number of cases used in each step (FIG. 17B). Clinical information for each of the patients included in this process, such as tumor anatomical site, treatment, hormonal status, etc. is provided in Tables 29-32. The starting library was subjected to positive selection using one NB case (rounds 1-6) and negative selection using two B cases (rounds 4-6) to generate TL-NB, and vice versa for generating TL-B. In Tables 29-30, the cases are grouped in triads. For example, positive selection was performed using NB case, TL-NB+, and negative selection in the same enrichment was performed using the two B cases just below identified as TL-NB- and TL-NB-. For addition details of the selection schemes and protocols, see FIG. 17C and Example 22. Testing readout is based on polyligand-histochemistry ("PHC") staining of FFPE slides from cases independent of those used for training. All tissue samples used for training and testing were collected prior to treatment to ensure that library training is independent of molecular changes in the tumor tissue that occur as a result of treatment.

Figure 17C:
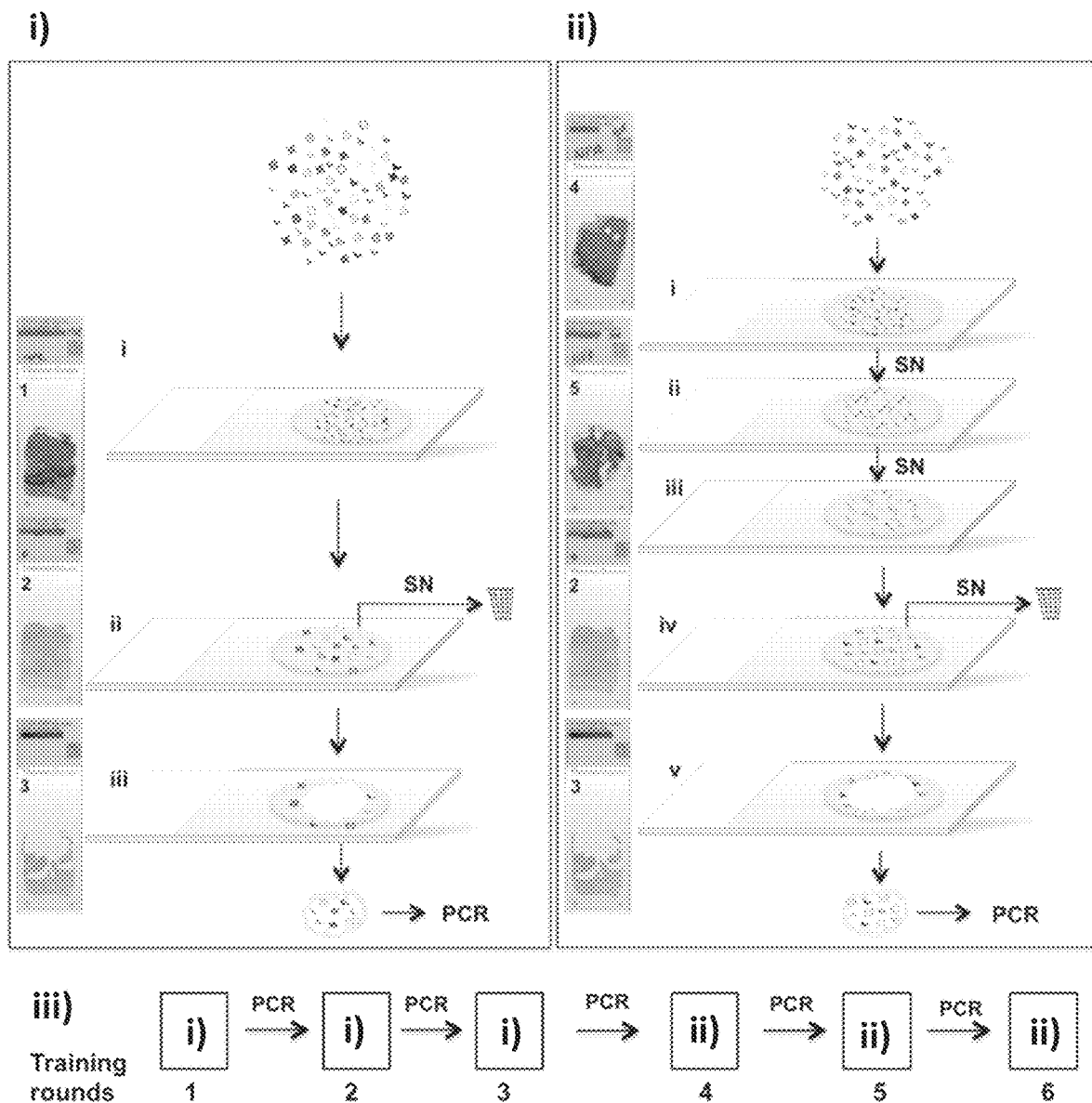
Figure 17D:
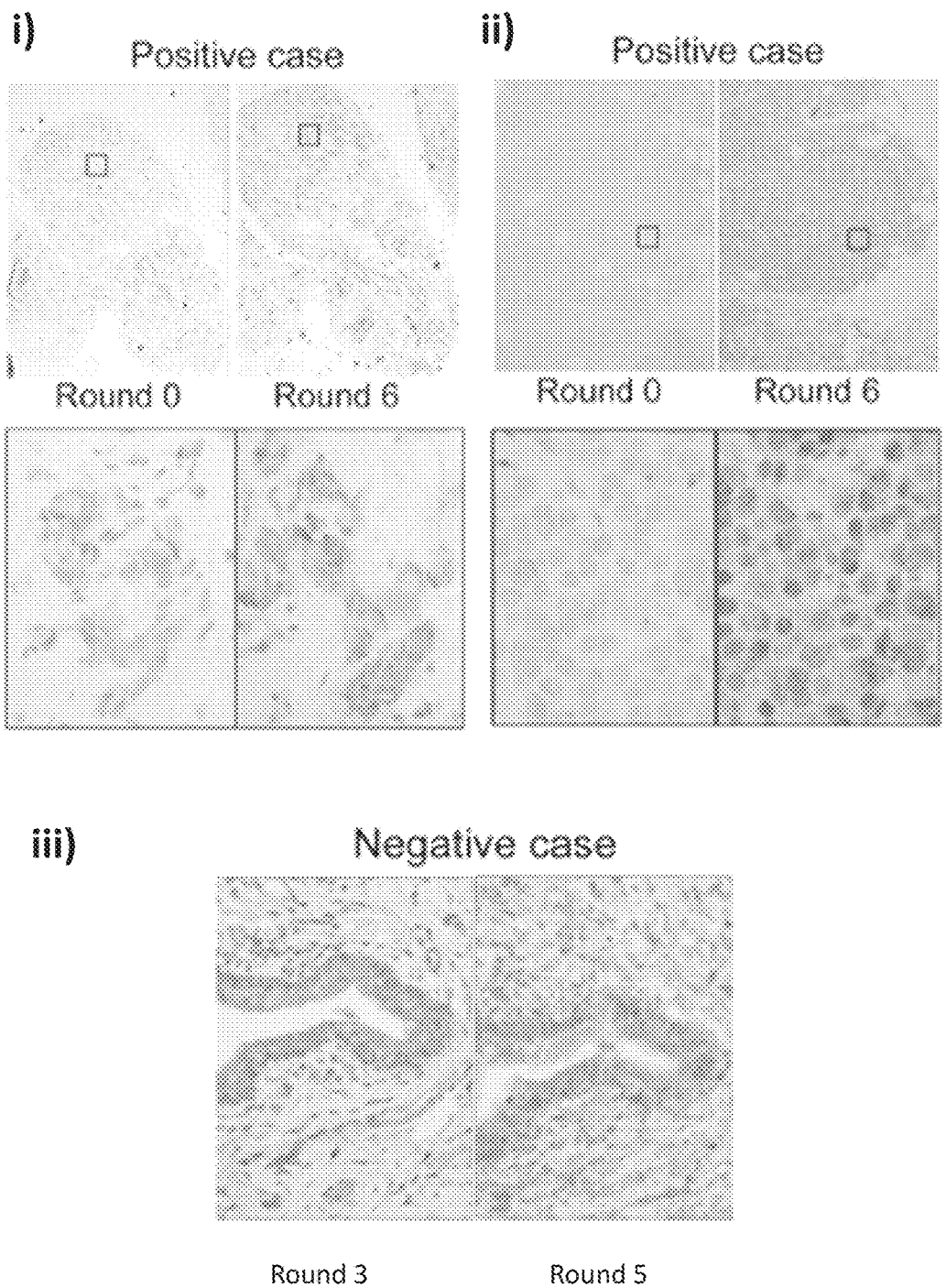

FIG. 17C provides an overview of the procedure for ssODN library training. FIG. 17Ci outlines positive training steps towards a library that identifies non-benefitting (NB) cases: (i) incubation of the ssODN library with the NB tissue; (ii) removal of unbound sequences, (iii) dissection of tumor tissue and recovery of the subset of sequences, specific to the NB cancer tissue. SN: supernatant. Recovered ssODNs were amplified by PCR, converted to ssODNs and used for the next training round. The slide images on the left show tissue appearance: Slide 1) Hematoxylin and eosin (H&E) staining of NB tissue (tumor area outlined in green); Slide 2) Nuclear Fast Red (NFR) stained tissue after partitioning before dissection; Slide 3) Remaining normal tissue after dissection of cancer tissue with bound ssODNs. FIG. 17Cii outlines training steps with additional counter-selection steps on benefit (B) cases: (i) incubation of the ssODN library with the 1st B tissue; (ii) incubation of the supernatant from (i) with the 2nd B case; (iii) incubation of the supernatant from (ii) with the NB case from A; (iv) and (v) correspond to the steps (ii) and (iii) in A. The slide images on the left show tissue appearance: Slide 4) Hematoxylin and eosin (H&E) staining of 1st B tissue (tumor area outlined in green); Slide 5) Hematoxylin and eosin (H&E) staining of 2nd B tissue (tumor area outlined in green); Slides 2 and 3 are the same as in FIG. 17Ci. FIG. 17Ciii outlines the entire ssODN library training, which is comprised of three training rounds as shown in FIG. 17Ci (indicated "i)"); followed by three training rounds as shown in FIG. 17Cii (indicated "ii)"). FIG. 17Di shows staining of the tissue from the NB-case that was used during the selection process with untrained library (round 0), compared to the trained TL-NB library (round 6; upper panel: 4×, lower panel: 20×). FIG. 17Dii shows staining of tissue from an NB case not used during the selection process with untrained library (round 0), compared to the trained library TL-NB (round 6; upper panel: 4×, lower panel: 20×). FIG. 17Diii shows staining of the tissue from the responder case employed for counter selection in the training of TL-NB, using the output ssODNs from round 3 (left), compared to the output ssODNs from round 5 (right).

In more detail, the training library for non-benefiting patients TL-NB was obtained by incubating the starting library directly with FFPE-fixed breast tumor tissue from a trastuzumab NB-patient. After one hour of incubation (step i), non-binding ssODNs were removed by washing (step ii), followed by a dissection of the tumor tissue away from normal adjacent tissue (step iii) and asymmetric PCR-amplification of ssODNs bound to the dissected tumor tissue. See FIG. 17Ci and Example 22. These positive selection steps were performed a total of three times on serial tissue sections of the same case (rounds 1-3; FIG. 17Ci, iii). The ssODN-library from the third round of enrichment was then subjected to two consecutive counter-selection steps by incubating with FFPE tissue from two trastuzumab B-patients. The supernatant from the second counter-selection step, i.e. the library that is depleted of ssODNs that are associated with binding to B-tumor tissue, was transferred to a new tissue section from the original NB-patient's tumor for one final positive selection step as described above and the subset of bound ssODNs was PCR-amplified (FIG. 17Cii). The negative-negative-positive steps were performed a total of three times (SELEX rounds 4-6; FIG. 17Ciii). A comparison of the staining intensities of the unselected library with that of the round 6 TL-NB library on the NB case used for the selection showed a significant increase of staining for the enriched library (FIG. 17Di, round 6), whereas no or weak staining was seen for the unselected library (FIG. 17Di, round 0). Similar staining was observed on a separate NB case not used for the library training (FIG. 17Dii). Not unexpectedly, staining intensity was also high when the PCR-amplified library from round 3 (the enriched library before counter selection) was applied to a B case (FIG. 17Diii, left panel). However, after round 5 a notable decrease in staining intensity was observed for TL-NB applied to the same B case, indicating that the counter-selection steps were effective (FIG. 17Diii, right panel). Thus, TL-NB shows high staining intensities on NB tissue, while it stains the B-case used for counter selection with considerably weaker intensity. TL-NB was therefore suitable for PHC staining on an independent test-set.

To test whether we could also train a random library for a set of ssODNs that preferentially stain B-cases, we carried out a separate enrichment process in the opposite direction, using B-cases for positive, and NB-cases for counter-selection. The resulting trained library, TL-B, showed preferential staining of B-cases compared to the NB-cases or the untrained starting library. FIG. 17E shows staining of library TL-B on B and NB tissues. FIG. 17Ei shows staining of tissue from a B case not used during the selection process with untrained library (round 0), compared to the trained library TL-B (round 6; upper panel: 4×, lower panel: 20×) FIG. 17Eii shows staining of the tissue of a patient who did not derive benefit from trastuzumab-based regimens (NB) by polyligand-histochemistry (PHC), using the library enriched on a benefiting case (B) at round 4, compared to TL-B after round 6.

Taken together, the PHC staining characteristics observed with TL-NB and TL-B indicate sufficient selection pressure and successful enrichment toward their targeted phenotypes. The variable regions of the 100000 most prevalent sequences in the NB selected enrichment (library TL-NB) are included herein as SEQ ID NOs. 3062-103061, ordered by prevalence. The variable regions of the 100000 most prevalent sequences in the B selected enrichment (library TL-B) are included herein as SEQ ID NOs. 103062-203061, also ordered by prevalence.

Figure 17F:
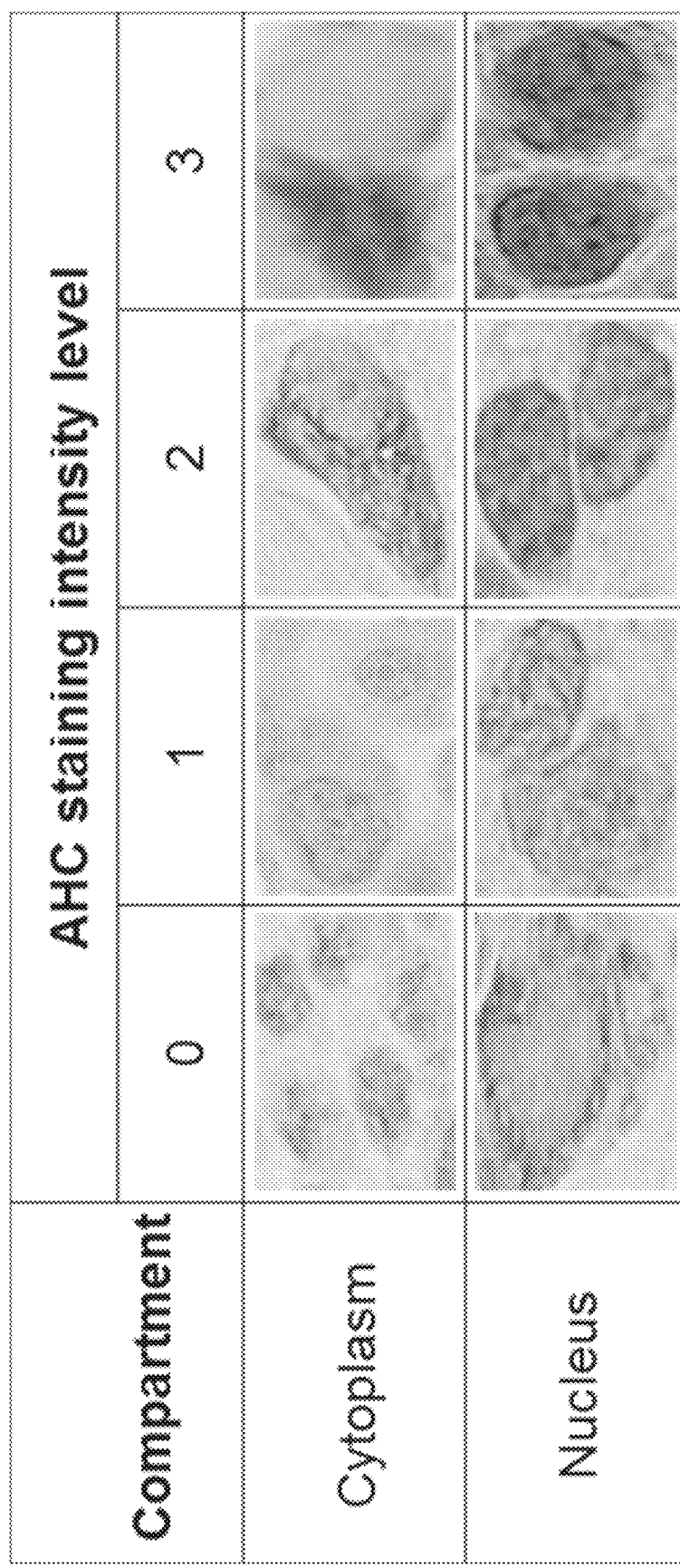
Figure 17G:
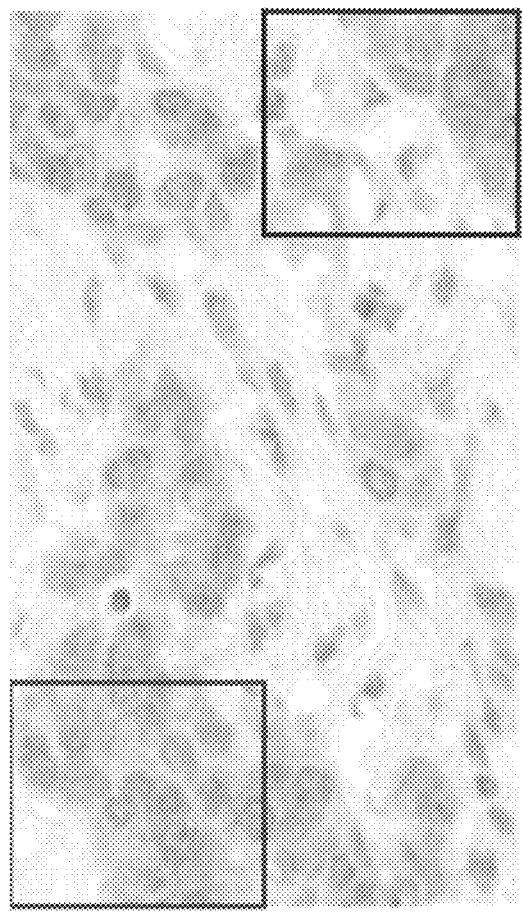
Figure 17H:
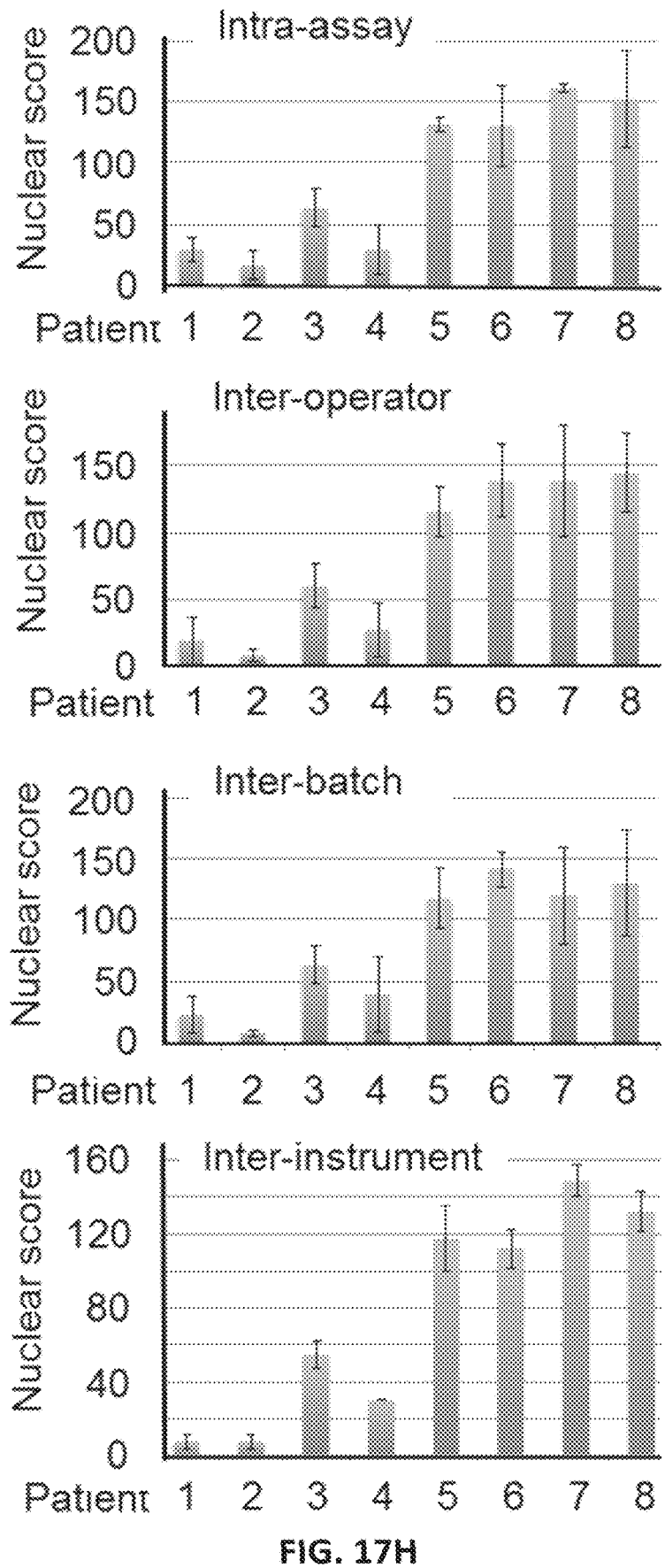
Figure 17I:
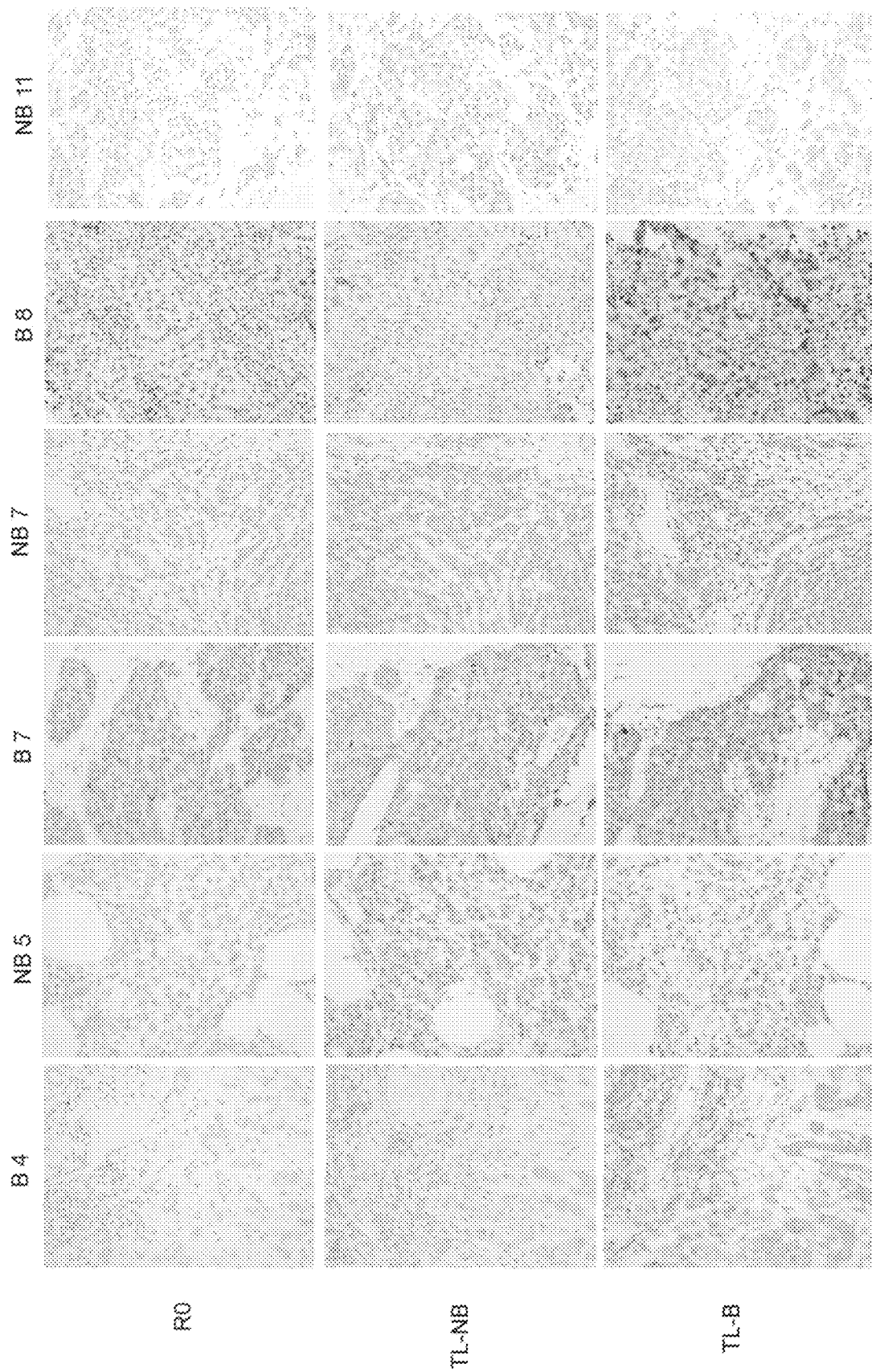
Figure 17J:
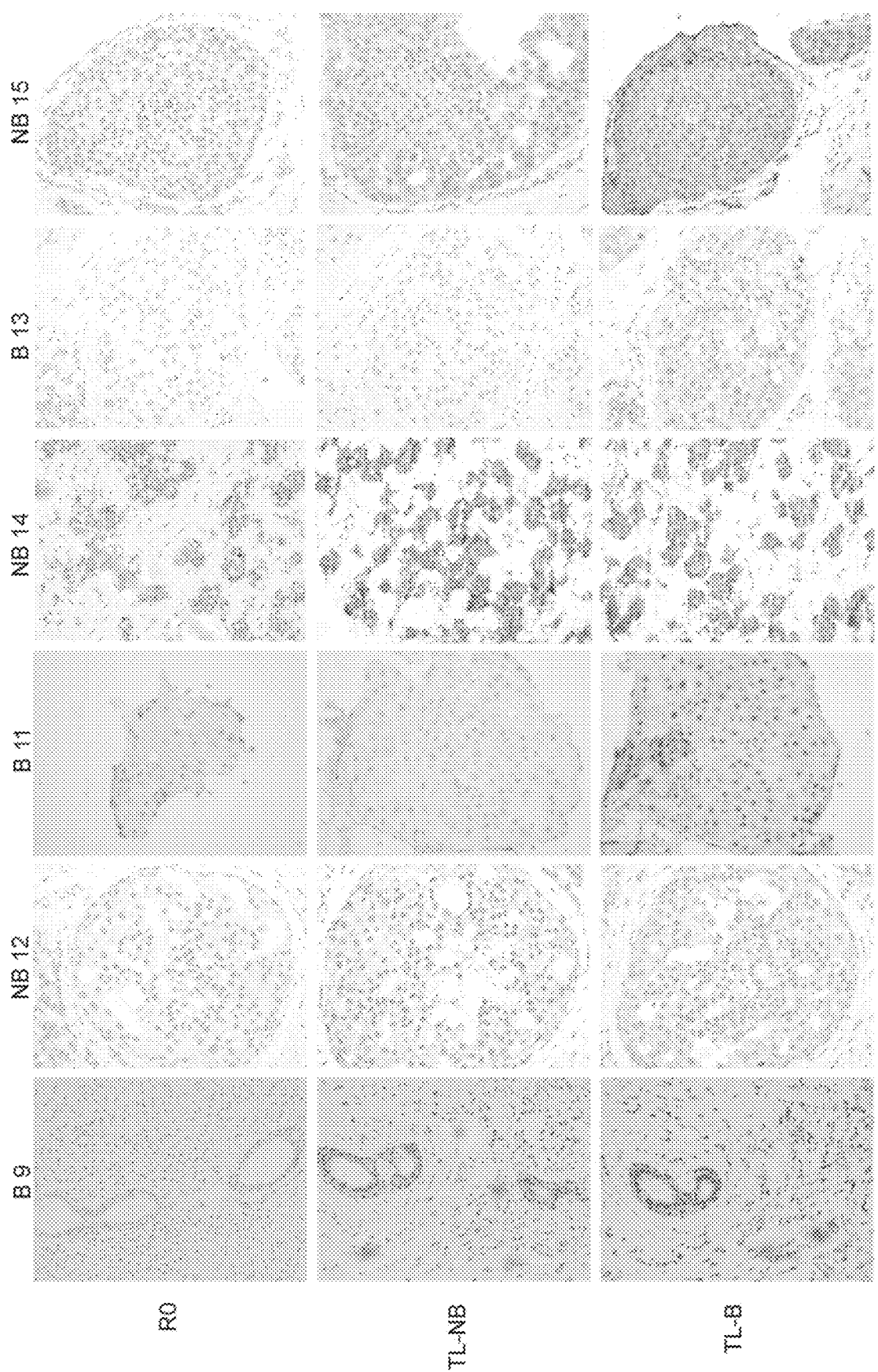
Figure 17K:
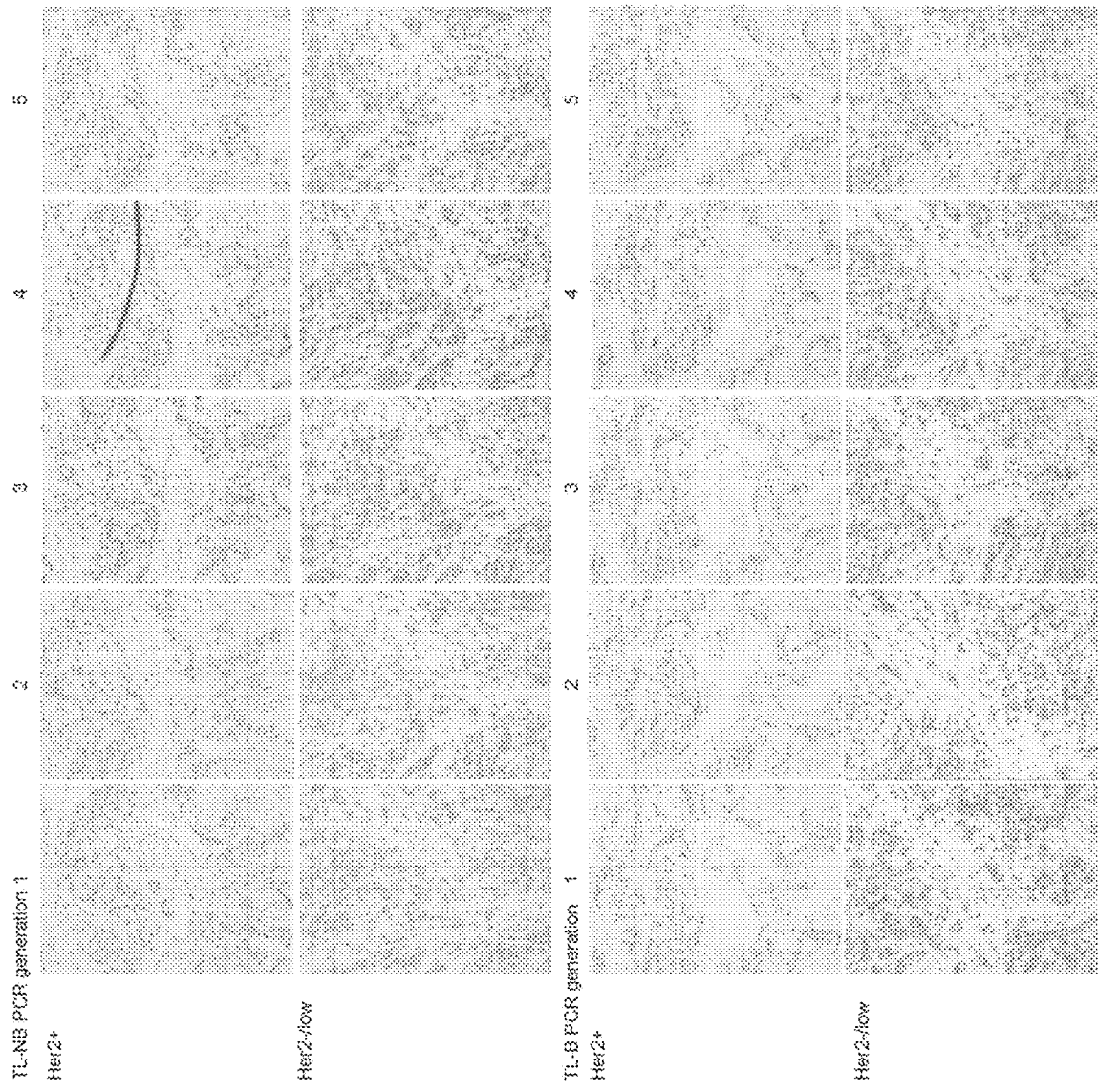
Figure 17L:
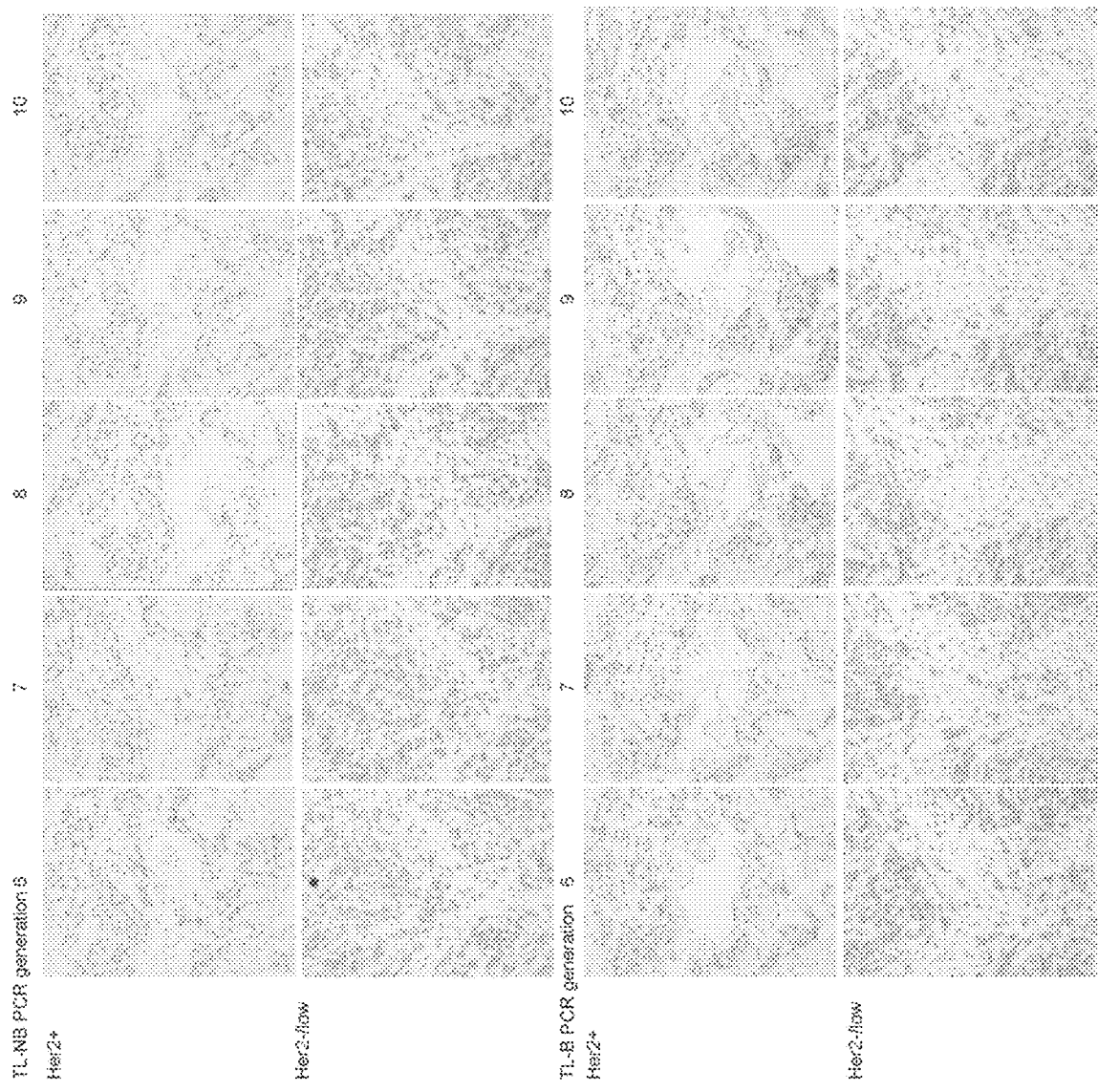

To evaluate the performance of TL-NB and TL-B on cases independent from those used for training, we verified that histological H-scoring of the tissue staining intensity obtained with the trained libraries can be employed for the quantitative comparison of the cases, similar to standard pathological practice for IHC (21). The scoring for both cytoplasmic and nuclear staining was performed by a board-certified pathologist who was blinded to the patient outcomes. Protocols are found in FIGS. 17F-H and Example 22 and scoring results are shown in Tables 33-36. Examples of PHC staining intensity levels in the cytoplasm and the nuclei of breast cancer FFPE tissue ranging from 0 to 3 are shown in FIG. 17F. See also FIGS. 17I-J, which show polyligand histochemistry (PHC) staining profiles comparison of the non-enriched starting library (R0) and enriched libraries TL-NB and TL-B on patients not benefiting (NB) and benefiting (B) from trastuzumab containing treatment. The view areas are matched in each row between libraries within each panel. The library R0 usually exhibits little to no staining, while the enriched libraries can be scored from 1+ to 3+. Library TL-NB, which was enriched toward a trastuzumab non-benefiting case exhibits stronger intensity on NB cases, except for NB-15. Library TL-B, which was enriched toward a Trastuzumab responder case, exhibits stronger intensity on the B cases. The magnification in FIGS. 17I-J is 20×. The histological scores were calculated by standard methods by determining the percentages of cells on the entire tissue, classified to fall within each PHC intensity level in the cytoplasm and the nucleus. See FIG. 17G and Example 22. To evaluate staining and scoring reproducibility, we selected cases that showed weak and strong staining with TL-NB and then scored nuclear staining (22) between technical replicates (FIG. 17H, first panel "Intra-assay"), different operators (FIG. 17H, second panel "Inter-operator"), different batches of library (FIG. 17H, third panel: Inter-batch"), and different instruments (FIG. 17H, fourth panel "Inter-instrument"). The classification of four strongly and weakly staining cases was consistent and independent of these variables, indicating that the staining and scoring is reproducible. To further assess the technical reproducibility of PCR amplified versions of TL-NB and TL-B, both libraries were amplified for up to ten PCR-generations. See FIGS. 17K-L, which show technical reproducibility of the staining with libraries TL-NB and TL-B resulting from different PCR-generations 1-5 (FIG. 17K), and 6-10 (FIG. 17L). Examples from two different cases (Her2+ and Her2−/low) at 20× magnifications are shown. For each PCR generation, an aliquot (0.4 ng) of each preceding library generation was amplified for 10 PCR cycles. Each PCR generation of TL-NB and TL-B was then used for the staining of consecutive tissue sections from the same NB patient for TL-NB and the same B patient for TL-B. Each PCR generation of TL-NB and TL-B was used for the staining of consecutive tissue sections from the same NB patient for TL-NB and the same B patient for TL-B. No significant difference in the staining was observed from generation to generation, indicating highly robust performance of both libraries after excessive PCR amplification.

TABLE 33

Histological Scoring, TL-NB Trastuzamab TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| ALx-R-42 | Neg | 80 | 0 | 20 | 0 | 0 | 100 | 0 | 0 | 40 | 100 | 140 |
| ALx-R-53 | Neg | 20 | 80 | 0 | 0 | 0 | 100 | 0 | 0 | 80 | 100 | 180 |
| ALx-R-41 | Neg | 5 | 10 | 85 | 0 | 0 | 100 | 0 | 0 | 180 | 100 | 280 |
| ALx-R-55 | Neg | 30 | 60 | 10 | 0 | 0 | 100 | 0 | 0 | 80 | 100 | 180 |
| ALx-R-58 | Pos | 30 | 40 | 30 | 0 | 0 | 70 | 30 | 0 | 100 | 130 | 230 |
| ALx-R-60 | Pos | 15 | 30 | 55 | 0 | 100 | 0 | 0 | 0 | 140 | 0 | 140 |
| ALx-R-59 | Pos | 20 | 50 | 30 | 0 | 30 | 50 | 20 | 0 | 110 | 90 | 200 |
| ALx-R-50 | Neg | 100 | 0 | 0 | 0 | 30 | 70 | 0 | 0 | 0 | 70 | 70 |
| ALx-R-51 | Pos | 5 | 90 | 5 | 0 | 0 | 100 | 0 | 0 | 100 | 100 | 200 |
| ALx-R-43 | Pos | 1 | 20 | 79 | 0 | 0 | 100 | 0 | 0 | 178 | 100 | 278 |
| ALx-NR-4 | Neg | 10 | 90 | 0 | 0 | 0 | 100 | 0 | 0 | 90 | 100 | 190 |
| ALx-NR-7 | Neg | 60 | 40 | 0 | 0 | 80 | 20 | 0 | 0 | 40 | 20 | 60 |
| ALx-NR-9 | Pos | 20 | 80 | 0 | 0 | 0 | 100 | 0 | 0 | 80 | 100 | 180 |
| ALx-NR-10 | Neg | 30 | 40 | 30 | 0 | 0 | 60 | 40 | 0 | 100 | 140 | 240 |
| ALx-NR-11 | Pos | 50 | 40 | 10 | 0 | 30 | 70 | 0 | 0 | 60 | 70 | 130 |
| ALx-NR-12 | Pos | 20 | 50 | 30 | 0 | 0 | 100 | 0 | 0 | 110 | 100 | 210 |
| ALx-NR-14 | Neg | 10 | 0 | 80 | 10 | 0 | 100 | 0 | 0 | 190 | 100 | 290 |
| ALx-NR-18 | Pos | 60 | 20 | 20 | 0 | 0 | 90 | 10 | 0 | 60 | 110 | 170 |
| ALx-NR-20 | Neg | 90 | 10 | 0 | 0 | 0 | 80 | 20 | 0 | 10 | 120 | 130 |
| ALx-R-1 | Neg | 40 | 60 | 0 | 0 | 5 | 20 | 75 | 0 | 60 | 170 | 230 |
| ALx-R-4 | Pos | 100 | 0 | 0 | 0 | 0 | 40 | 60 | 0 | 0 | 160 | 160 |
| ALx-R-5 | Pos | 60 | 40 | 0 | 0 | 5 | 85 | 10 | 0 | 40 | 105 | 145 |
| ALx-R-6 | Neg | 10 | 60 | 30 | 0 | 10 | 90 | 0 | 0 | 120 | 90 | 210 |
| ALx-R-7 | Neg | 40 | 60 | 0 | 0 | 100 | 0 | 0 | 0 | 60 | 0 | 60 |
| ALx-R-8 | Pos | 95 | 5 | 0 | 0 | 99 | 1 | 0 | 0 | 5 | 1 | 6 |
| ALx-R-9 | Neg | 50 | 50 | 0 | 0 | 50 | 50 | 0 | 0 | 50 | 50 | 100 |
| ALx-R-10 | Neg | 60 | 40 | 0 | 0 | 0 | 80 | 20 | 0 | 40 | 120 | 160 |
| ALx-R-11 | Neg | 90 | 10 | 0 | 0 | 30 | 70 | 0 | 0 | 10 | 70 | 80 |
| ALx-R-13 | Pos | 90 | 10 | 0 | 0 | 90 | 10 | 0 | 0 | 10 | 10 | 20 |
| ALx-R-14 | Neg | 90 | 10 | 0 | 0 | 10 | 90 | 0 | 0 | 10 | 90 | 100 |
| ALx-R-15 | Pos | 100 | 0 | 0 | 0 | 10 | 85 | 5 | 0 | 0 | 95 | 95 |
| ALx-R-16 | Pos | 100 | 0 | 0 | 0 | 0 | 100 | 0 | 0 | 0 | 100 | 100 |
| ALx-R-17 | Neg | 100 | 0 | 0 | 0 | 10 | 50 | 40 | 0 | 0 | 130 | 130 |
| ALx-R-18 | Pos | 15 | 85 | 0 | 0 | 0 | 80 | 20 | 0 | 85 | 120 | 205 |
| ALx-R-19 | Neg | 95 | 5 | 0 | 0 | 10 | 90 | 0 | 0 | 5 | 90 | 95 |
| ALx-R-20 | Pos | 50 | 40 | 10 | 0 | 20 | 70 | 10 | 0 | 60 | 90 | 150 |
| ALx-R-45 | Neg | 20 | 60 | 20 | 0 | | | | | 100 | 0 | 100 |
| ALx-R-44 | Neg | 80 | 20 | 0 | 0 | | | | | 20 | 0 | 20 |
| ALx-R-48 | Neg | 0 | 60 | 40 | 0 | | | | | 140 | 0 | 140 |
| ALx-R-47 | Neg | 0 | 100 | 0 | 0 | | | | | 100 | 0 | 100 |
| ALx-R-54 | Pos | 100 | 0 | 0 | 0 | | | | | 0 | 0 | 0 |
| ALx-R-56 | Pos | 20 | 70 | 10 | 0 | | | | | 90 | 0 | 90 |
| ALx-R-52 | Neg | 20 | 80 | 0 | 0 | | | | | 80 | 0 | 80 |

TABLE 33-continued

Histological Scoring, TL-NB Trastuzamab TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| ALx-R-57 | Pos | 0 | 50 | 50 | 0 | | | | | 150 | 0 | 150 |
| ALx-R-49 | Pos | 90 | 10 | 0 | 0 | | | | | 10 | 0 | 10 |

TABLE 34

Histological Scoring, TL-NB, Platinum/Taxane TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| Pl-1 | Neg | 5 | 45 | 50 | 0 | 0 | 100 | 0 | 0 | 145 | 100 | 245 |
| Pl-2 | Pos | 70 | 30 | 0 | 0 | 10 | 70 | 20 | 0 | 30 | 110 | 140 |
| Pl-3 | Neg | 10 | 55 | 35 | 0 | 0 | 100 | 0 | 0 | 125 | 100 | 225 |
| Pl-4 | Neg | 30 | 70 | 0 | 0 | 0 | 100 | 0 | 0 | 70 | 100 | 170 |
| Pl-5 | Neg | 45 | 50 | 5 | 0 | 0 | 100 | 0 | 0 | 60 | 100 | 160 |
| Pl-6 | Pos | 20 | 40 | 40 | 0 | 0 | 100 | 0 | 0 | 120 | 100 | 220 |
| Pl-7 | Neg | 60 | 30 | 10 | 0 | 10 | 90 | 0 | 0 | 50 | 90 | 140 |
| Pl-8 | Pos | 35 | 45 | 20 | 0 | 0 | 70 | 30 | 0 | 85 | 130 | 215 |
| Pl-9 | Pos | | | | | | | | | 0 | 0 | 0 |
| Pl-10 | Neg | 0 | 10 | 90 | 0 | 100 | 0 | 0 | 0 | 190 | 0 | 190 |
| Pl-11 | Pos | 5 | 90 | 5 | 0 | 0 | 100 | 0 | 0 | 100 | 100 | 200 |
| Pl-12 | Neg | 20 | 40 | 40 | 0 | 10 | 90 | 0 | 0 | 120 | 90 | 210 |
| Pl-13 | Pos | 50 | 40 | 10 | 0 | 0 | 100 | 0 | 0 | 60 | 100 | 160 |
| Pl-14 | Pos | 80 | 20 | 0 | 0 | 50 | 50 | 0 | 0 | 20 | 50 | 70 |
| Pl-15 | Neg | | | | | | | | | 0 | 0 | 0 |
| Pl-16 | Neg | 20 | 80 | 0 | 0 | 0 | 60 | 40 | 0 | 80 | 140 | 220 |
| Pl-17 | Neg | 20 | 80 | 0 | 0 | 100 | 0 | 0 | 0 | 80 | 0 | 80 |
| Pl-18 | Neg | | | | | | | | | 0 | 0 | 0 |
| Pl-19 | Neg | | | | | | | | | 0 | 0 | 0 |
| Pl-20 | Neg | 10 | 90 | 0 | 0 | 0 | 100 | 0 | 0 | 90 | 100 | 190 |
| Pl-21 | Pos | 5 | 10 | 85 | 0 | 100 | 0 | 0 | 0 | 180 | 0 | 180 |
| Pl-22 | Pos | 60 | 30 | 10 | 0 | 70 | 30 | 0 | 0 | 50 | 30 | 80 |
| Pl-23 | Neg | 10 | 30 | 60 | 0 | 10 | 90 | 0 | 0 | 150 | 90 | 240 |
| Pl-24 | Pos | 5 | 70 | 25 | 0 | 0 | 100 | 0 | 0 | 120 | 100 | 220 |
| Pl-25 | Pos | | | | | | | | | 0 | 0 | 0 |
| Pl-26 | Pos | 10 | 80 | 10 | 0 | 0 | 80 | 20 | 0 | 100 | 120 | 220 |
| Pl-27 | Neg | 10 | 70 | 20 | 0 | 20 | 80 | 0 | 0 | 110 | 80 | 190 |
| Pl-28 | Pos | 35 | 40 | 25 | 0 | 0 | 60 | 40 | 0 | 90 | 140 | 230 |
| Pl-29 | Pos | 3 | 67 | 30 | 0 | 0 | 100 | 0 | 0 | 127 | 100 | 227 |
| Pl-30 | Pos | 10 | 80 | 10 | 0 | 10 | 90 | 0 | 0 | 100 | 90 | 190 |
| Pl-31 | Pos | 20 | 60 | 20 | 0 | 0 | 100 | 0 | 0 | 100 | 100 | 200 |
| Pl-32 | Neg | 20 | 80 | 0 | 0 | 0 | 80 | 20 | 0 | 80 | 120 | 200 |
| Pl-33 | Neg | 40 | 60 | 0 | 0 | 100 | 0 | 0 | 0 | 60 | 0 | 60 |
| Pl-34 | Pos | 70 | 30 | 0 | 0 | 20 | 60 | 20 | 0 | 30 | 100 | 130 |
| Pl-35 | Pos | 50 | 50 | 0 | 0 | 10 | 90 | 0 | 0 | 50 | 90 | 140 |
| Pl-36 | Pos | 80 | 10 | 10 | 0 | 0 | 100 | 0 | 0 | 30 | 100 | 130 |
| Pl-37 | Neg | 20 | 10 | 70 | 0 | 30 | 70 | 0 | 0 | 150 | 70 | 220 |
| Pl-38 | Neg | 30 | 60 | 10 | 0 | 10 | 90 | 0 | 0 | 80 | 90 | 170 |
| Pl-39 | Pos | 10 | 90 | 0 | 0 | 0 | 100 | 0 | 0 | 90 | 100 | 190 |
| Pl-40 | Neg | 60 | 35 | 5 | 0 | 20 | 80 | 0 | 0 | 45 | 80 | 125 |
| Pl-41 | Neg | 5 | 45 | 50 | 0 | 0 | 80 | 20 | 0 | 145 | 120 | 265 |

TABLE 35

Histological Scoring, TL-B, Trastuzamab TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| ALx-R-42 | Neg | 35 | 45 | 20 | 0 | 0 | 100 | 0 | 0 | 85 | 100 | 185 |
| ALx-R-53 | Neg | 30 | 70 | 0 | 0 | 0 | 100 | 0 | 0 | 70 | 100 | 170 |
| ALx-R-41 | Neg | 10 | 80 | 10 | 0 | 10 | 90 | 0 | 0 | 100 | 90 | 190 |
| ALx-R-55 | Neg | 90 | 10 | 0 | 0 | 0 | 100 | 0 | 0 | 10 | 100 | 110 |
| ALx-R-58 | Pos | 20 | 80 | 0 | 0 | 0 | 100 | 0 | 0 | 80 | 100 | 180 |
| ALx-R-60 | Pos | 10 | 40 | 50 | 0 | 10 | 90 | 0 | 0 | 140 | 90 | 230 |
| ALx-R-59 | Pos | 15 | 85 | 0 | 0 | 0 | 100 | 0 | 0 | 85 | 100 | 185 |
| ALx-R-50 | Neg | 50 | 50 | 0 | 0 | 0 | 100 | 0 | 0 | 50 | 100 | 150 |

TABLE 35-continued

Histological Scoring, TL-B, Trastuzamab TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| ALx-R-51 | Pos | 5 | 95 | 0 | 0 | 0 | 100 | 0 | 0 | 95 | 100 | 195 |
| ALx-R-43 | Pos | 5 | 45 | 50 | 0 | 5 | 95 | 0 | 0 | 145 | 95 | 240 |
| ALx-NR-4 | Neg | 25 | 65 | 10 | 0 | 0 | 90 | 10 | 0 | 85 | 110 | 195 |
| ALx-NR-7 | Neg | 70 | 30 | 0 | 0 | 100 | 0 | 0 | 0 | 30 | 0 | 30 |
| ALx-NR-9 | Pos | 40 | 60 | 0 | 0 | 0 | 100 | 0 | 0 | 60 | 100 | 160 |
| ALx-NR-10 | Neg | 80 | 10 | 10 | 0 | 10 | 80 | 10 | 0 | 30 | 100 | 130 |
| ALx-NR-11 | Pos | 90 | 10 | 0 | 0 | 10 | 90 | 0 | 0 | 10 | 90 | 100 |
| ALx-NR-12 | Pos | 10 | 20 | 70 | 0 | 0 | 100 | 0 | 0 | 160 | 100 | 260 |
| ALx-NR-14 | Neg | 50 | 20 | 30 | 0 | 10 | 20 | 70 | 0 | 80 | 160 | 240 |
| ALx-NR-18 | Pos | 88 | 10 | 2 | 0 | 2 | 88 | 10 | 0 | 14 | 108 | 122 |
| ALx-NR-20 | Neg | 80 | 20 | 0 | 0 | 20 | 50 | 30 | 0 | 20 | 110 | 130 |
| ALx-R-1 | Neg | 10 | 10 | 80 | 0 | 0 | 90 | 10 | 0 | 170 | 110 | 280 |
| ALx-R-4 | Pos | 20 | 80 | 0 | 0 | 0 | 60 | 40 | 0 | 80 | 140 | 220 |
| ALx-R-5 | Pos | 20 | 40 | 40 | 0 | 0 | 60 | 40 | 0 | 120 | 140 | 260 |
| ALx-R-6 | Neg | 5 | 35 | 60 | 0 | 0 | 100 | 0 | 0 | 155 | 100 | 255 |
| ALx-R-7 | Neg | 10 | 45 | 45 | 0 | 0 | 80 | 20 | 0 | 135 | 120 | 255 |
| ALx-R-8 | Pos | 10 | 25 | 25 | 40 | 0 | 40 | 60 | 0 | 195 | 160 | 355 |
| ALx-R-9 | Neg | 5 | 35 | 60 | 0 | 0 | 100 | 0 | 0 | 155 | 100 | 255 |
| ALx-R-10 | Neg | 5 | 95 | 0 | 0 | 0 | 100 | 0 | 0 | 95 | 100 | 195 |
| ALx-R-11 | Neg | 2 | 30 | 68 | 0 | 0 | 100 | 0 | 0 | 166 | 100 | 266 |
| ALx-R-13 | Pos | 93 | 5 | 2 | 0 | 25 | 75 | 0 | 0 | 9 | 75 | 84 |
| ALx-R-14 | Neg | 10 | 80 | 10 | 0 | 0 | 50 | 50 | 0 | 100 | 150 | 250 |
| ALx-R-15 | Pos | 20 | 20 | 60 | 0 | 0 | 80 | 20 | 0 | 140 | 120 | 260 |
| ALx-R-16 | Pos | 10 | 60 | 30 | 0 | 0 | 20 | 80 | 0 | 120 | 180 | 300 |
| ALx-R-17 | Neg | 70 | 30 | 0 | 0 | 0 | 50 | 50 | 0 | 30 | 150 | 180 |
| ALx-R-18 | Pos | 5 | 15 | 80 | 0 | 0 | 0 | 100 | 0 | 175 | 200 | 375 |
| ALx-R-19 | Neg | 100 | 0 | 0 | 0 | 10 | 20 | 70 | 0 | 0 | 160 | 160 |
| ALx-R-20 | Pos | 20 | 50 | 30 | 0 | 0 | 100 | 0 | 0 | 110 | 100 | 210 |
| ALx-R-45 | Pos | 50 | 40 | 10 | 0 | 10 | 70 | 20 | 0 | 60 | 110 | 170 |
| ALx-R-44 | Neg | 0 | 50 | 50 | 0 | 80 | 20 | 0 | 0 | 150 | 20 | 170 |
| ALx-R-48 | Neg | 20 | 70 | 10 | 0 | 0 | 100 | 0 | 0 | 90 | 100 | 190 |
| ALx-R-47 | Pos | 0 | 100 | 0 | 0 | 0 | 100 | 0 | 0 | 100 | 100 | 200 |
| ALx-R-54 | Neg | 100 | 0 | 0 | 0 | 0 | 100 | 0 | 0 | 0 | 100 | 100 |
| ALx-R-56 | Neg | 60 | 40 | 0 | 0 | 0 | 70 | 30 | 0 | 40 | 130 | 170 |
| ALx-R-52 | Pos | 20 | 80 | 0 | 0 | 10 | 60 | 30 | 0 | 80 | 120 | 200 |
| ALx-R-57 | Pos | 0 | 100 | 0 | 0 | 0 | 100 | 0 | 0 | 100 | 100 | 200 |
| ALx-R-49 | Neg | 95 | 5 | 0 | 0 | 30 | 70 | 0 | 0 | 5 | 70 | 75 |

TABLE 36

Histological Scoring, TL-B, Platinum/Taxane TTNT

| Case ID in the test set | Her2 status | Nuclear 0 | 1 | 2 | 3 | Cytoplasmic 0 | 1 | 2 | 3 | Nuclear score | Cytoplasmic score | Total score |
|---|---|---|---|---|---|---|---|---|---|---|---|---|
| Pl-1 | Neg | 5 | 95 | 0 | 0 | 0 | 80 | 20 | 0 | 95 | 120 | 215 |
| Pl-2 | Pos | 80 | 20 | 0 | 0 | 20 | 80 | 0 | 0 | 20 | 80 | 100 |
| Pl-3 | Neg | 5 | 95 | 0 | 0 | 0 | 100 | 0 | 0 | 95 | 100 | 195 |
| Pl-4 | Neg | 10 | 90 | 0 | 0 | 0 | 100 | 0 | 0 | 90 | 100 | 190 |
| Pl-5 | Neg | 60 | 39 | 1 | 0 | 0 | 100 | 0 | 0 | 41 | 100 | 141 |
| Pl-6 | Pos | | | | | | | | | 0 | 0 | 0 |
| Pl-7 | Neg | 70 | 30 | 0 | 0 | 70 | 30 | 0 | 0 | 30 | 30 | 60 |
| Pl-8 | Pos | 80 | 20 | 0 | 0 | 60 | 40 | 0 | 0 | 20 | 40 | 60 |
| Pl-9 | Pos | | | | | | | | | 0 | 0 | 0 |
| Pl-10 | Neg | 0 | 50 | 50 | 0 | 0 | 100 | 0 | 0 | 150 | 100 | 250 |
| Pl-11 | Pos | 5 | 95 | 0 | 0 | 0 | 100 | 0 | 0 | 95 | 100 | 195 |
| Pl-12 | Neg | 30 | 70 | 0 | 0 | 30 | 70 | 0 | 0 | 70 | 70 | 140 |
| Pl-13 | Pos | 30 | 40 | 30 | 0 | 0 | 100 | 0 | 0 | 100 | 100 | 200 |
| Pl-14 | Pos | 90 | 10 | 0 | 0 | 40 | 60 | 0 | 0 | 10 | 60 | 70 |
| Pl-15 | Neg | | | | | | | | | 0 | 0 | 0 |
| Pl-16 | Neg | 5 | 95 | 0 | 0 | 0 | 100 | 0 | 0 | 95 | 100 | 195 |
| Pl-17 | Neg | 50 | 50 | 0 | 0 | 0 | 100 | 0 | 0 | 50 | 100 | 150 |
| Pl-18 | Neg | | | | | | | | | 0 | 0 | 0 |
| Pl-19 | Neg | | | | | | | | | 0 | 0 | 0 |
| Pl-20 | Neg | 10 | 90 | 0 | 0 | 70 | 30 | 0 | 0 | 90 | 30 | 120 |
| Pl-21 | Pos | 5 | 45 | 50 | 0 | 0 | 100 | 0 | 0 | 145 | 100 | 245 |
| Pl-22 | Pos | 50 | 50 | 0 | 0 | 40 | 60 | 0 | 0 | 50 | 60 | 110 |
| Pl-23 | Neg | 20 | 80 | 0 | 0 | 0 | 80 | 0 | 0 | 80 | 80 | 160 |
| Pl-24 | Pos | 20 | 70 | 10 | 0 | 20 | 40 | 40 | 0 | 90 | 120 | 210 |
| Pl-25 | Pos | | | | | | | | | 0 | 0 | 0 |

TABLE 36-continued

Histological Scoring, TL-B, Platinum/Taxane TTNT

| Case ID in the test set | Her2 status | Nuclear | | | | Cytoplasmic | | | | Nuclear score | Cytoplasmic score | Total score |
|---|---|---|---|---|---|---|---|---|---|---|---|---|
| | | 0 | 1 | 2 | 3 | 0 | 1 | 2 | 3 | | | |
| Pl-26 | Pos | 60 | 40 | 0 | 0 | 0 | 60 | 40 | 0 | 40 | 140 | 180 |
| Pl-27 | Neg | 0 | 50 | 50 | 0 | 0 | 100 | 0 | 0 | 150 | 100 | 250 |
| Pl-28 | Pos | 5 | 95 | 0 | 0 | 0 | 40 | 60 | 0 | 95 | 160 | 255 |
| Pl-29 | Pos | 0 | 5 | 95 | 0 | 0 | 100 | 0 | 0 | 195 | 100 | 295 |
| Pl-30 | Pos | 5 | 95 | 0 | 0 | 5 | 95 | 0 | 0 | 95 | 95 | 190 |
| Pl-31 | Pos | 5 | 85 | 10 | 0 | 0 | 100 | 0 | 0 | 105 | 100 | 205 |
| Pl-32 | Neg | 50 | 50 | 0 | 0 | 0 | 70 | 30 | 0 | 50 | 130 | 180 |
| Pl-33 | Neg | 40 | 60 | 0 | 0 | 0 | 100 | 0 | 0 | 60 | 100 | 160 |
| Pl-34 | Pos | 100 | 0 | 0 | 0 | 100 | 0 | 0 | 0 | 0 | 0 | 0 |
| Pl-35 | Pos | 10 | 85 | 5 | 0 | 0 | 100 | 0 | 0 | 95 | 100 | 195 |
| Pl-36 | Pos | 30 | 60 | 10 | 0 | 20 | 75 | 5 | 0 | 80 | 85 | 165 |
| Pl-37 | Neg | 20 | 20 | 60 | 0 | 100 | 0 | 0 | 0 | 140 | 0 | 140 |
| Pl-38 | Neg | 50 | 40 | 10 | 0 | 0 | 100 | 0 | 0 | 60 | 100 | 160 |
| Pl-39 | Pos | 30 | 70 | 0 | 0 | 20 | 70 | 10 | 0 | 70 | 90 | 160 |
| Pl-40 | Neg | 60 | 40 | 0 | 0 | 0 | 100 | 0 | 0 | 40 | 100 | 140 |
| Pl-41 | Neg | 20 | 80 | 0 | 0 | 0 | 50 | 50 | 0 | 80 | 150 | 230 |

Figure 17M:
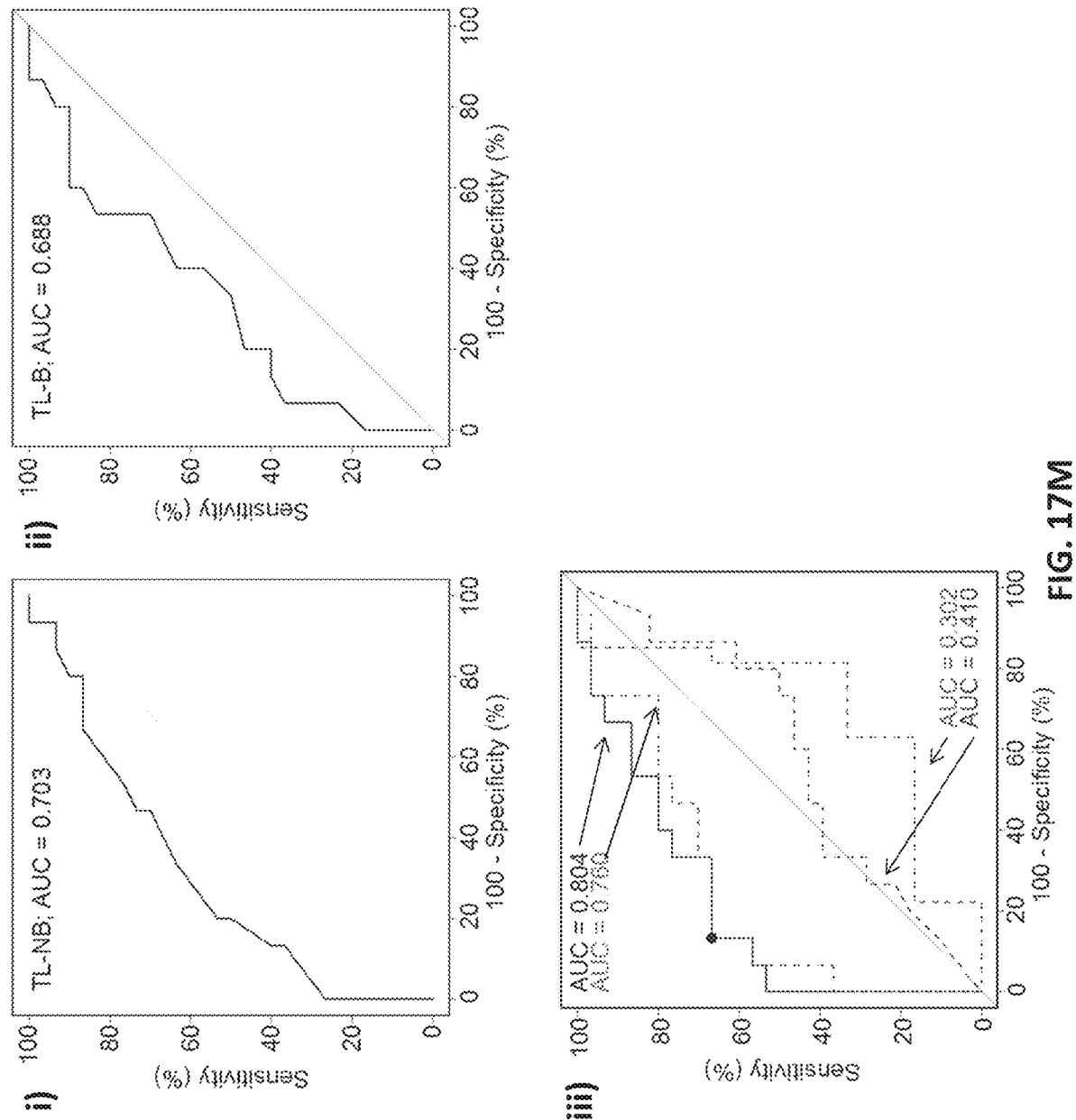

With two libraries in hand that reciprocally show preferential staining for either B or NB cases, we tested use for PHC scores for the differentiation and prediction of responders and non-responders to trastuzumab-based regimens in the 45 independent test cases. See FIG. 17A. We assessed the PHC scores of TL-B and TL-NB by receiver operating characteristic (ROC) curves, and calculated area under the curve (AUC) values (FIG. 17Mi-ii). For TL-NB, an AUC value of 0.703 was obtained based on the scoring of the nucleus (22) (FIG. 17Mi), whereas TL-B yielded an AUC value of 0.688 (FIG. 17Mii) based on the scoring of both nucleus and cytoplasm. These AUC values from the individual libraries indicate that TL-NB and TL-B provide reliable information that distinguishes the NB and B phenotypes. To predict the patient's response to trastuzumab-based regimens with a multivariate method that uses PHC scores from both TL-NB and TL-B staining, a logistic regression model was developed. Specifically, the binary outcome of benefit- or non-benefit status was used as the dependent variable; the staining scores of TL-NB and TL-B, respectively, were treated as independent variables. We then assessed the performance of the model by ROC curve analysis. As a result, by combining the data from the two libraries, the AUC-value increased to 0.804, indicating improved performance due to the reciprocal nature of the training schemes (FIG. 17Miii, indicated by AUC=0.804). The statistical reliability of this analysis was further verified by 10-fold cross validation (CV), which resulted in an AUC value of 0.760 (FIG. 17Miii, indicated by AUC=0.760). We then compared these PHC-based NB and B classifications with those predicted by HER2 immunohistochemistry scoring of the same 45 cases test set (FIG. 17Miii, indicated by AUC=0.410). The HER2 IHC results yielded an AUC value of 0.410, indicating that TL-NB and TL-B outperformed conventional HER2 IHC in classifying trastuzumab B and NB cases in this cohort.

Figure 17N:
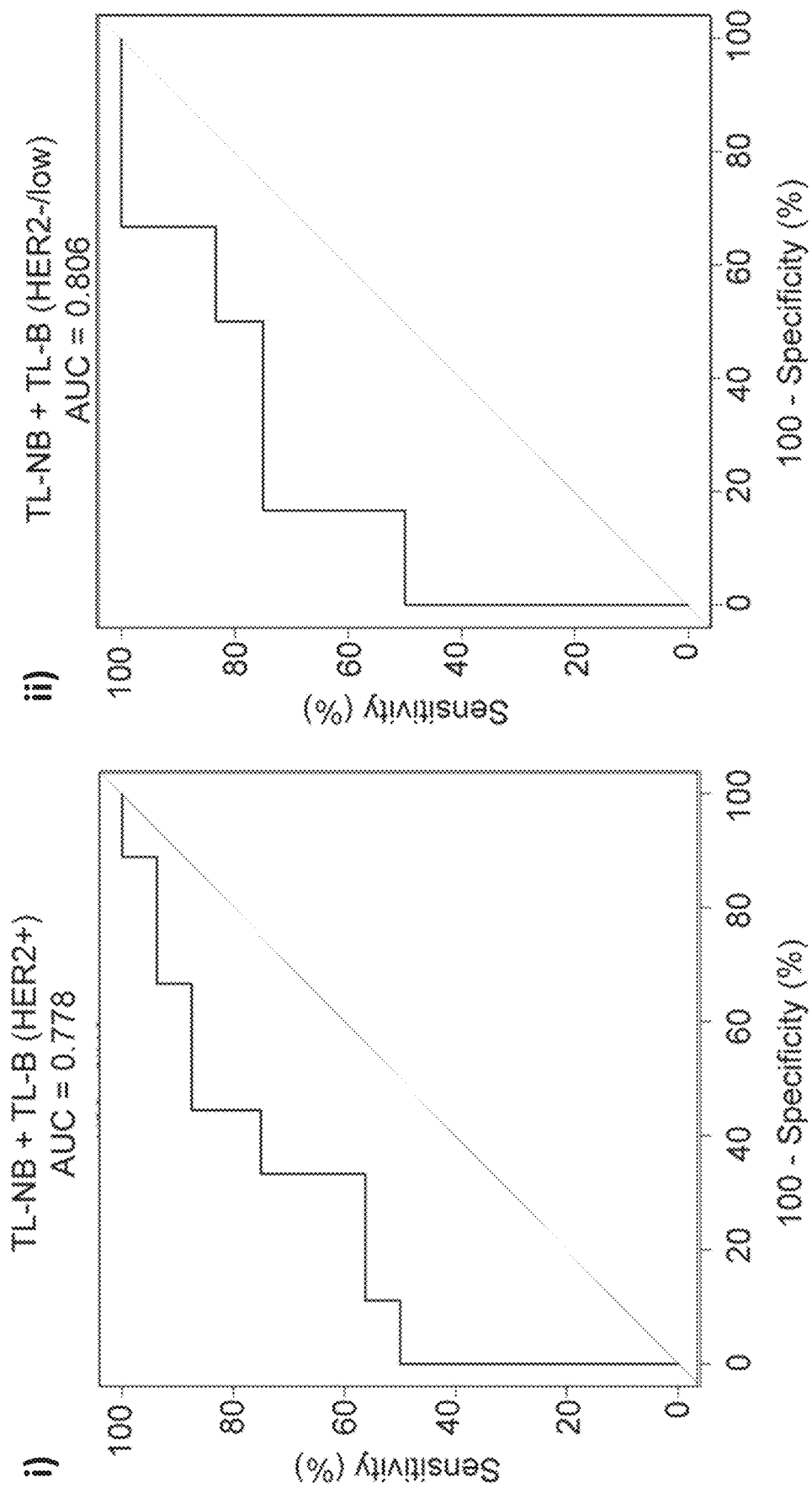

TL-NB and TL-B were able to effectively classify B and NB patients that had low levels of HER2− expression by IHC with an AUC value of 0.8. FIG. 17N shows the receiver operating characteristic (ROC) curves for differentiation between patients, benefiting and not from trastuzumab-based regimens, using combined histological scores from libraries TL NB and TL B polyligand histochemistry (PHC) staining in the test set of 45 cases, shown separately in the group of HER2+ cases (A) and in the group of HER2−/low cases (B). Hence, the ability of the libraries to differentiate NB from B-cases does not depend solely on the HER2 status.

Figure 17O:
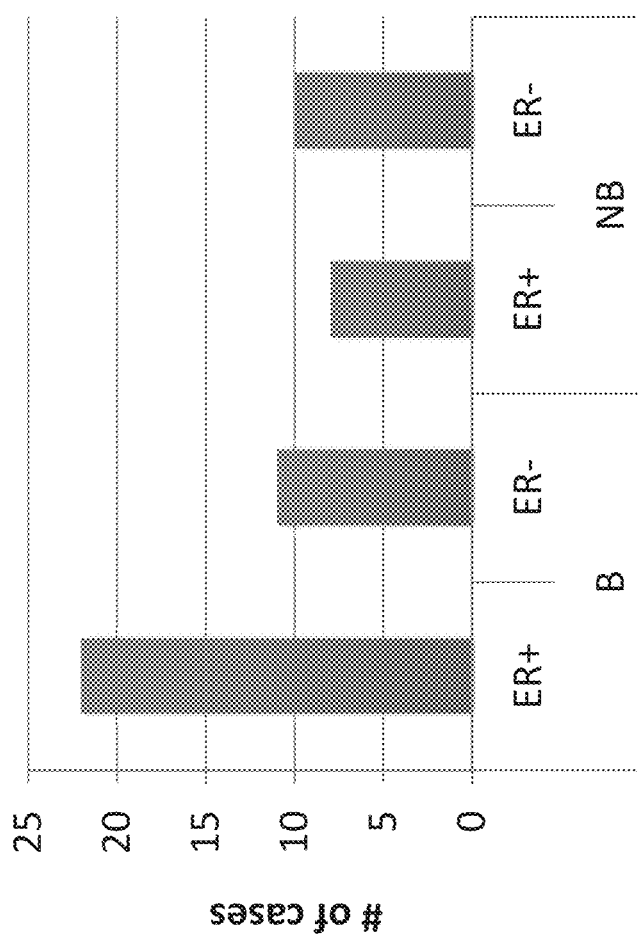

To determine whether TL-NB and TL-B were revealing information about response to trastuzumab-based regimens and not only classifying patients with a favorable prognosis regardless of trastuzumab treatment, we stained FFPE tumor tissues from an independent cohort of 33 patients who were treated with a platinum/taxane combination without trastuzumab. Like all other samples in this study, the samples from this non-trastuzumab cohort were collected prior to treatment. The AUC of the combined libraries on 33 HER2− cases independent from the test set who received platinum/taxane combination therapy instead of trastuzumab was 0.302 (FIG. 17Miii, indicated by AUC=0.302), indicating that the performance of TL-NB and TL-B relate to the molecular profile determining the response to the presence of trastuzumab in the treatment regimens. Moreover, trastuzumab has been reported to be substantially less effective in estrogen receptor (ER)-positive breast cancer (23, 24), but we found that the ER status of all cases enrolled in our study showed no correlation with the benefit from trastuzumab-based therapy. See FIG. 17O, which shows that in the tested population, benefit from trastuzumab does not correlate with hormonal status. ER status for the patients in this Example is shown in Tables 31-32. Taken together, these data indicate that the application of these libraries to the 45-cases test-set classifies patients with benefit from patients without benefit from trastuzumab-containing treatment with high accuracy, regardless of their HER2− status.

We next sought to evaluate the ability of PHC to select the fraction of patients that benefit from trastuzumab-based regimens for more than 180 days. FIG. 17Pi-ii show Kaplan-Meier curves of trastuzumab-treated breast cancer patients stratified by polyligand profiling. In FIG. 17Pi, the shortest distance between the ROC curves to point (specificity and sensitivity=100%) determines the cutoff of test positive and negative, and is represented as dot on the line indicated by AUC=0.804 in FIG. 17Miii (Sensitivity: 66.6%; Specificity: 86.7%). An "event" was defined as the time point (days) at which a patient either deceased from cancer or at which trastuzumab-based treatment changed. Median time of benefit is 604 days for patients tested positive ((FIG. 17Pi, upper curve), n=22, event=11) and 129 days for patients tested negative ((FIG. 17Pi, lower curve), n=23, event=18).

HR=0.320, 95% CI: 0.146-0.703; log-rank p=0.003. The small vertical lines mark cases that were censored due to absence of treatment follow-up data. See Table 32. FIG. 17Pii shows the Kaplan-Meier curve of trastuzumab-treated breast cancer patients stratified by tumors' HER2 status. HER2 status of patients with both HER2 IHC and HER2 ISH test results was determined according to the following rules. 1. HER2 positive, if any test shows positive result; else 2, HER2−/low, if any test shows negative result; else 3, NA, if both test show equivalent result. Median time of benefit was 250 days for HER2 positive cases ((FIG. 17Pii, lower curve, n=25, event=16), and 369 days for HER2−/low cases ((FIG. 17Pii, upper curve; n=18, event=12). HR=1.39, 95% CI: 0.62-3.13; log-rank p=0.418. Accordingly, the resulting Kaplan-Meier curves show that cases with positive test results exhibited a significantly longer TTNT (FIG. 17Pi, upper curve) than those tested negative (FIG. 17Pi, lower curve). The median event-free time, i.e. the time that elapsed before the treatment regimens changed, increased from 129 days for the test-negative to 604 days for the test-positive cases. For comparison, we analyzed the prognostic value based on the tumors' HER2 status as determined by IHC. In this case, the KM-curves did not reveal any significant difference in TTNT between patients that were HER2+ or Her2−/low (FIG. 17Pii). These data indicate that polyligand profiling can be employed to generate a predictive assay that differentiates between patients that benefit from a certain treatment regimens from those that do not.

In this Example, we demonstrated a prototypical polyligand profiling approach with potential to improve patient stratification for cancer therapy. The approach was applied to train the libraries TL-B and TL-NB for classifying trastuzumab response by TTNT. Polyligand profiling is not limited to this condition and will be applicable for differentiating a wide variety of phenotypes depending on the question at hand and the availability of suitable samples. Previous studies have used morphology-based enrichment of ssODN libraries on cancer tissues (see herein, references 25, 26) in order to identify new biomarkers. In this study, to account for the heterogeneity of molecular composition and the complex interactomes that reflect intra- and inter-tumoral variability it is reasonable that library training as introduced here enriches for a complex variety of ligands.

Without optimization, the PHC-test developed in this Example outperformed the standard HER2 IHC in differentiating the patients in this cohort who benefit from trastuzumab-based treatment from those that do not. See FIGS. 17M, P and related discussion above. These data indicate that the PHC-test can provide a CDx, in this case one that aims at identifying the 50-70% of HER2+ patients who will not benefit from trastuzumab. Conversely, it has been reported that 16-45% of patients with breast cancer who express low levels of Her2 derived benefit from adjuvant trastuzumab in combination chemotherapy (27-29). The data shown in FIGS. 17M, P indicate that a CDx based on polyligand profiling also has the potential to identify the patients who benefit from trastuzumab-containing regimens from the group expressing low levels of Her2.

Polyligand profiling allows accessing the molecular information that is reflected by the perturbations within the vast diversity of biological complexes that constitute cellular interactomes within or among tumors. In addition to predicting patients with benefit or without benefit from a given drug treatment regimens, the PHC approach can advance precision oncology in additional ways. For example, when applied to existing therapies as well as to new compounds in clinical trials polyligand profiling could reduce the administration of toxic therapies that are ineffective, and thereby could increase the success rate of new drugs.

References cited in this Example, all incorporated by reference herein in their entirety.
1. D. Hanahan, R. A. Weinberg, Hallmarks of cancer: the next generation. Cell 144, 646-674 (2011).
2. M. Gerlinger et al., Intratumor heterogeneity and branched evolution revealed by multiregion sequencing. N Engl J Med 366, 883-892 (2012).
3. L. A. Garraway, E. S. Lander, Lessons from the cancer genome. Cell 153, 17-37 (2013).
4. V. Prasad, Perspective: The precision-oncology illusion. Nature 537, S63 (2016).
5. V. Prasad, T. Fojo, M. Brada, Precision oncology: origins, optimism, and potential. Lancet Oncol 17, e81-86 (2016).
6. G. L. Klement et al., Future paradigms for precision oncology. Oncotarget 7, 46813-46831 (2016).
7. R. Kurzrock, F. J. Giles, Precision oncology for patients with advanced cancer: the challenges of malignant snowflakes. Cell Cycle 14, 2219-2221 (2015).
8. J. Shrager, J. M. Tenenbaum, Rapid learning for precision oncology. Nat Rev Clin Oncol 11, 109-118 (2014).
9. M. J. Duffy, J. Crown, Companion biomarkers: paving the pathway to personalized treatment for cancer. Clin Chem 59, 1447-1456 (2013).
10. M. P. Stumpf et al., Estimating the size of the human interactome. Proc Natl Acad Sci USA 105, 6959-6964 (2008).
11. Z. Mitri, T. Constantine, R. O'Regan, The HER2 Receptor in Breast Cancer Pathophysiology, Clinical Use, and New Advances in Therapy. Chemother Res Pract 2012, 743193 (2012).
12. H. J. Burstein, The distinctive nature of HER2− positive breast cancers. N Engl J Med 353, 1652-1654 (2005).
13. R. Bartsch, C. Wenzel, G. G. Steger, Trastuzumab in the management of early and advanced stage breast cancer. Biologics 1, 19-31 (2007).
14. I. Petak, R. Schwab, L. Orfi, L. Kopper, G. Keri, Integrating molecular diagnostics into anticancer drug discovery. Nat Rev Drug Discov 9, 523-535 (2010).
15. D. J. Slamon et al., Human breast cancer: correlation of relapse and survival with amplification of the HER-2/neu oncogene. Science 235, 177-182 (1987).
16. J. Horton, Trastuzumab use in breast cancer: clinical issues. Cancer Control 9, 499-507 (2002).
17. M. Famulok, J. S. Hartig, G. Mayer, Functional aptamers and aptazymes in biotechnology, diagnostics, and therapy. Chem. Rev. 107, 3715-3743 (2007).
18. M. Famulok, G. Mayer, Aptamer modules as sensors and detectors. Acc Chem Res 44, 1349-1358 (2011).
19. TTNT is a FDA-approved clinical endpoint that is robustly captured by electronic medical record systems and therefore is generally available.
20. U.S. Department of Health and Human Services Food and Drug Administration Center for Drug Evaluation and Research (CDER), Guidance for industry: clinical trial endpoints for the approval of cancer drugs and biologics., http://www.fda.gov/downloads/Drugs/ . . . /Guidances/ucm071590.pdf (2007).
21. Z. Gatalica, S. M. Lele, B. A. Rampy, B. A. Norris, The expression of Fhit protein is related inversely to disease progression in patients with breast carcinoma. Cancer 88, 1378-1383 (2000).
22. TL-NB staining of the cytoplasm was not informative for the differentiation of B and NB cases.

23. L. Lousberg, J. Collignon, G. Jerusalem, Resistance to therapy in estrogen receptor positive and human epidermal growth factor 2 positive breast cancers: progress with latest therapeutic strategies. Ther Adv Med Oncol 8, 429-449 (2016).
24. S. Loi et al., Effects of Estrogen Receptor and Human Epidermal Growth Factor Receptor-2 Levels on the Efficacy of Trastuzumab: A Secondary Analysis of the HERA Trial. JAMA Oncol 2, 1040-1047 (2016).
25. H. Wang et al., Morph-X-Select: Morphology-based tissue aptamer selection for ovarian cancer biomarker discovery. Biotechniques 61, 249-259 (2016).
26. S. Li et al., Identification of an aptamer targeting hnRNP A1 by tissue slide-based SELEX. J Pathol 218, 327-336 (2009).
27. S. Paik, C. Kim, N. Wolmark, HER2 status and benefit from adjuvant trastuzumab in breast cancer. N Engl J Med 358, 1409-1411 (2008).
28. S. Ithimakin et al., HER2 drives luminal breast cancer stem cells in the absence of HER2 amplification: implications for efficacy of adjuvant trastuzumab. Cancer Res 73, 1635-1646 (2013).
29. clinicaltrials.gov/ct2/show/NCT01275677term=NSABP+B01275647&rank=01275671.

Example 22: Polyligand Profiling Materials and Methods

This Example provides Materials and Methods used in Example 21 above.

FFPE Tissue Cases

The study was performed with Western Institutional Review Board approval, 45 CFR 46.101(b)(4).

This study included cases from women with invasive breast cancer that received trastuzumab-based treatment first line after tissue collection with a sufficient number of properly fixed and embedded slides available. Cases with in situ cancer, improperly fixed or crushed tissue sections were not included in this study. Cases with incomplete staining (i.e. insufficient coverage of the tissue with binding solution) and other technical problems with the assay performance were excluded from analysis.

Serial tissue sections of 51 patients with breast cancer that had time-to-next treatment (TTNT) data from trastuzumab therapy were used for training of the ssODN libraries and testing of TL-NB and TL-B. A separate group of 33 cases that had TTNT data from platinum-taxane treatment was used as a control set to evaluate the specificities of TL-NB and TL-B towards trastuzumab-based TINT. Excised tissue containing both tumor and normal parts, was formalin-fixed, paraffin-embedded and serially sectioned (4 µm). Haematoxylin and eosin (H&E) staining was performed for 1-2 slides of each case and served for initial pathological diagnosis. Pre-treatment of the FFPE tissue slides before the enrichment included incubating slides at 60° C. for 1.5 h, followed by automated deparaffinization and epitope retrieval on the Ventana UltraView Autostainer (Ventana Medical Systems, Inc., Tucson, Ariz.). Specifically, deparaffinization at 72° C. for 24 min, dehydration by ethanol, epitope retrieval at 90° C. for 36 min and 100° C. for 4 min (pH 8), followed by peroxidase inhibition ($H_2O_2$, 1%≤x<5%) and washing slides with detergent (Dawn 1-00; P&G Professional, The Procter & Gamble Company, Cincinnati, Ohio) to remove residual liquid coverslip. For testing of the enriched libraries, deparaffinization was performed manually, by incubation at 60° C. for 1.5 hour, followed by epitope retrieval on PT-Linker (Dako, Agilent Technologies, Santa Clara, Calif.) at 97° C. for 20 min, pH 9.

Treatment regimens and pathological diagnoses for 84 cases can be found in Tables 29-32. A subset of 3 non-benefiting (NB) breast cancer cases and 3 benefiting (B) breast cancer cases was selected for enrichment. Patients who stayed on their initially prescribed trastuzumab therapy for at least 181 days were classified as B; patients whose treatment changed within 180 days were classified as NB. Clinical information for the training cases can be found in Tables 29-30. For enrichment purposes, tissue areas with breast carcinoma were utilized as positive selection targets, while adjacent non-malignant tissue as well as carcinoma tissue from patients with alternative response was used as counter selection targets.

ssDNA Library Design and Reproduction with Unequal Length Primers Asymmetrical PCR The random ssDNA library (naïve F-TRin-35n-B 8-3s library) contains 35 random nucleotides flanked by constant regions. Specifically, the naïve library comprises a 5' region (5' CTAGCATGACTGCAGTACGT (SEQ ID NO. 4)) followed by a random naïve oligonucleotide sequence of 35 nucleotides and a 3' region (5' CTGTCTCTTATACA-CATCTGACGCTGCCGACGA (SEQ ID NO. 5)). This library was synthesized at Integrated DNA Technologies (IDT, Coralville, Iowa, USA), pooled in equimolar amounts and PCR amplified to add biotin to the 5'-end. The library constant regions are complimentary to primers: reverse: 5'-Biosg-CTAGCATGACTGCAGTACGT-3' (SEQ ID NO. 4) and forward: 5'AAAAAAAAAAAAAAAAAAAAAA AAAA AAAAAAAAA (SEQ ID NO. 203062)/iSp9//iSp9/TCGTCGGCAGCGTCA-3' (SEQ ID NO. 203063)), which were used in asymmetric PCR to generate majority of the target strand. The internal spacers iSp9 (Internal triethylene glycol Spacer, IDT) of the forward primer prevented extension of the complimentary strand, while the addition of poly-A tail resulted in longer length of forward strands, allowing for size separation and target strand ssDNA recovery following gel excision from 4% denaturing agarose E-gels with final purification by gel extraction column (Nucleospin, MACHEREY-NAGEL GmbH & Co. KG, Düren, DE). Biotinylated antisense library was used for enrichment. Asymmetric PCR mixture (100 µl) contained 5×Q5 PCR buffer, 0.2 mM dNTPs, 0.08 µM of forward primer, 30 µM of reverse primer, 0.01 pmol template (of pure library) or 57 µl of post-dissection solution containing library/tissue (after enrichment) and 2U of Q5 Hot Start High-Fidelity DNA polymerase (New England Biolabs, Ipswich, Mass.). PCR program included initial denaturation at 98° C. for 30 sec, followed by cycle of denaturation, annealing (60° C. for 30 sec) and extension (72° C. for 3 min), and final extension was at 72° C. for 5 min. For pure library 15 cycles of amplification were performed, for libraries during enrichment number of cycles varies between 15 and 30 depends on the recovery. Asymmetric PCR products were mixed with denaturing buffer (180 mM NaOH, 6 mM EDTA), heated at 70° C. for 10 min, cooled down on ice for 3 min, loaded ~20 µl on 4% agarose SYBRGold gel (E-GEL EX Gels, G401004, Life Technologies), separated for 15 min. Single stranded reverse strand was cut, gel pieces were combined with NTC buffer (Nucleospin, Macherey-Nagel), melted at 50° C. for 5-10 min until all pieces got molten. 700 µl of melted agarose was loaded onto Nucleospin column and then followed standard procedure for ssDNA purification. Purified DNA was eluted with 30 µl of NE buffer.

FFPE Tissue Slide-Based SELEX

Enrichment of ssODNs libraries toward Trastuzumab response was performed according to the scheme in FIG. 17C. Treatment regimens for enrichment cases can be found in Table 29-30. In the enrichment of each library, first three rounds were performed on positive cases only, followed by additional three rounds with two counter selections cases and one positive case. For positive selection, 400 µl of blocking buffer (0.8 ng/ul Salmon DNA (Life Technologies, Thermo Fisher Scientific Inc., Waltham, Mass., USA), 0.8 ng/µl tRNA (Life Technologies), 1 µg/µl HSA (Sigma), 0.5% F127 (Thermo Fisher) and 3 mM $MgCl_2$ in Ix PBS) was mixed with 90 µl of ssODN library solution (7 pmol for round 1, 3.5 pmol for following rounds in 1×PBS, 3 mM $MgCl_2$) on top of the Agilent gasket slide (Agilent Technologies, Santa Clara, Calif.). FFPE tissue slide, after deparaffinization and epitope retrieval, was mounted on top of the gasket slide containing binding cocktail and incubated for 1 hour in Agilent microarray hybridization chambers with rotation at RT. After incubation, slides were washed by dipping into 2×750 ml washing buffer (1×PBS, 3 mM $MgCl_2$) buffer, 3 dips into each jar. Next, 490 µl of nuclear fast red (NFR), supplemented with 3 mM $MgCl_2$, was added to the slide for 45 s and washed by 6 times dipping in 750 ml washing buffer. Based on the initial pathological diagnosis from corresponding H&E slides, cancer areas were dissected and transferred into 180 µl water, which served as a template for asymmetric PCR with unequal length primers to generate single stranded library for next round (see protocol above). Remaining normal tissue served for internal counter selection. This protocol was repeated for 3 rounds. For negative selection, binding cocktail was added directly to the tissue of counter selection slides and incubated for 1 hour in humidity chamber. After incubation, maximum volume of supernatant was collected. Additionally, 50 µl of blocking buffer was applied to collect the unbound ssODNs. Combined supernatant was added to the $2^{nd}$ counter selection slide and incubated for 1 hour. After incubation supernatant was collected the same way as before and applied to the slide from positive case for another hour incubation, done this time in the Agilent microarray hybridization chamber. The following steps, washing, staining and PCR, were the same as described above.

Polyligand-Histochemistry (PHC) Screening of the Enriched Libraries

Staining of FFPE tissue slides with enriched libraries was performed on Dako Autostainer. After baking slides at 60° C. for 1.5 hour, epitope retrieval was done on Dako PT-Linker at pH9, 98° C., 22 min. The staining on Dako Autostainer includes 5 min peroxidase inhibition with 450 µl of solution, containing disodium hydrogenorthophosphate 5%<=x<7%, $H_2O_2$ 3%<=x<5%, phosphoric acid, monosodium salt, monohydrate 1%<=x<2%, 1 hour incubation with 450 ul of binding cocktail (3.5 pmol of enriched library, 0.65 ng/µl Salmon DNA, 0.65 ng/µl tRNA, 10% BlockAid (Life Technologies), 30 min incubation with 450 µl of Streptavidin Poly-HRP, supplemented with 3 mM $MgCl_2$, 10 min staining with DAB solution, supplemented with 3 mM $MgCl_2$, followed by 5 min incubation with 450 µl of Hematoxylin (2 ng/µl final conc.). Rinsing with 1×PBS, 3 mM $MgCl_2$ buffer was done between each step. Finally, the stained slides were dehydrated with ethanol, xylene and covered by coverslip for long-term storage. Microscopy was done on Olympus BX41 (Olympus Corporation of the Americas, Center Valley, Pa., USA).

Histological scores for both nuclear and cytoplasmic staining were calculated as sum between intensity levels (1, 2 and 3) multiplied by the percentage of the cells with this particular intensity.

Statistical Analysis

Firstly, the ability of each single library to classify Trastuzumab responders and non-responders was assessed by ROC curves and AUCs. See, e.g., FIGS. 17J-K. To predict the patient's response to trastuzumab therapy with a multivariate method using PHC scores from both library TL-NB and TL-B staining, a logistic regression model was developed. Specifically, a binary outcome of responder/non-responder was used as the response variable, and staining scores of libraries TL-NB and TL-B were treated as independent variables (FIG. 17J (C), solid line labeled AUC=0.804). A 10-fold cross-validation was conducted to assess the generalizability of the model's prediction performance, in which the data set was randomly split into 10 equal parts exclusively. A logistic regression model was built on 9 parts, and subsequently tested on the 1 hold-out part. This process was iterated throughout the 10 parts, and only the predicted probability was collected for further assessment (FIG. 17J (C), dashed line labeled AUC=0.760).

The end points of time to next treatment (TINT) were defined as either the time of next non-trastuzumab treatment or death. Patients without the next non-trastuzumab treatment or death information were censored at the last contact date (see vertical marks in the Kaplan-Meier curves (FIG. 17M). A Cox-PH model was fitted using either tumors' HER2 status or PHC test results as the independent variable. Median survival time was calculated from the Kaplan-Meier estimate. The Log-rank test was performed to evaluate the significance of TINT survival between groups. All analysis was conducted using the "survival" r package.

Example 23: Alternate Oligonucleotide Probe Assay Classifies Outcomes of Breast Cancer Patients Treated with Trastuzumab-Based Therapy Background:

Although trastuzumab is a highly effective targeted therapy, approximately 50% of patients with HER2+ breast cancers do not benefit from trastuzumab-based regimens. We developed a poly-ligand aptamer-based approach that outperforms traditional HER2 testing in its ability to classify patients likely to derive benefit from trastuzumab.

Methods:

A library of $10^{13}$ biotinylated ssDNA oligodeoxynucleotides (ssODN) was incubated on FFPE tissue slides of patients who either benefited (B) or did not benefit (NB) from trastuzumab-based therapies based on time to next treatment. Unbound ssODNs were discarded and bound ssODNs were retained for two subsequent rounds of positive selection. Starting at round 4, the partially enriched library was applied to cases representing the alternate phenotype (NB for B and vice versa) for negative selection and supernatant containing unbound ssODNs was collected and retained. Libraries obtained after two more rounds of negative selection were used as probes to stain and score 30 B and 15 NB independent cases by Polyligand Histochemistry (PHC). The ability of the trained libraries to classify patients who benefited from trastuzumab-based treatment was assessed by calculating AUC values from ROC curves.

Kaplan-Meier (KM) plots were used to compare outcomes with test results.

Results:

Two libraries effectively classified B and NB groups (ROC AUC of 0.8). In contrast, standard HER2 IHC yielded an AUC of 0.4. Median duration of trastuzumab treatment was 604 days for test-positive patients and 129 days for test-negative patients (HR=0.320, 95% CI: 0.146-0.703; log-rank p=0.003), indicating that PHC scoring was highly effective for classifying distinct clinical outcomes. By HER2 status alone (IHC), median duration of trastuzumab treatment of 250 days for HER2+ cases and 369 days for HER2−/low cases (HR=1.39, 95% CI: 0.62-3.13; log-rank p=0.418).

Conclusions:

These results indicate that polyligand profiling provides a high-performance systems biology approach to generating predictive assays that can be used to identify patients more or less likely to benefit from targeted therapies such as trastuzumab.

Example 24: Selection of Aptamers on FFPE Tissue from Individuals Diagnosed with Colorectal Cancer and Treated with FOLFOX and Bevacizumab Bevacizumab is a recombinant humanized monoclonal antibody that blocks angiogenesis by inhibiting vascular endothelial growth factor A (VEGF-A). VEGF-A is a chemical signal that stimulates angiogenesis in a variety of diseases, especially in cancer. Bevacizumab, sold under the trade name Avastin, was approved by the FDA in February 2004 for use in metastatic colorectal cancer (CRC) when used with standard chemotherapy treatment (as first-line treatment) and with 5-fluorouracil-based therapy for second-line metastatic colorectal cancer. FOLFOX is a chemotherapy regimen for treatment of colorectal cancer, made up of three drugs: 1) FOL—Folinic acid (leucovorin); 2) F—Fluorouracil (5-FU); and 3) OX—Oxaliplatin (Eloxatin). FOLFOX and bevacizumab may be used as first-line treatment for metastatic CRC.

Figure 18B:
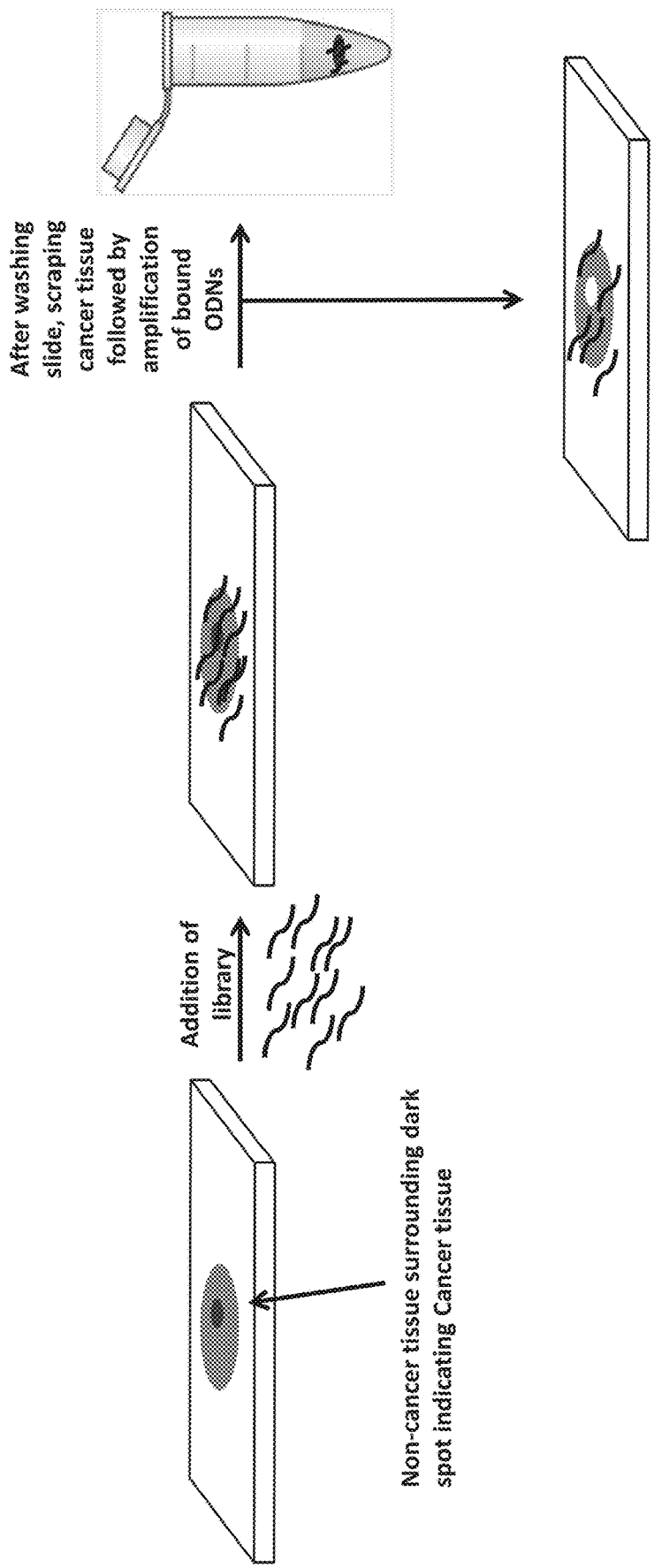
Figure 18C:
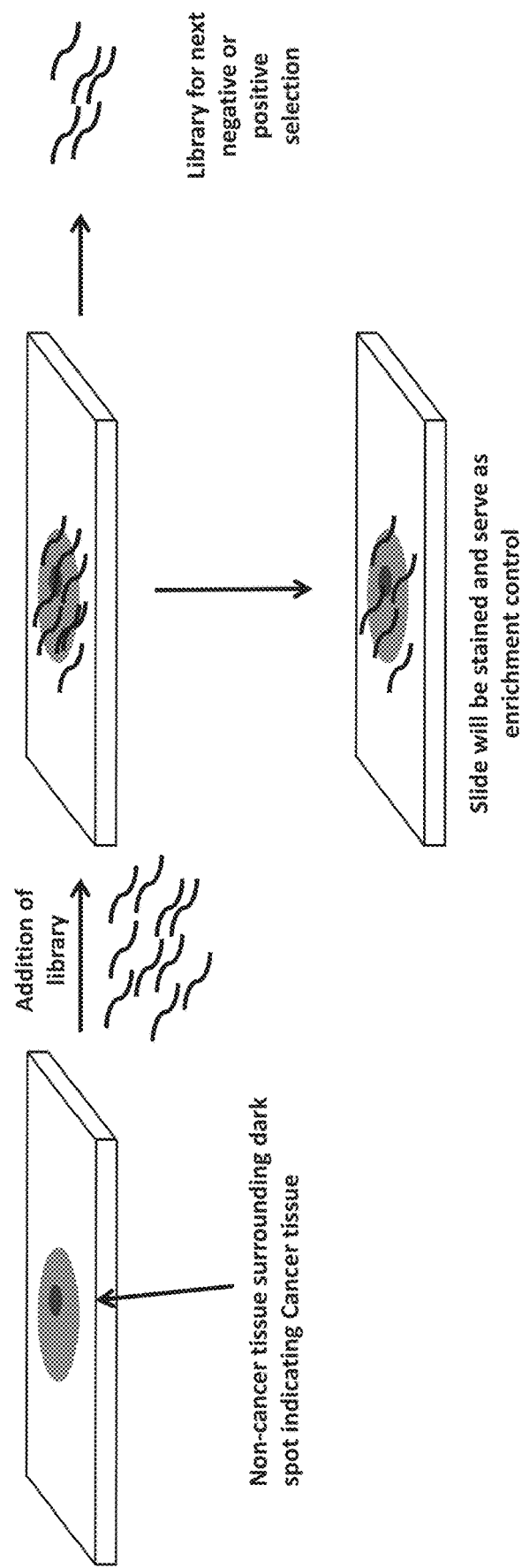

Currently, there is no good way to predict efficacy of FOLFOX with Bevacizumab as a treatment in cancer therapy. The goal of this Example was the development of oligonucleotide probe libraries that can be used in an assay that predicts the response to a combinational therapy with FOLFOX/bevacizumab in individuals diagnosed with colorectal cancer. The approach taken is similar to Examples 19-20 above. Briefly, the selection of oligonucleotide probes was performed on FFPE CRC tissue samples. Patients were divided into two cohorts based on the time they have stayed on FOLFOX (TNT; time to next treatment): responder and non-responder. A non-responder stayed on FOLFOX for a maximum of 124 days while a responder was on this treatment for at least 241 days. Bevazicumab treatment varied from patient to patient. It might have started at the same time as FOLFOX or later and ended at the same time, earlier or later than FOLFOX. An enrichment scheme is outlined in FIG. 18A with positive and negative selection steps illustrated in FIG. 18B and FIG. 18C, respectively.

Six rounds of positive selection of 7 enrichments for responder and 4 enrichments for non-responders were performed, creating 11 pools of enriched oligonucleotide probes. Counter selection was performed for responder cases on the non-responder samples and vice versa. An exemplary set of slides is shown in FIGS. 18D-E, which shows staining of an FFPE sample used for positive selection in enrichment "M" stained with H&E (FIG. 18D) or the probe library M (FIG. 18E). The figure shows staining for cancer tissue; tumor site: colon; specimen: colon. The slides are shown at 20× magnification. Table 37 shows results of staining intensity of the indicated tissue samples with the indicated probe library.

TABLE 37

Enriched oligonucleotide probes

|  | Enriched Probe Library | Specimen used for positive selection | Cancer | Non-Cancer |
|---|---|---|---|---|
| Non-responder | A | Rectum | ++ | − |
|  | C | Colon | +++ | No data |
|  | E |  | +++ | No data |
|  | F |  | ++ | + |
| Responder | G |  | ++ | ++ |
|  | H |  | ++ | − |
|  | I |  | +++ | +++ |
|  | J |  | +++ | + |
|  | K |  | ++ | ++ |
|  | L |  | ++ | + |
|  | M |  | +++ | + |

Figure 18F:
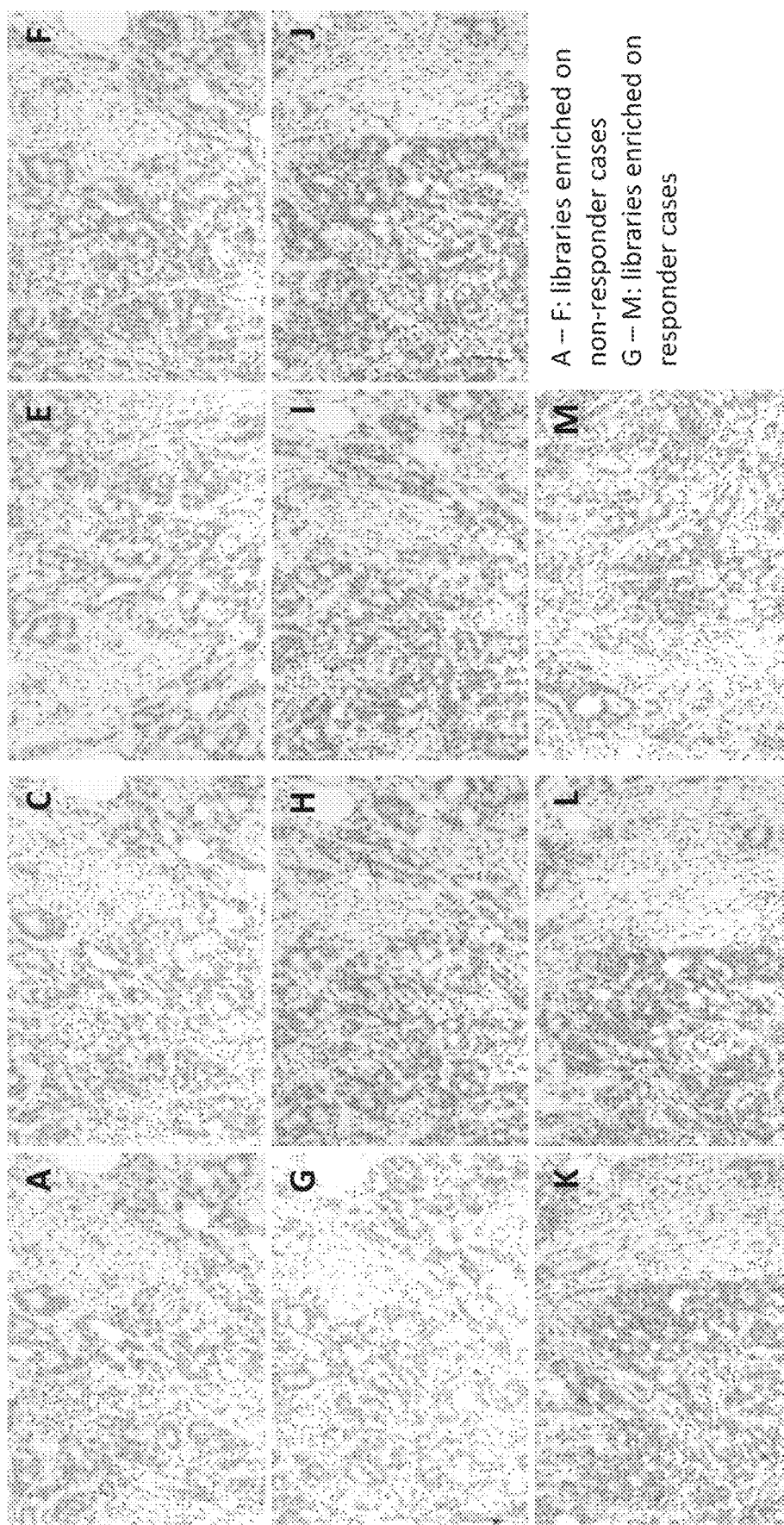
Figure 18G:
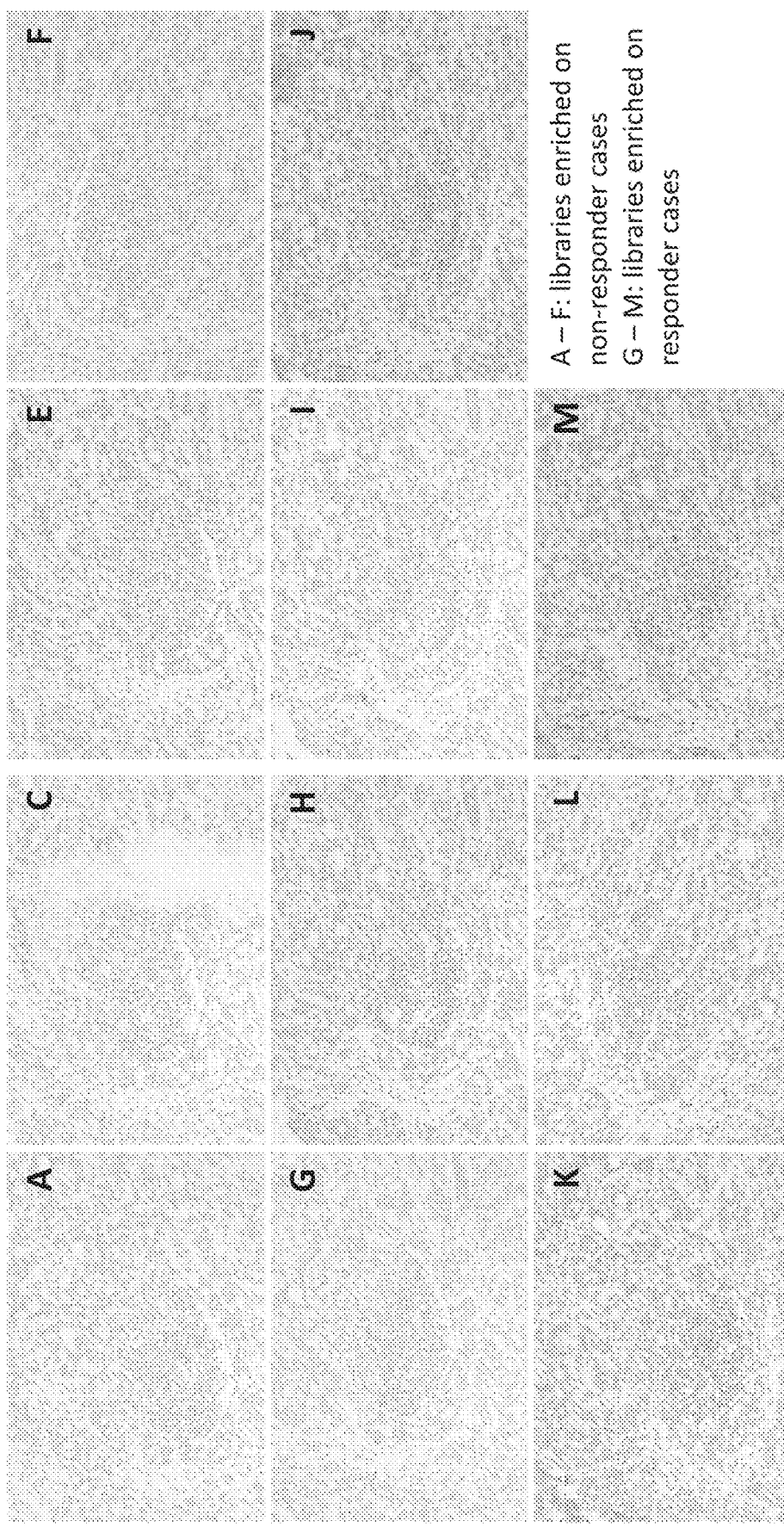

To test the enriched libraries, one non-responder case and 5 responder cases that were not part of the enrichment were stained with all 11 libraries. In addition, the cases used for positive selection were stained with the corresponding libraries. Exemplary results for staining of one test sample, Sample 2, are shown in FIGS. 18F-G. The sample characteristics include: Responder; tumor site: descending colon; specimen: descending colon. FIG. 18F shows staining of a cancer sample from the Sample 2 slide. The library (A-M) are indicated over each slide in the figure. As shown, slightly darker staining was observed in slides H-M as compared to the others. FIG. 18G shows staining of non-cancer tissue from the Sample 2 slide. In this setting, staining was lighter and of similar intensity across all samples.

Another set of enrichment experiments was performed on a fixed sample comprising tumor tissue from an individual considered to be a responder to bevacizumab. For positive selection, the oligonucleotide probe library was binding to the entire tissue on the slide but only the cancer tissue was scraped off the slide, then the library was recovered from the scraped tissue and amplified. After three such rounds, three rounds of two steps of negative selection (tissue from two individuals not responding to Avastin) and one positive selection as before were performed. Round 7 included one more positive selection. For round 8, the enrichment strategy was altered. Instead of doing enrichment of tissue fixed to slides, the cancer tissue and the non-cancer tissue were scraped and separated in different tubes. To perform enrichments in tubes, we used centrifugation at 100,000×g to separate the tissue from unbound library. Four rounds of enrichment on scraped cancer tissue with counter selection on scraped non-cancer tissue were performed. The library after 12 rounds was used for probing and selection of aptamer that bound stronger to cancer relative to non-cancer tissue. Four sequences recovered from the enrichment are shown in Table 38. The table indicates the variable region of the identified sequences along with the full length sequence with 5' region CTAGCATGACTGCAGTACGT (SEQ ID NO 4) and a 3' region CTGTCTCTTATACACATCTGACGCTGCCGACGA (SEQ ID NO 5) surrounding the variable region. These sequences can be used to identify, e.g., by staining, cancer tissue from a responder to bevacizumab. In the table, the sequences with name comprising "RC" are the reverse complement sequences used as non-binding controls.

TABLE 38

Oligonucleotide probes that bind bevacizumab responder cancer tissue

| Variable Region (5'->3') | SEQ ID NO | Seq name | Full sequence (5'->3') | SEQ ID NO |
|---|---|---|---|---|
| GCTTCCCGC AACCGTCCT ACCCATCCT ACGCCTCC | 203064 | 5825D-R12c-S1-5'biotin | /5Biosg/CTAGCATGACTGCAGTACGTGCT TCCCGCAACCGTCCTACCCATCCTACGCCTC CCTGTCTCTTATACACATCTGACGCTGCCGA CGA | 203068 |
|  |  | 5825D-R12c-S1RC-5'biotin | /5Biosg/TCGTCGGCAGCGTCAGATGTGTA TAAGAGACAGGGAGGCGTAGGATGGGTAGGA CGGTTGCGGGAAGCACGTACTGCAGTCATGC TAG | 203069 |
| TGGTCACCG CTTCCGCTG GTACGCCCC ACCCCATAA | 203065 | 5825D-R12c-S2-5'biotin | /5Biosg/CTAGCATGACTGCAGTACGTTGG TCACCGCTTCCGCTGGTACGCCCCACCCCAT AACTGTCTCTTATACACATCTGACGCTGCCG ACGA | 203070 |
|  |  | 5825D-R12c-S2RC-5'biotin | /5Biosg/TCGTCGGCAGCGTCAGATGTGTA TAAGAGACAGTTATGGGTGGGGCGTACCAG CGGAAGCGGTGACCAACGTACTGCAGTCATG CTAG | 203071 |
| ACCTAGCTG CTCCCTACT CCCTTCTTA TGTACATTA | 203066 | 5825D-R12c-S3-5'biotin | /5Biosg/CTAGCATGACTGCAGTACGTACC TAGCTGCTCCCTACTCCCTTCTTATGTACAT TACTGTCTCTTATACACATCTGACGCTGCCG ACGA | 203072 |
|  |  | 5825D-R12c-S3RC-5'biotin | /5Biosg/TCGTCGGCAGCGTCAGATGTGTA TAAGAGACAGTAATGTACATAAGAAGGGAGT AGGGAGCAGCTAGGTACGTACTGCAGTCATG CTAG | 203073 |
| TTCATGCTG TTCCATGAC CTCCACATT TCTCACGCT GA | 203067 | 5825D-R12c-S4-5'biotin | /5Biosg/CTAGCATGACTGCAGTACGTTTC ATGCTGTTCCATGACCTCCACATTTCTCACG CTGACTGTCTCTTATACACATCTGACGCTGC CGACGA | 203074 |
|  |  | 5825D-R12c-S4RC-5'biotin | /5Biosg/TCGTCGGCAGCGTCAGATGTGTA TAAGAGACAGTCAGCGTGAGAAATGTGGAGG TCATGGAACAGCATGAAACGTACTGCAGTCA TGCTAG | 203075 |

Additional sequences were determined after round 9 above. Tissue from responder cancer (i.e., cancer tissue from responder patients), responder non-cancer (i.e., non-cancer tissue from responder patients), non-responder cancer (i.e., cancer tissue from non-responder patients) and non-responder non-cancer (i.e., non-cancer tissue from non-responder patients) were scraped and bound oligonucleotides were sequenced. The fold changes between the non-responder cancer and other tissues were calculated after normalization of read counts from the sequencing to the tissue sizes. Table 39 shows fold changes for the non-responder cancer over the other three tissue types as indicated. The table indicates the variable region of the identified sequences. The full length sequences comprised 5' region CTAGCATGACTGCAGTACGT (SEQ ID NO 4) and a 3' region CTGTCTCTTATACACATCTGACGCTGC-CGACGA (SEQ ID NO 5) surrounding the variable region. Any appropriate flanking sequences can be used. In Table 40, the complete sequences for the first six variable regions in Table 39 along with the complete sequences with flanking regions. These sequences can be used to identify, e.g., by staining, cancer tissue from a responder to bevacizumab. The variables regions of additional sequences with fold changes of at least 100% in one comparison are listed in SEQ ID NOs. 203114-206478. In Table 40, the sequences with name comprising "RC" are the reverse complement sequences and can be used as non-binding controls. The sequences in Table 40 are further shown labeled with digoxigenin (DIG). Anti-digoxigenin antibodies with high affinities and specificity can be used in a variety of biological immuno-assays, e.g., to visualize the oligonucleotide staining as described herein. Both biotin and digoxigenin labeling can be used in such applications, in addition to any other such useful labeling systems. Any desired number or combination of the sequences in Table 39 can be used to create oligonucleotide probes such as in Table 40.

TABLE 39

Sequences with fold-change differences between bevacizumab non-responders and responders

|  |  | Sample Type/Fold changes | | |
|---|---|---|---|---|
| Variable Sequence 5' -> 3' | SEQ ID NO | Responder, Cancer | Non-responder, non-cancer | Responder, non-cancer |
| ATATGCGATGCTAGCTCGAAGCGTGTGCAGTCCCT | 203076 | 2 | 4 | 2 |
| GTCCAGCTCGCAATTACACTAGTTTGCCAGTAAAAG | 203077 | 3 | 4 | 3 |

TABLE 39-continued

Sequences with fold-change differences between bevacizumab non-responders and responders

| Variable Sequence 5' -> 3' | SEQ ID NO | Responder, Cancer | Non-responder, non-cancer | Responder, non-cancer |
|---|---|---|---|---|
| TCCGGAGTCCATAAGACTACGGATAGCTTTGACCG | 203078 | 3 | 3 | 9 |
| CATGCACATCGCGTTTCGGAAACAAAAGTGTAGATA | 203079 | 2 | 3 | 4 |
| CCACACGACGTGTGACCTCGGATTCCTCATACACT | 203080 | 2 | 3 | 3 |
| ACTGGGTACTTGAATCATTGTCGCATTTCCCTATT | 203081 | 4 | 3 | 11 |
| CGTAGTTAAGACGCCTCAAGACACATACGGCTTGAA | 203082 | 0 | 49 | 0 |
| TCATGACCGAGTAACGACCGACCCACATATCCGC | 203083 | 1 | 37 | 2 |
| GTTGGCTCCCTCTAGCATATCCCCACTAGCTGG | 203084 | 1 | 26 | 1 |
| CGCCCACTCTTGTTGTTACCGTGCTGTCCTCGGTC | 203085 | 1 | 22 | 1 |
| GCATGTGTGGTTTCCCCAGCGCACTCGAGACGACT | 203086 | 0 | 22 | 1 |
| GAAAAGTCAGACTTTTGAAGGATTGTGCTGGAACT | 203087 | 1 | 20 | 1 |
| GAACATGAAGCATCGAAAGCACTTCACGTAGATTCGA | 203088 | 1 | 17 | 0 |
| TTGTGGATTCAAGCGGTCACCACTATGCCAACTTCCA | 203089 | 1 | 14 | 1 |
| CCACCTTTTCCACCCATTCCAGGATAGTCGCCCACGA | 203090 | 0 | 13 | 0 |
| GTTCGGATGCCCACAGCCCGTTAAGGTATTTTCACGA | 203091 | 0 | 11 | 0 |
| TTGTGGGGACGTATGAGCAGATCCATGCGCGCCA | 203092 | 0 | 9 | 1 |
| AGATCTCCGGTACGCCACCGGCGATACCGATTCAG | 203093 | 1 | 9 | 1 |
| GTAACCCGATTTTCACGGCCGACCGCATACGCGCC | 203094 | 0 | 8 | 1 |
| GCTAGACACTTACAGTGACGTTACTGTCTTGAGCT | 203095 | 0 | 8 | 1 |
| GGACATTCAGGTGTCGCTCATCCAAAGCTACGTGC | 203096 | 1 | 7 | 6 |
| GTTATCGCACTGAAAAGTAATTCCTTGTATACTCT | 203097 | 1 | 7 | 1 |
| GCAAAGGATCCTGGTTGGGCACTTTGTTCCTTTCC | 203098 | 0 | 7 | 0 |
| ACCCACTAGGAGGTCGTTAAAGGATAGTTGTAAACTCA | 203099 | 2 | 7 | 2 |
| TCTTGCCTCTGTATGAGCGAGAACTTCTCGCGCGTTCA | 203100 | 1 | 7 | 1 |
| GTCAGTCCCTGGAGTCCATGTGCTTTACCGCCGTC | 203101 | 0 | 7 | 0 |
| GAAAGACAACACGTATACATCCCTGAGCCACCCACGA | 203102 | 0 | 6 | 0 |
| CCATTGCTCTTACACCGCCTGTCCTTACGGTTGTGGA | 203103 | 1 | 6 | 4 |
| TGTTTGCCGATCTCTCATCTGGAGGAACGGGGCA | 203104 | 0 | 6 | 1 |
| GTAGTATGTTCTCTTTACTGCGACATGAGTTTCGGTCA | 203105 | 1 | 6 | 1 |
| CGTCACGACACCTACACAAAGCCGCACTCCCTCTGGA | 203106 | 1 | 6 | 1 |
| GTATGGTTAACACCAATTACCGGATCCGTAGATTCA | 203107 | 0 | 6 | 0 |
| AACAATACCACAGTGGATGCTACCAGTCCCATTAT | 203108 | 1 | 6 | 1 |
| GACCCGTTTTGTCGTTGTATTGATATGGTACGTCTTGA | 203109 | 1 | 6 | 1 |
| AAATCGCGACCGGGACAGTGCCGATATTTTTCACG | 203110 | 0 | 6 | 1 |
| CTATCCGATGCTACCACTGTTTGAAATCAACAGCC | 203111 | 1 | 6 | 0 |

TABLE 39-continued

Sequences with fold-change differences between bevacizumab non-responders and responders

| Variable Sequence 5' -> 3' | SEQ ID NO | Sample Type/Fold changes | | |
|---|---|---|---|---|
| | | Responder, Cancer | Non-responder, non-cancer | Responder, non-cancer |
| CTTCATTCGGTTCGGCCGTTCGAACACACTTGTCCCA | 203112 | 1 | 6 | 1 |
| GCTAATGCTCGGTGAGGATCGAGCTCCGGTGCCTC | 203113 | 1 | 6 | 1 |

TABLE 40

Oligonucleotide probes that bind bevacizumab responder cancer tissue

| Variable Region SEQ ID NO | Seq name | Full sequence (5'->3') | SEQ ID NO |
|---|---|---|---|
| 203076 | 5825C-R9-S1-5'DIG | /5DIG/CTAGCATGACTGCAGTACGTATATGCGATGCTA GCTCGAAGCGTGTGCAGTCCCTCTGTCTCTTATACACAT CTGACGCTGCCGACGA | 206479 |
| | 5825C-R9-S1-RC-5'DIG | /5DIG/TCGTCGGCAGCGTCAGATGTGTATAAGAGACAG AATAGGGAAATGCGACAATGATTCAAGTACCCAGTACGT ACTGCAGTCATGCTAG | 206480 |
| 203077 | 5825C-R9-S2-5'DIG | /5DIG/CTAGCATGACTGCAGTACGTGTCCAGCTCGCAA TTACACTAGTTTGCCAGTAAAAGCTGTCTCTTATACACA TCTGACGCTGCCGACGA | 206481 |
| | 5825C-R9-S2-RC-5'DIG | /5DIG/TCGTCGGCAGCGTCAGATGTGTATAAGAGACAG AGGGACTGCACACGCTTCGAGCTAGCATCGCATATACGT ACTGCAGTCATGCTAG | 206482 |
| 203078 | 5825C-R9-S3-5'DIG | /5DIG/CTAGCATGACTGCAGTACGTTCCGGAGTCCATA AGACTACGGATAGCTTTGACCGCTGTCTCTTATACACAT CTGACGCTGCCGACGA | 206483 |
| | 5825C-R9-S3-RC-5'DIG | /5DIG/TCGTCGGCAGCGTCAGATGTGTATAAGAGACAG TATCTACACTTTTGTTTCCGAAACGCGATGTGCATGACG TACTGCAGTCATGCTAG | 206484 |
| 203079 | 5825C-R9-S4-5'DIG | /5DIG/CTAGCATGACTGCAGTACGTCATGCACATCGCG TTTCGGAAACAAAAGTGTAGATACTGTCTCTTATACACA TCTGACGCTGCCGACGA | 206485 |
| | 5825C-R9-S4-RC-5'DIG | /5DIG/TCGTCGGCAGCGTCAGATGTGTATAAGAGACAG AGTGTATGAGGAATCCGAGGTCACACGTCGTGTGGACGT ACTGCAGTCATGCTAG | 206486 |
| 203080 | 5825C-R9-S5-5'DIG | /5DIG/CTAGCATGACTGCAGTACGTCCACACGACGTGT GACCTCGGATTCCTCATACACTCTGTCTCTTATACACAT CTGACGCTGCCGACGA | 206487 |
| | 5825C-R9-S5-RC-5'DIG | /5DIG/TCGTCGGCAGCGTCAGATGTGTATAAGAGACAG CTTTTACTGGCAAACTAGTGTAATTGCGAGCTGGACACG TACTGCAGTCATGCTAG | 206488 |
| 203081 | 5825C-R9-S6-5'DIG | /5DIG/CTAGCATGACTGCAGTACGTACTGGGTACTTGA ATCATTGTCGCATTTCCCTATTCTGTCTCTTATACACAT CTGACGCTGCCGACGA | 206489 |
| | 5825C-R9-S6-RC-5'DIG | /5DIG/TCGTCGGCAGCGTCAGATGTGTATAAGAGACAG CGGTCAAAGCTATCCGTAGTCTTATGGACTCCGGAACGT ACTGCAGTCATGCTAG | 206490 |

Example 25: Background Optimization and Automation

In this Example, we optimized fixed tissue staining with oligonucleotide probe libraries as in the experiments described in the Examples above. For example, such optimization was performed to reduce non-specific background staining with enriched oligonucleotide probe libraries when using polyligand histochemistry (PHC). Certain conditions were found to address non-specific background staining. Certain changes in the staining protocols are shown in Table 41. The "New" and "New+" improved protocols were optimized and automated using the Ventana Discovery platform. In the table, BA refers to BlockAid Blocking Solution (Thermo Fisher Scientific), and PBS refers to phosphate buffered saline. As seen from the table, the blocking conditions are more stringent in the New and New+ protocols.

TABLE 41

| | Original Protocol | New Protocol | New+ Protocol |
|---|---|---|---|
| Background optimization conditions | | | |
| Permeabilization | No | Yes (0.1% Triton-100 for 10 mins) | Yes (0.1% Triton-100 for 10 mins) |
| Deparaffinization | 69° C. for 32 mins | 69° C. for 32 mins | 69° C. for 32 mins |
| Antigen Retrieval | 95° C. for 32 mins | 95° C. for 32 mins | 95° C. for 32 mins |
| Library cocktail | 10% BA (no Triton) | 25% BA (0.01% Triton) | 25% BA (0.01% Triton) |
| Rinses | 1 rinse | 4 rinses | 4 rinses |
| Str-HRP + MgCl$_2$ | In PBS | In PBS | In 25% BA |

The complete protocol is as follows. Examples of staining various tissues will follow. Reagents are shown in Table 42. The equipment is a Ventana Discovery Autostainer.

TABLE 42

| Reagent | Vendor | cat # |
|---|---|---|
| Raw Materials | | |
| Salmon DNA | Life Tech | 15632-011 |
| tRNA | Life Tech | AM7119 |
| BlockAid | Life Tech | B10710 |
| Streptavidin Poly-HRP | Life Tech | 21140 |
| MgCl2 | Affymetrix | 78641 |
| Hyclone PBS | V.W.R. International | SH30256.01 |
| Sigma PBS Packet | Sigma-Aldrich | P3813 |
| H2O | Sigma-Aldrich | W4502 |
| Molecular Grade Water | Life Tech | 10977-015 |
| DAB Buffer | Dako | SM803 |

TABLE 43

| Reagent | Stock Concentration | Cocktail Concentration | Volume from stock, ul | Final Concentration |
|---|---|---|---|---|
| SA-poly HRP cocktail | | | | |
| H2O | — | — | 0.00 | |
| SA-poly HRP, x | 250 | 4 | 384.0 | 1.00 |
| PBS, x | 20 | 4 | 4800.0 | 1.00 |
| MgCl2, mM | 1000 | 12 | 288.0 | 3.00 |
| BlockAid, % | 100 | 77.2 | 18528.0 | 19.30 |

The biotinylated oligonucleotide probe library is mixed with MgCl$_2$ prior to addition to the Competitor/Block master mix shown in Table 44:

TABLE 44

| Reagent | Stock Concentration | Intermediate stock (in H20) | Cocktail Concentration | Volume of stock to make cocktail, ul | Final Concentration |
|---|---|---|---|---|---|
| Block/Aptamer master mix | | | | | |
| H$_2$O | | | | 72.5 | |
| Triton, % | 100 | 1 | 0.03 | 14.2 | 0.01 |
| Salmon DNA, ng/ul | — | 300 | 1.96 | 3.1 | 0.65 |
| tRNA, ng/μl | — | 300 | 1.96 | 3.1 | 0.65 |
| BlockAid, % | 100 | — | 75.00 | 354.4 | 25.00 |
| MgCl$_2$, mM | 1000 | — | 9.00 | 4.3 | 3.00 |
| PBS, x | 20 | — | 0.00 | 0.0 | 0.00 |
| Oligo library ng/μl | 15 | — | 0.67 | 21.0 | 0.22 |

Reagent Preparation

1 Step 1: Permeabilization of all slides immediately prior to epitope retrieval. Completely immerse slides in 0.1% Triton X 100 in 1×PBS, incubate for 10 mins at room temperature (RT).

Step 2: Wash the slide by dipping 10× in 750 mL 1×PBS (1 Liter copling jar).

Step 3: Prepare Competitor/Block/Aptamer Library cocktail. In Table 43, the SA-poly HRP cocktail is shown. SA-poly HRP refers to Streptavidin Poly-HRP conjugate, which is biotin-binding protein conjugated with polymers of horseradish peroxidase that enables signal amplification and detection of biotinylated binding agents (e.g., antibodies or aptamers) for IHC and other methods.

Staining

Step 4: Aptohistochemistry on Ventana Discovery autostainer

Deparaffinization and Epitope Retrieval

All Slides: Apply corresponding block/aptamer solution 150 μl (Table 44), incubate for 1 h @ RT (300 μl of Running buffer will be added automatically)

All Slides: Apply 100 μl of SA-HRP+MgCl$_2$+19% BA SA-poly HRP cocktail (Table 43)

Apply DAB buffer

Apply Hematoxylin

Post Staining

Step 5: Pour off liquid coverslip and use paper towel to wick off residual oil from edge of glass.

Step 6: Standard coverslipping.

Step 7: Score slide staining.

Tissue Staining

Figure 19A:
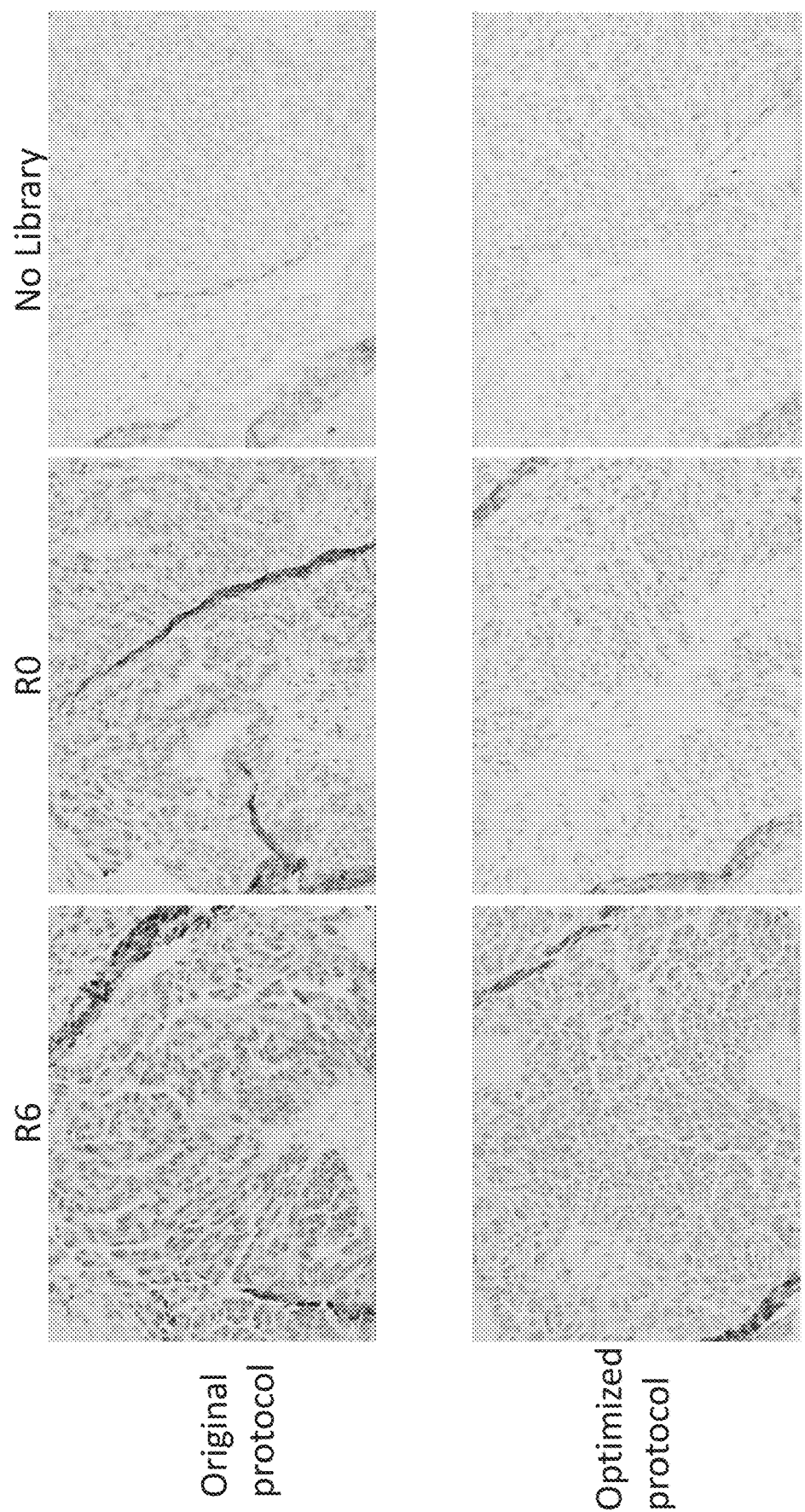
FIGS. 19A-K show background optimization of oligonucleotide probe staining of fixed tissue samples.
Figure 19B:
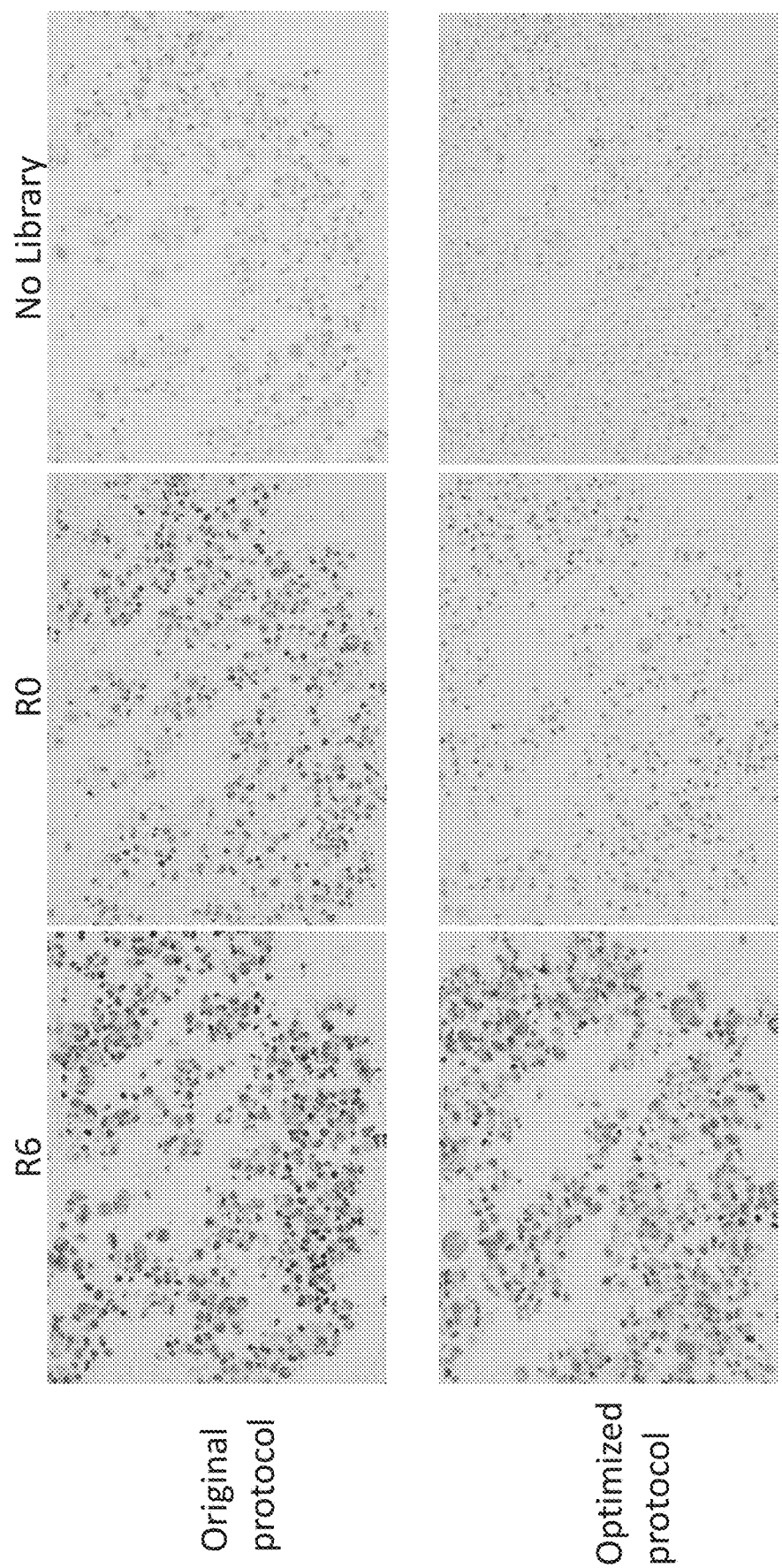
Figure 19C:
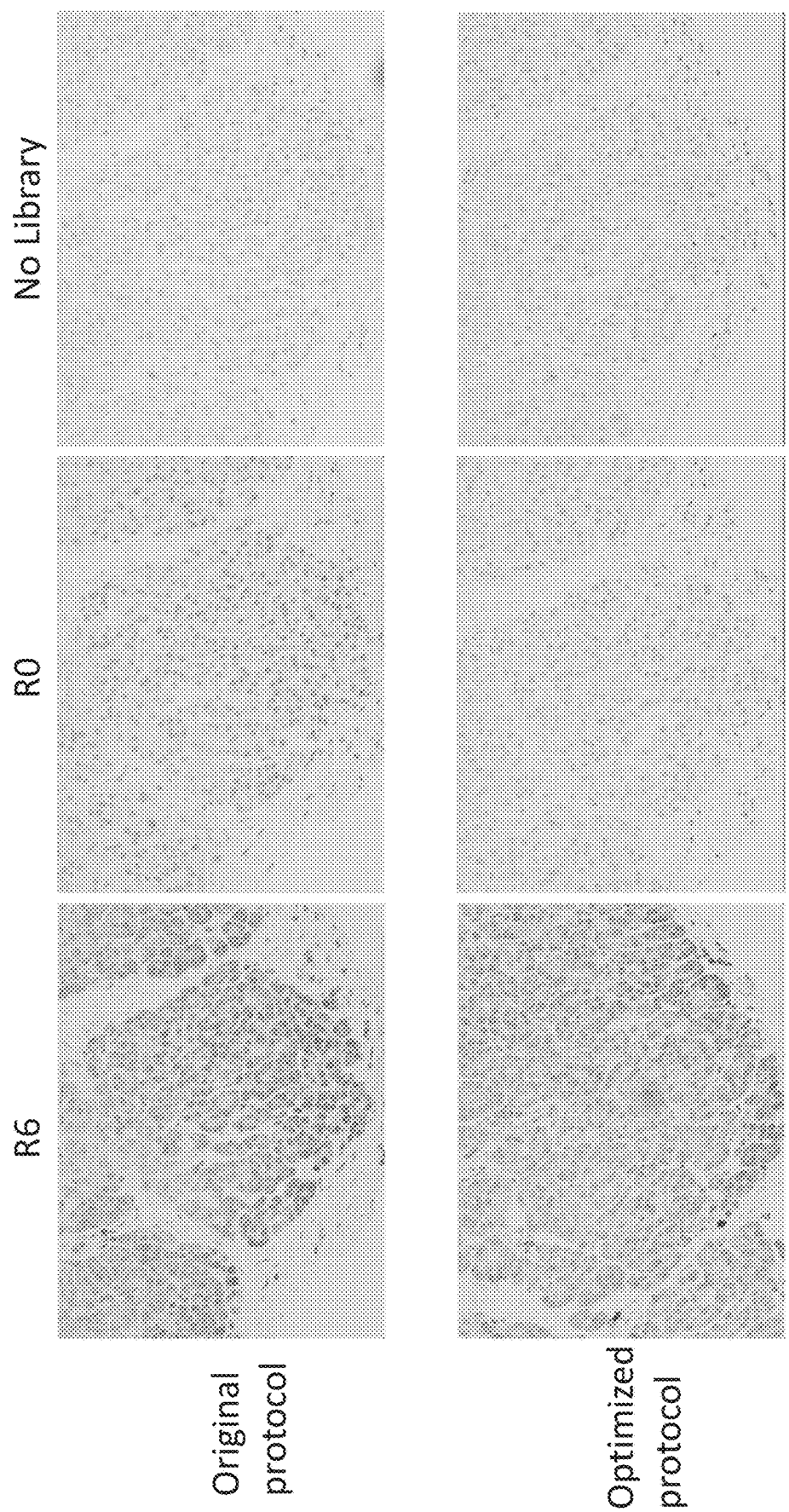
Figure 19D:
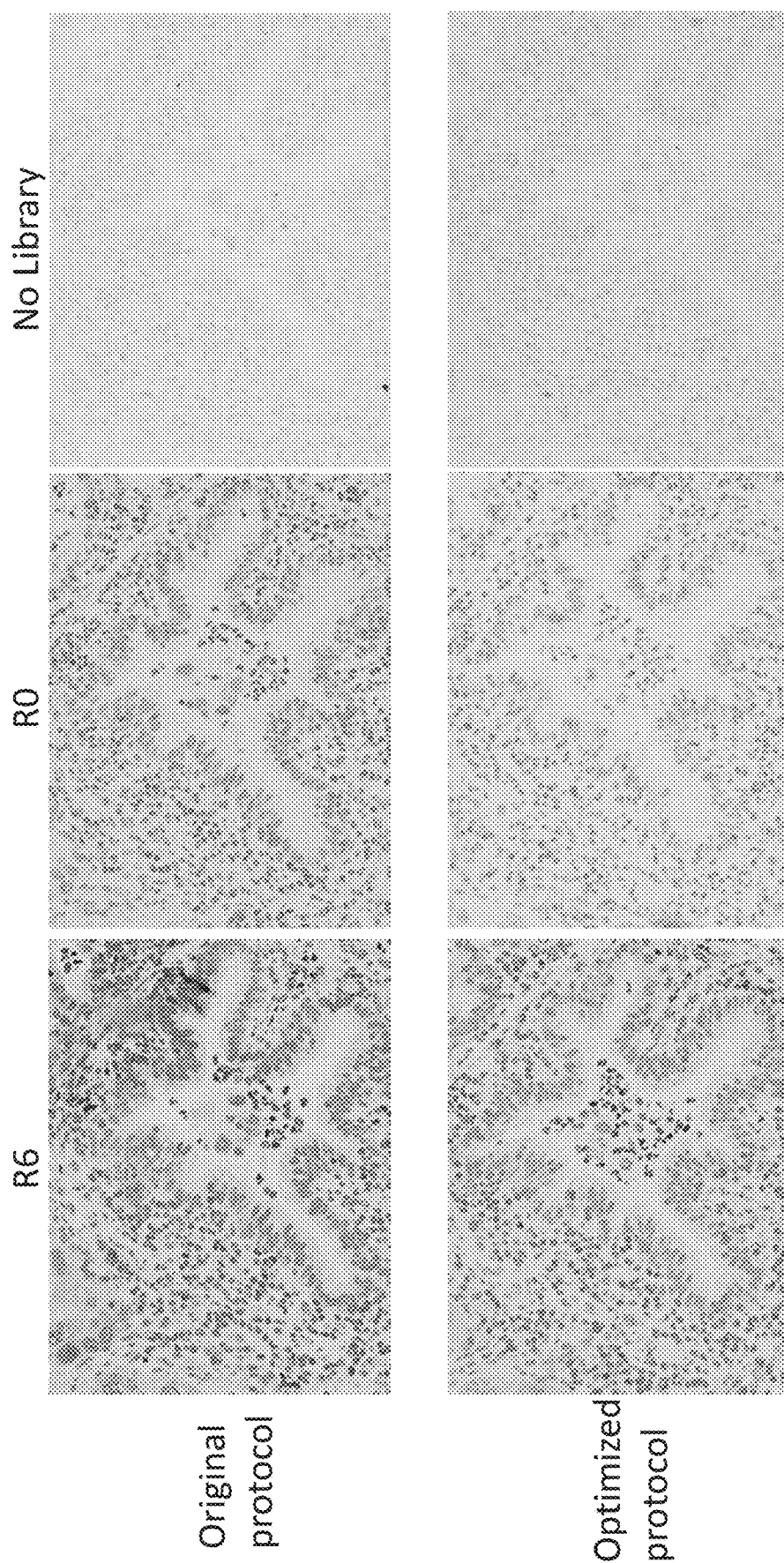
Figure 19E:
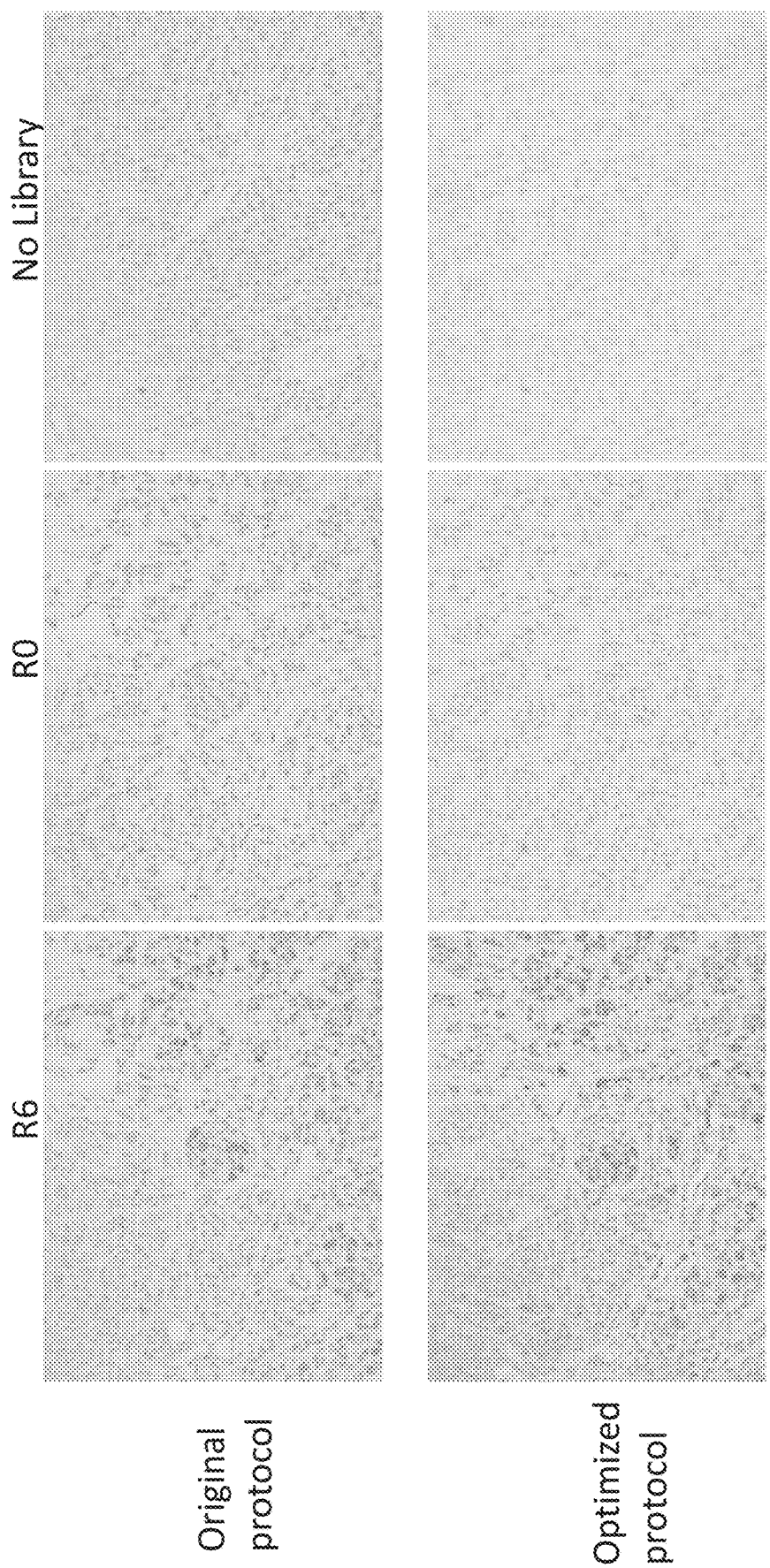
Figure 19F:
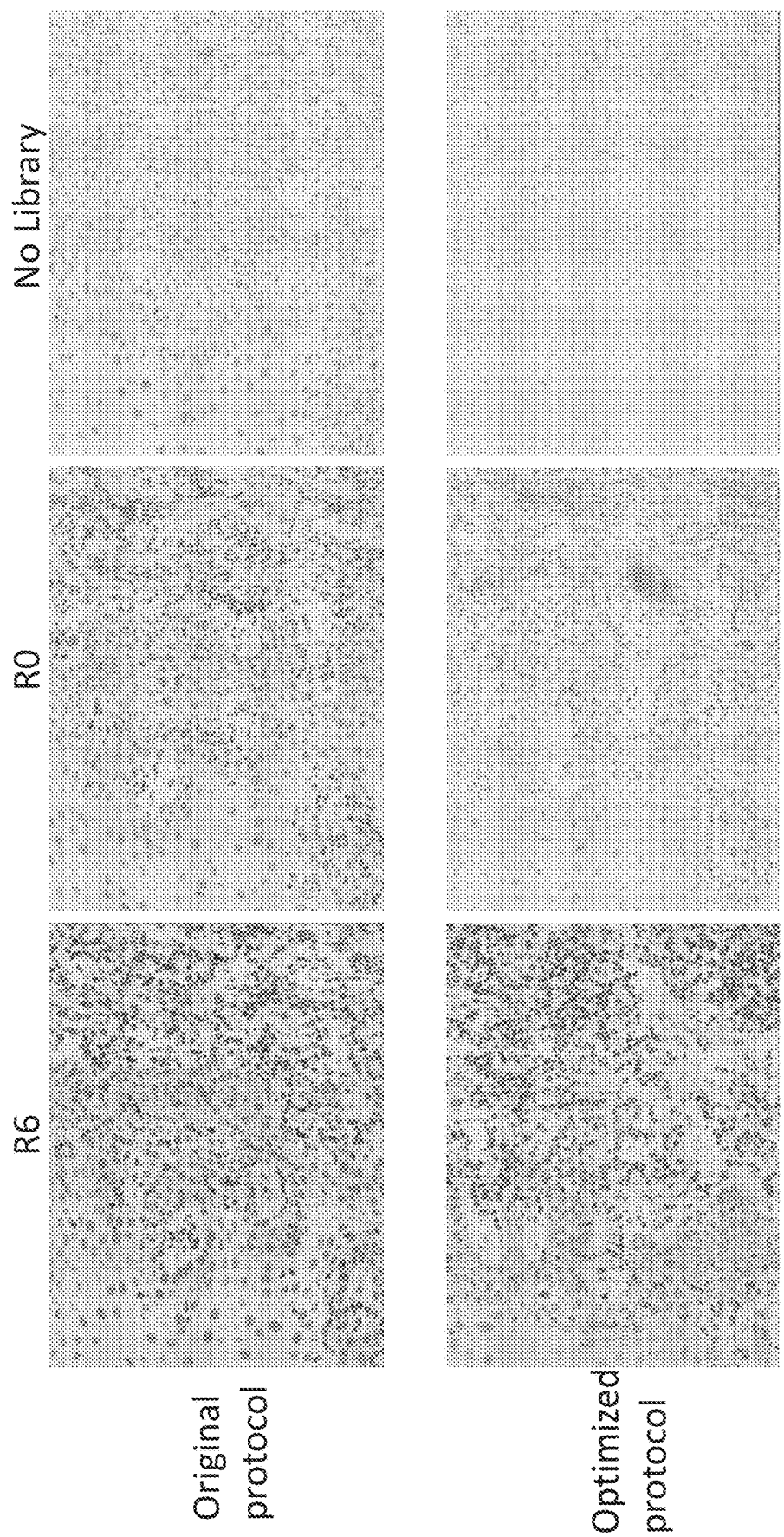
Figure 19G:
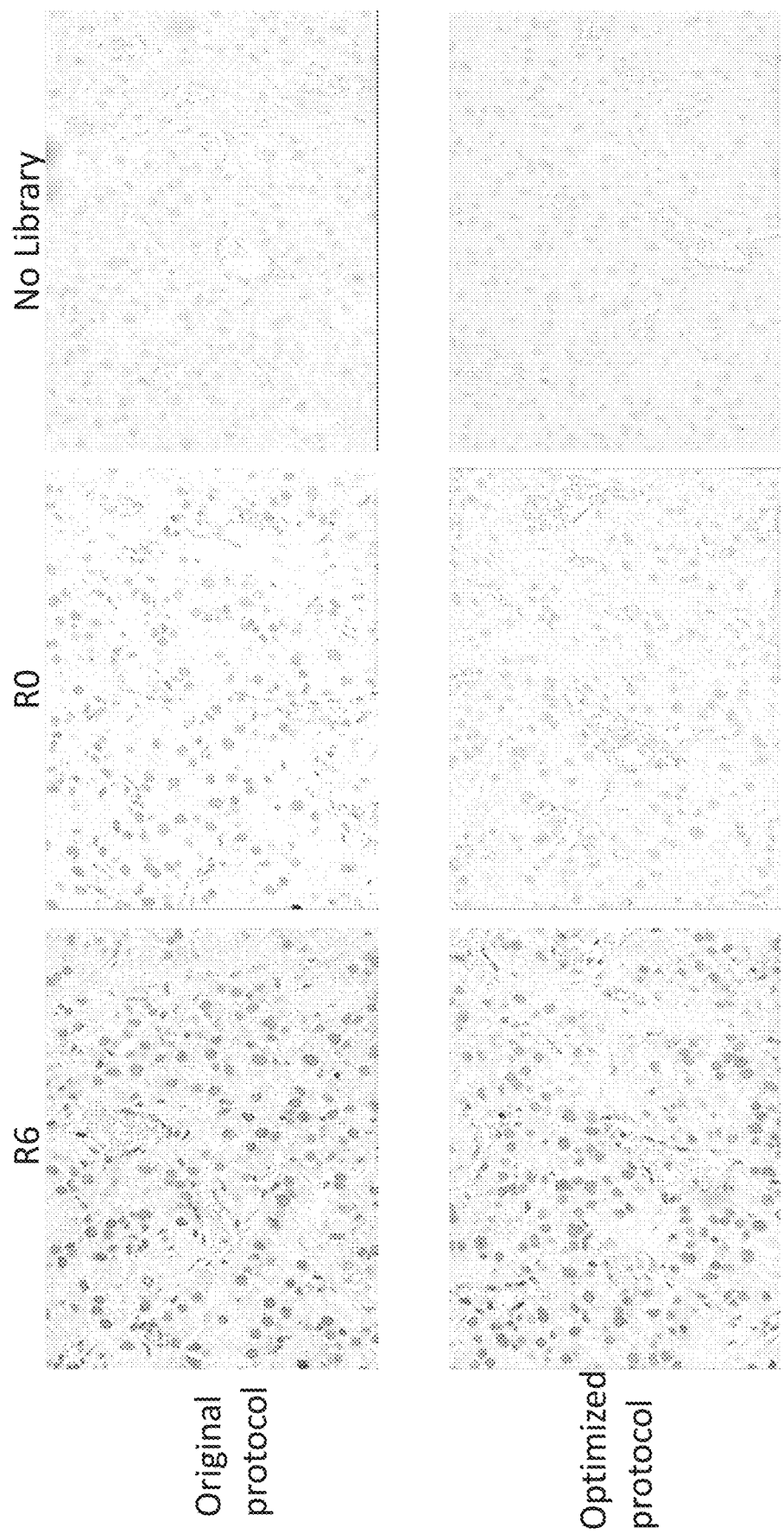
Figure 19H:
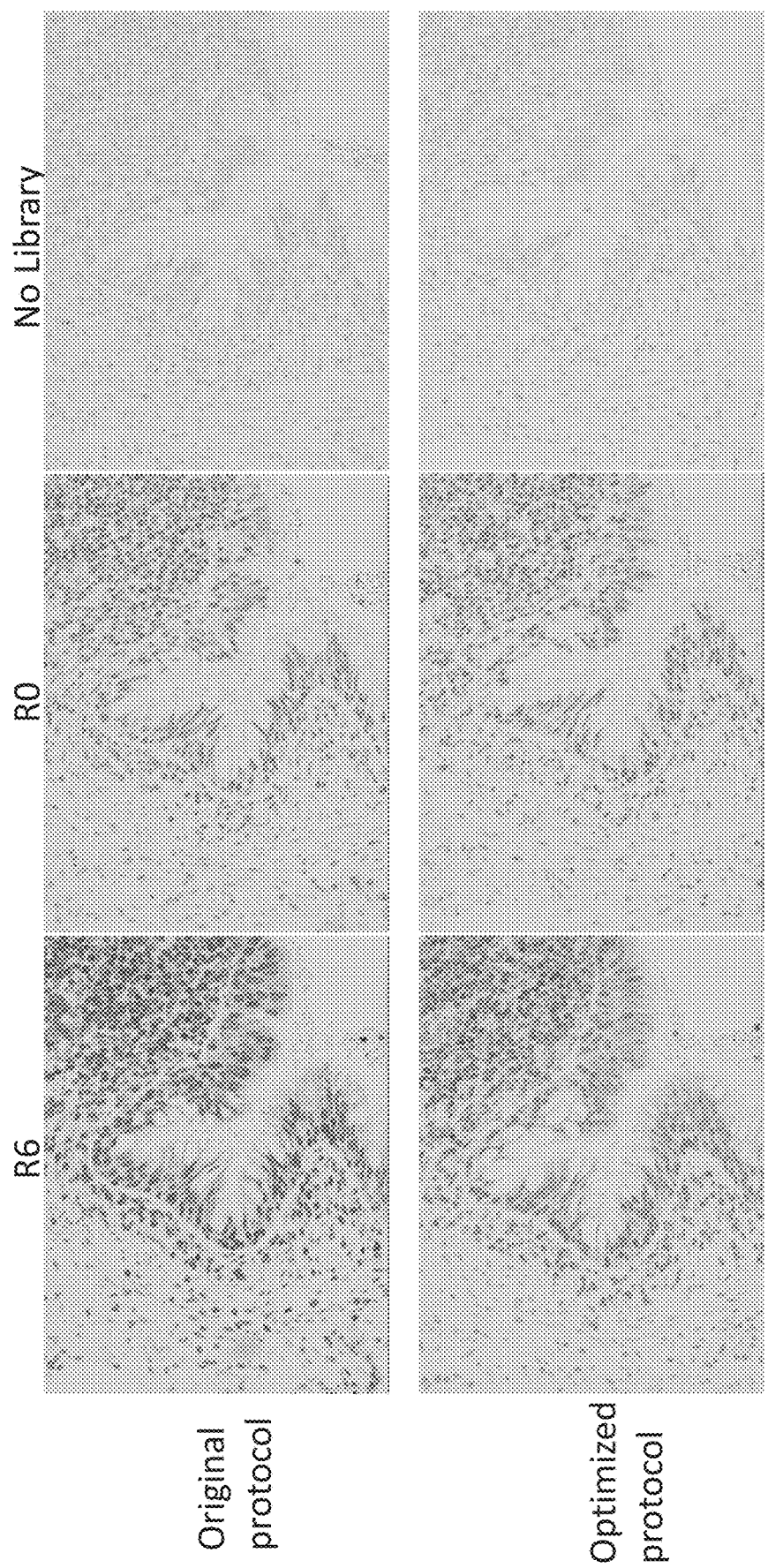
Figure 19I:
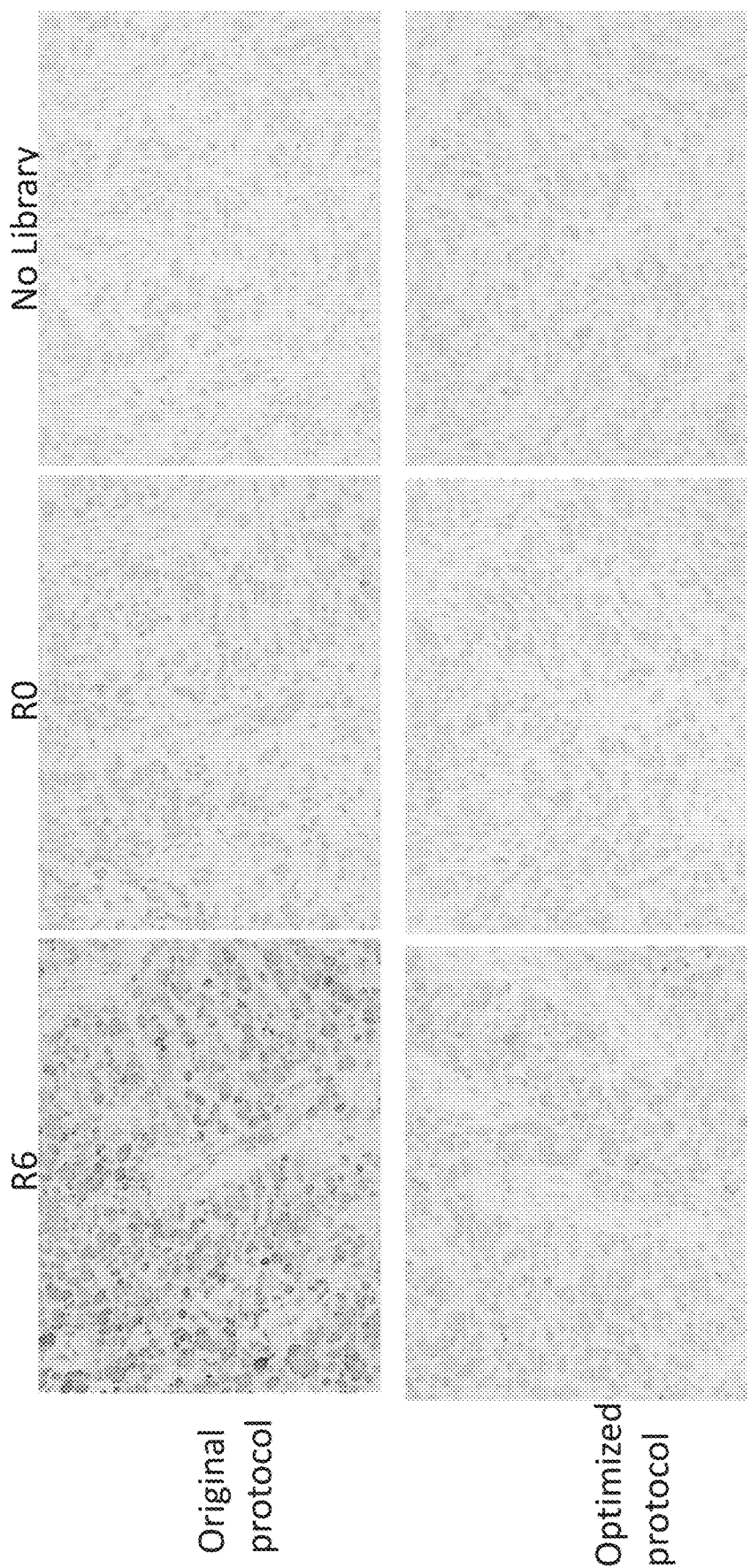
Figure 19J:
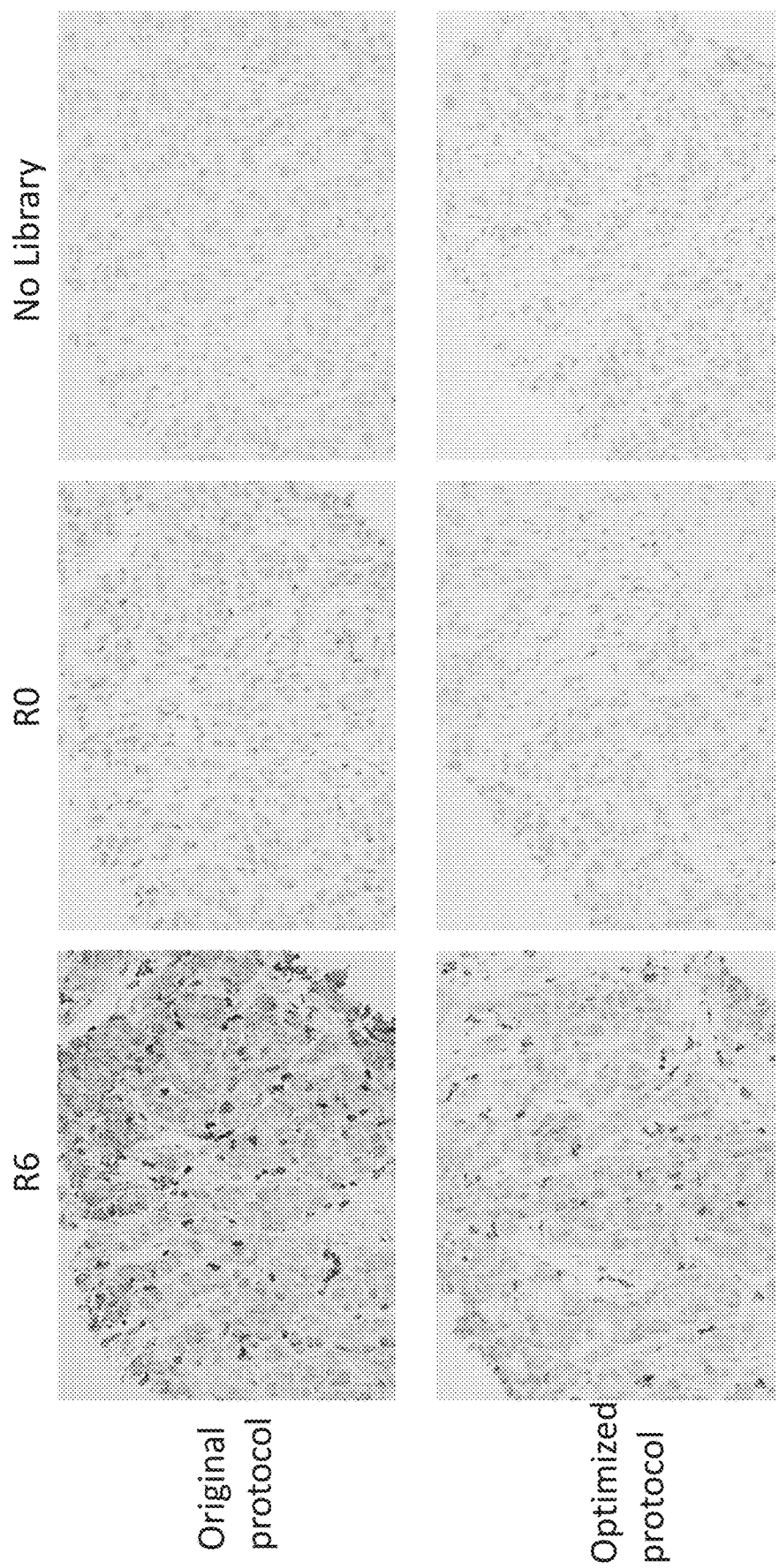
Figure 19K:
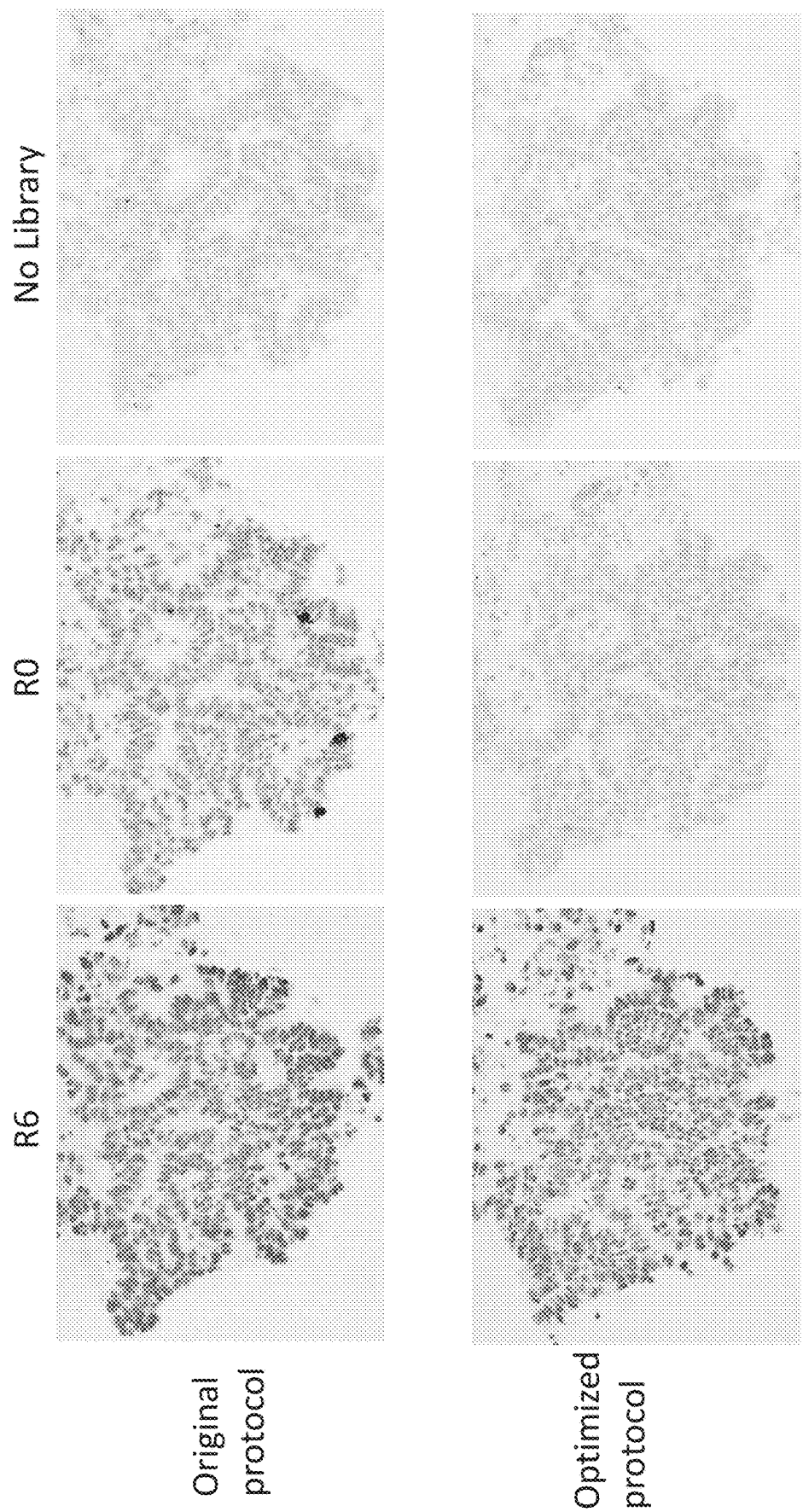

The protocol above was used to stain fixed tissues from various anatomical locales, including tumor samples from ovarian, breast, pancreatic, bladder, melanoma, head & neck, kidney, non-small cell lung (NSCLC), glioblastoma (GBM), hepatocellular carcinoma (HCC) and colon origin. The oligonucleotide probe library used was the R6 library from HER2+ breast tissue enrichment in Example 19. The unenriched library (R0) was used as a control. Accordingly, the probe library was not optimized for each tissue but nonetheless provided discernible staining in various tissues as shown in FIGS. 19A-K. The figures show H&E stained slides with the original protocol and the optimized protocol presented in this Example. FIG. 19A shows results for ovarian cancer samples. The darkest staining of all samples was observed with the original protocol, though discernible brown stain was observed in the No Library sample that was absent any oligonucleotide probes. With the optimized library, staining was most evident with R6 and no brown staining was observed in the No Library sample. Without being bound by theory, the staining observed in the absence of probe library with the original protocol may be derived from non-specific binding of the SA-HRP, or in some cases due to endogenous biotin. Qualitatively similar results were observed with breast cancer tissue (FIG. 19B), pancreatic cancer tissue (FIG. 19C), bladder cancer tissue (FIG. 19D), melanoma tissue (FIG. 19E), head and neck cancer tissue (FIG. 19F), kidney cancer cancer tissue (FIG. 19G), NSCLC tissue (FIG. 19H), GBM tissue (FIG. 19I), HCC tissue (FIG. 19J), and colon cancer tissue (FIG. 19K). With melanoma and GBM tissues, slight staining was observed in the optimized no library samples, but this staining was nonetheless noticeably reduced as compared to the original no library samples. With the NCSLC and colon tissues, little staining was observed in the no library samples under either set of conditions.

Example 26: Oligonucleotide Probe Enrichment on TUBB3+ Pancreatic Cancer Tissue

In this Example, we used the FFPE tissue enrichment protocol developed in the Examples above (see, e.g., Examples 21-22 and 25) to enrich a naïve oligonucleotide probe library against TUBB3+ pancreatic cancer tissue samples.

Figure 20B:
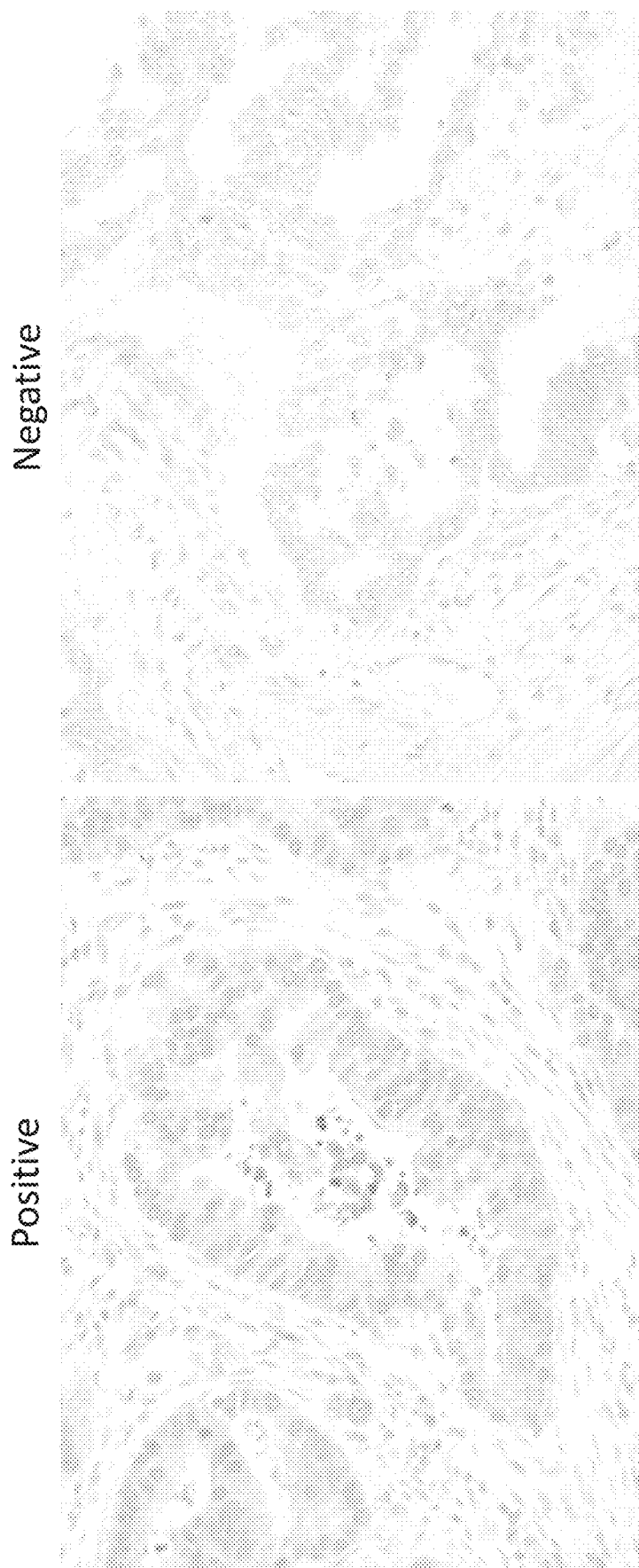

The random ssDNA library (naïve F-TRin-35n-B 8-3s library) contains 35 random nucleotides flanked by constant regions. Specifically, the naïve library comprises a 5' region (5' CTAGCATGACTGCAGTACGT (SEQ ID NO. 4)) followed by a random naïve oligonucleotide sequence of 35 nucleotides and a 3' region (5' CTGTCTCTTATACACATCTGACGCTGCCGACGA (SEQ ID NO. 5)). The samples were pancreatic FFPE tissue samples with TUBB3 status confirmed by conventional IHC. Seven rounds of enrichment were performed. We initially performed enrichment with the full protocol from Example 25 but no enrichment was observed. Without being bound by theory, it is likely the optimized protocol in Example 25 is too stringent as it was optimized for probing and not enrichment. Thus, the optimized protocol was adapted for the enrichment process as shown in FIG. 20A. In this scheme, enrichment was performed according to the order P→P→P→(N→P)→(N→P)→(N→P)→P, where "P" ("Pos" in FIG. 20A) refers to positive selection against TUBB3+ samples and "N" ("Neg" in FIG. 20A) refers to negative selection against TUBB3− samples. The enrichment was performed with low stringency in early rounds using the conditions as shown in FIG. 20A. For example, the figure shows that the concentration of detergent (Triton X100) and blocking agents (BlockAid) were increased in later rounds of enrichment. Further as indicated in the figure, staining as described in Example 25 was performed after later rounds of enrichment to observe the enrichment process. An example in shown in FIG. 20B, where much higher levels of brown stain are observed in the Positive sample as compared to the Negative sample.

Figure 20C:
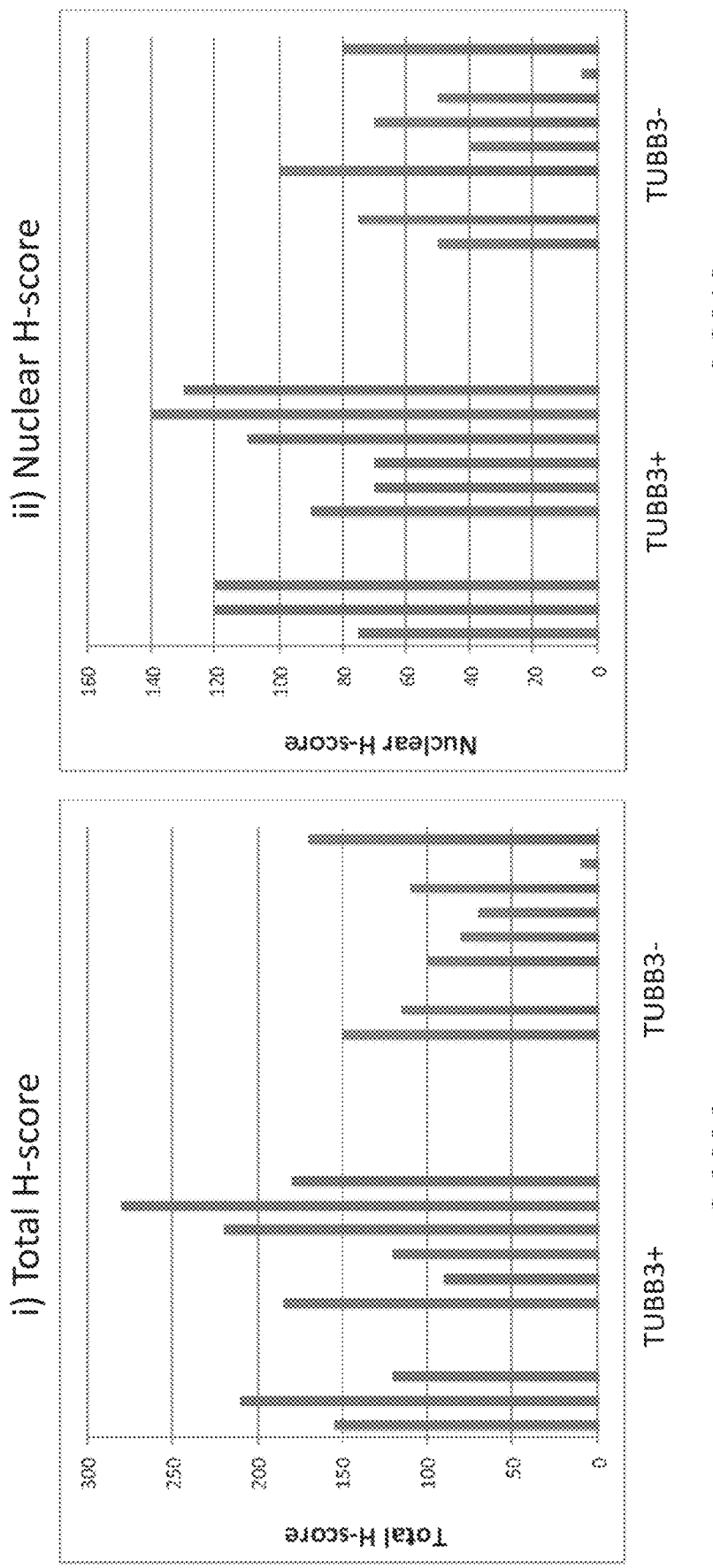

The final enriched library after seven rounds of enrichment is referred to as the TUBB3− R7 library. The TUBB3− R7 library was used to probe nine TUBB3+ and nine TUBB3− pancreatic cancer tissue slides that were not used in the enrichment process (i.e., non-enrichment cases). Staining intensity was determined by blinded pathologists. H-Scores (i.e., [1×(% cells 1+)+2×(% cells 2+)+3×(% cells 3+)]) were calculated based on the staining intensity for both overall slide staining and nuclear staining. Results are shown in FIG. 20C, which plots total (i) or nuclear (ii) H-score for the indicated groups of samples (i.e., TUBB3+ or TUBB3−). The p-values for the differences between the groups are indicated beneath each plot. The H-Scores were also used to generate ROC plots and calculate ROC AUC values, as shown in FIG. 20D. This figure provides plots for total (i) or nuclear (ii) ROC curves. The AUC value for total (i) was 0.843 and the AUC value for nuclear (ii) was 0.889. Thus, in both cases the TUBB3-R7 library had very high performance at differentiating TUBB3+ and TUBB3− pancreatic cancer tissue specimens.

In Example 19, we presented an oligonucleotide probe library that was able to distinguish HER2+ and HER2− breast cancer samples. Similarly, in this Example, we developed an oligonucleotide probe library that was able to distinguish TUBB3+ and TUBB3− pancreatic cancer samples.

Example 27: TTNT for Platinum/Taxane Treatment in Ovarian Cancer

In this Example, we used the FFPE tissue enrichment protocol as in Example 26 to enrich a naïve oligonucleotide probe library against ovarian cancer tissue samples that were considered as responders or non-responders to platinum/taxane treatment. Responder (benefit)/non-responder (non-benefit) status was determined using time-to-next-treatment (TENT) after platinum/taxane treatment, also known as drug free interval (DFI), as described in Examples 20-22. For this Example, non-responders were those with DFI<6 months and responders were those with DFI>6 months.

Figure 21B:
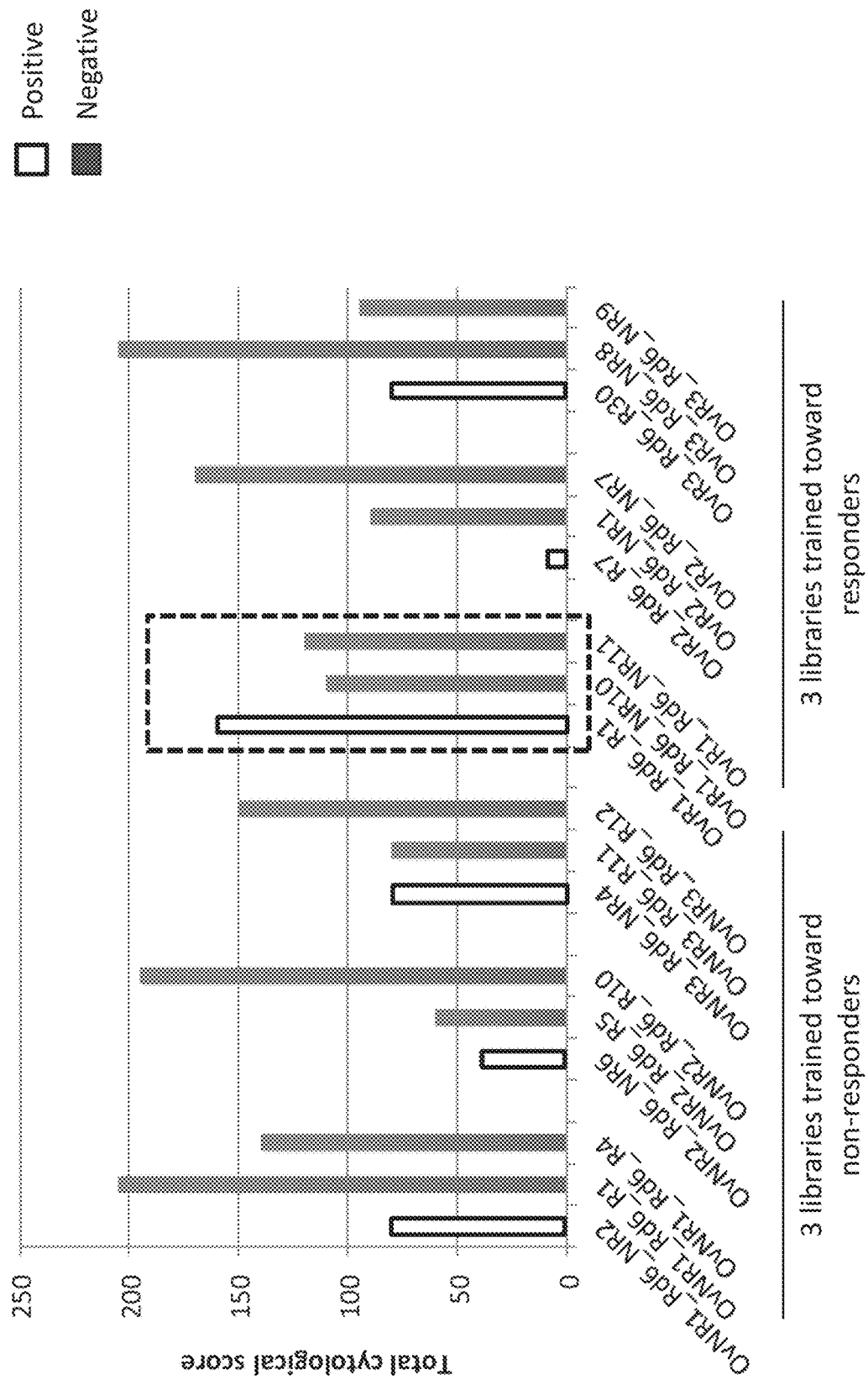

Methodology was similar to that in Example 26 with modifications described here. The enrichment process is outlined in FIG. 21A. Enrichment was performed according to the order P→P→P→(2N*→P)→(2N*→P)→(2N*→P, where "P" ("Pos" in FIG. 21A) refers to positive selection against responder tissue samples, "N" ("Neg" in FIG. 21A) refers to negative selection against non-responder tissue samples, and * indicates that two negative slides were used in parallel, the supernatants were pooled and the probes were purified with Streptavidin beads before PCR. The reverse process was also performed, wherein positive selection was against non-responder tissue samples and negative selection was against responder tissue samples. As in Example 26, more stringent conditions were used in later rounds of enrichment. See FIG. 21A for enrichment conditions. FIG. 21B shows examples of staining with six enriched libraries, three libraries trained toward non-responders and three trained toward responders, as indicated. The library in FIG. 21B showed the expected staining pattern with greater staining in the positive enrichment cases (here responders). This library will be used to probe non-enrichment ovarian cancer samples that benefit/respond or not from platinum/taxane treatment as described above.

Example 28: Detection of Oligonucleotide Probe Binding to Tissue Samples

Protocols similar to the Examples above were used to enrich the naïve F-TRin-35n-B 8-3s library against FFPE kidney tissue slides. The biotinylated library after 6 rounds of enrichment was used to probe fixed kidney tissue similar to Example 25. Slides were also probed with biotinylated unenriched F-TRin-35n-B 8-3s library as a control. The oligonucleotide probe binding was visualized as above using Steptavidin-horse radish peroxidase (SA-HRP) (Life Technologies, cat #11207733910). Despite stringent probing conditions, notable levels of background staining seen with the unenriched library control. In this Example, we used an alternative staining protocol to visualize oligonucleotide probe binding to the kidney samples.

Without being bound by theory, we examined whether non-specific binding of SA-HRP to the samples could be responsible and developed an alternate visualization methodology. Biotin-avidin/streptavidin biological assays have many desirable characteristics such as well known methods and reagents, do not require antibodies due to the strong and specific biotin-avidin binding, and steptavidin beads are available for pull down experiments/immunoprecipitation. However, in some cases endogenous biotin in the tissue could lead to problematic background binding. In this Example, we tested a digoxigenin (DIG) modified oligonucleotide library with anti-DIG-HRP antibody detection. Unlike biotin, digoxigenin is a steroid found exclusively in the flowers and leaves of certain plants.

Figure 22A:
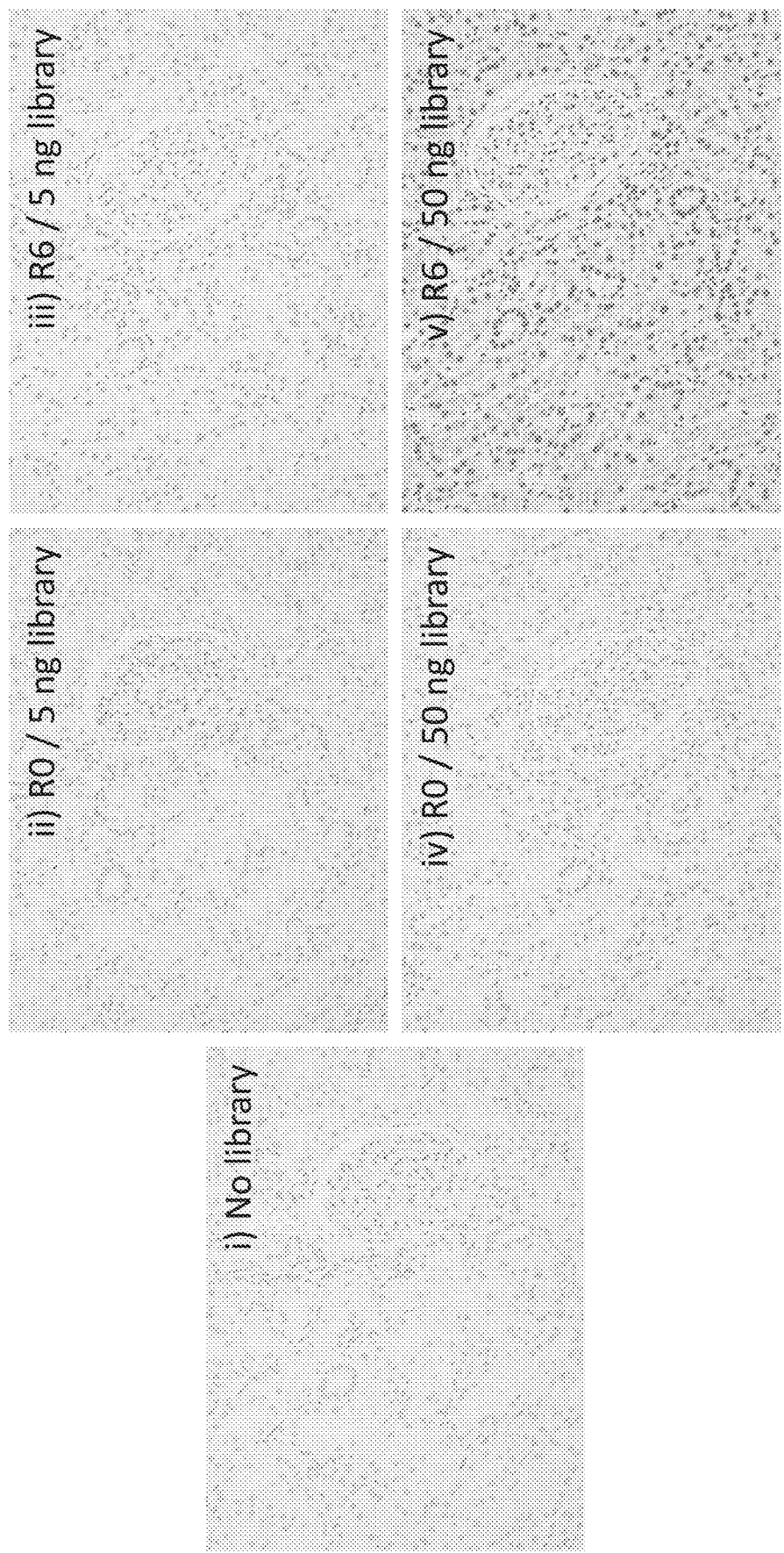
FIGS. 22A-B show enrichment and staining of an oligonucleotide probe library against kidney tissue anti-digoxigenin (DIG) antibody detection.

FIG. 22A show staining of kidney FFPE slides using the indicated DIG modified oligonucleotide libraries and anti-DIG-HRP antibody detection. FIG. 22Ai shows a no-library control, FIG. 22Aii shows staining with 5 ng of the unenriched (R0) library, FIG. 22Aiii shows staining with 5 ng of the round (R6) library, FIG. 22Aiv shows staining with 50 ng of the unenriched (R0) library, and FIG. 22Av shows staining with 50 ng of the round 6 (R6) library. All images were taken at a 20× magnification. In the figures, no brown staining was observed with no-library control (FIG. 22Ai) and 5 ng R0 samples (FIG. 22Aii). Only slight staining was observed with the 50 ng R0 samples (FIG. 22Aiv). More staining was observed with the 5 ng R6 samples (FIG. 22Aiii), and strong stain was observed when using 50 ng of the R6 library (FIG. 22Av). These data indicate that the DIG modified oligonucleotide libraries were effective at eliminating background staining observed with the biotin modified oligonucleotide libraries in the fixed kidney tissue samples used in this study.

Figure 22B:
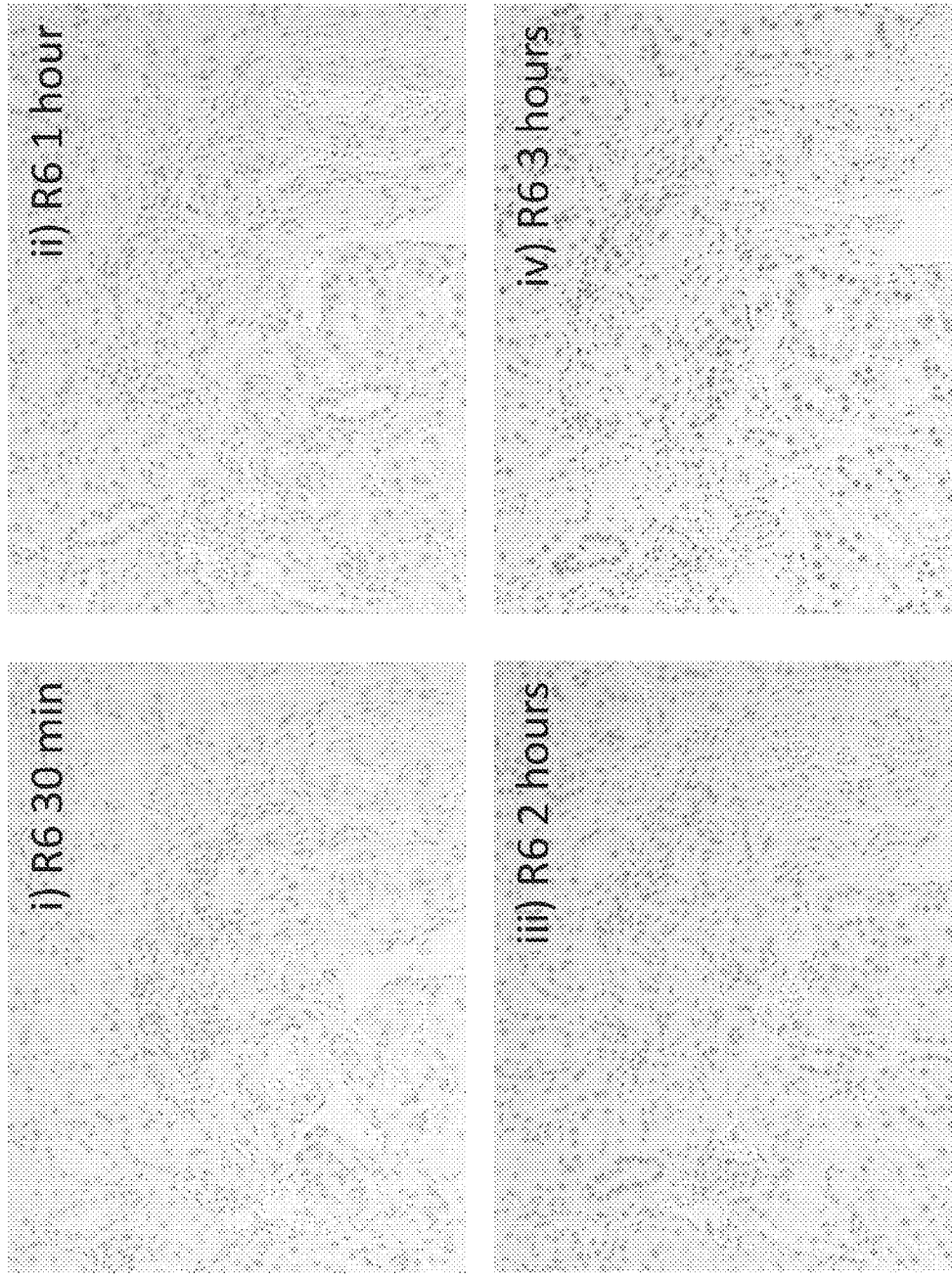

We also examined whether the incubation times during enrichment would influence the enrichment process. Four different enrichments were performed against kidney tissue wherein the library incubation time during enrichment was varied at 30 min, 1 h, 2 h, and 3 h. We then performed anti-DIG staining with 50 ng of libraries from six rounds of enrichment under each of the incubation conditions. We found that incubation time correlated with staining intensity: the longer the incubation time the stronger the staining. See FIG. 22B, which shows slides from six rounds of enrichment with incubation times of 30 min (FIG. 22Bi), 1 h (FIG. 22Bii), 2 h (FIG. 22Biii), and 3 h (FIG. 22Biv).

Example 29: On-Slide Oligonucleotide Probe Enrichment Against FFPE Tissue Lysate In certain instances, such as in the experiments described above in Examples 19-28, paraffin blocks comprising tumor samples, or multiple slides comprising sections from such blocks are available. In such cases, multiple slides from a single sample, including without limitation multiple sections from a tumor, can be used for oligonucleotide probe library enrichment and/or probing. In this Example, we developed a method for on-slide oligonucleotide probe enrichment against FFPE tissue lysate. Lysates from FFPE tissue slides were arrayed onto nitrocellulose film slides for enrichment and analysis. Such alternate methods may prove beneficial in certain cases, e.g., where limited samples are available, such as a single FFPE tissue slide per patient or tumor sample.

Figure 23A:
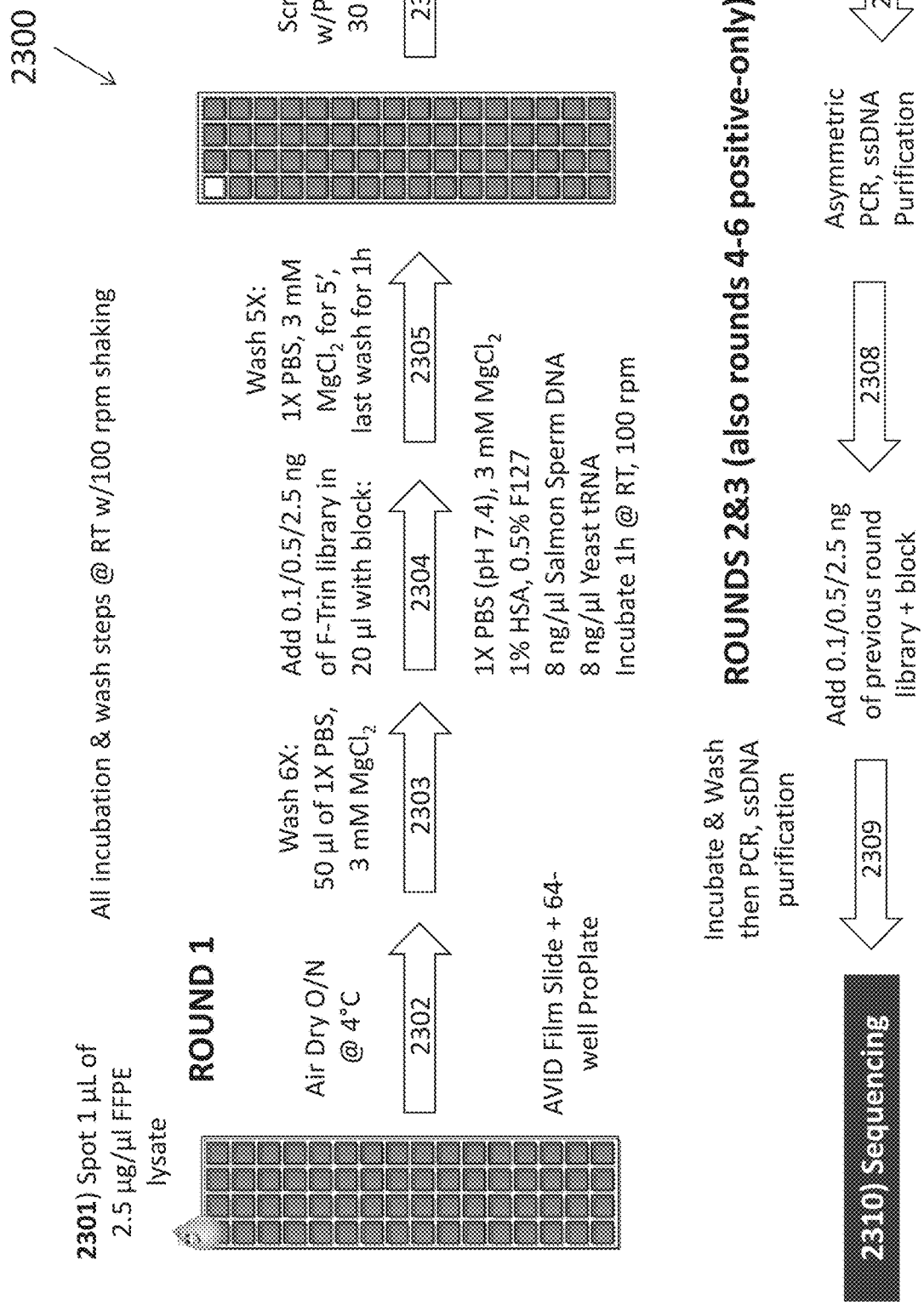

Methodology 2300 is outlined in FIG. 23A. As shown, 1 µL of 2.5 µg/l FFPE lysate is arrayed onto nitrocellulose film slides (AVID Film Slide+64-well ProPlate; Grace Bio-Labs, Bend, Oreg.) 2301. The slides are air dried overnight (O/N) at 4° C. 2302. The slides are washed six times in wash buffer comprising 50 µl of 1×PBS, 3 mM $MgCl_2$ 2303. The naïve F-Trin library as described herein is added in various concentrations (0.1/0.5/2.5 ng) to certain wells in 20 µl with blocking buffer comprising 1×PBS (pH 7.4), 3 mM $MgCl_2$, 1% HSA, 0.5% F127, 8 ng/µl Salmon Sperm DNA and 8 ng/µl Yeast tRNA 2304. The library is incubated on the film slides for 1 hour at room temperature (RT) with shaking at 100 rpm. After incubation, the film slides are washed five times with wash buffer 2305. The wells of the film slides are scraped with a pipet tip and transferred to 30 µl $H_2O$ 2306. Oligonucleotides recovered in the scraping are amplified by asymmetric PCR as described herein and single stranded oligonucleotide probes (ssDNA) are purified 2307. For the desired number of rounds of enrichment, 0.1/0.5/2.5 ng of the previous round's enriched library in blocking solution is added to fresh film slides 2308. After incubation, the oligonucleotide probes that bound to the sample are recovered and amplified as in round 1 2309. The recovered library was sequenced using next-generation sequencing 2310 after round 3.

The above procedure was performed on film slides arrayed with lysates from FFPE tissue slides from human subjects with various anatomical origins, including breast, colon, kidney, lung and pancreas. After three rounds of enrichment, the "Rd3" libraries were sequenced as described above 2310. In all cases, the largest number of sequences was observed in the samples incubated with 0.1 ng of oligonucleotide library.

Three more rounds of enrichment were performed as above with breast & pancreas FFPE lysates. In one set of enrichments, the methodology 2300 was as above. The library resulting from six rounds of positive selection on lysate from breast tissue is referred to as the Br_Rd6_Lib. In a next set of enrichments, the methodology 2300 was as above with addition of a competitor tissue lysate during incubation 2304. For this step in rounds 4-6, we added 0.1/0.5/2.5 ng of the 0.1 ng Rd3 library from a different tissue's enrichment in 80 µl of blocking buffer. For example, the Rd3 library from the breast lysate enrichments was incubated with breast and pancreatic lysates at the same time. The sequences bound to the breast lysate were retained, while sequences bound to pancreatic lysate were discarded. The library resulting from six rounds of positive selection on lysate from breast tissue wherein the last three rounds of enrichment included competition with lysates from pancreas tissue is referred to as the Br_Rd6+_Lib.

Figure 23B:
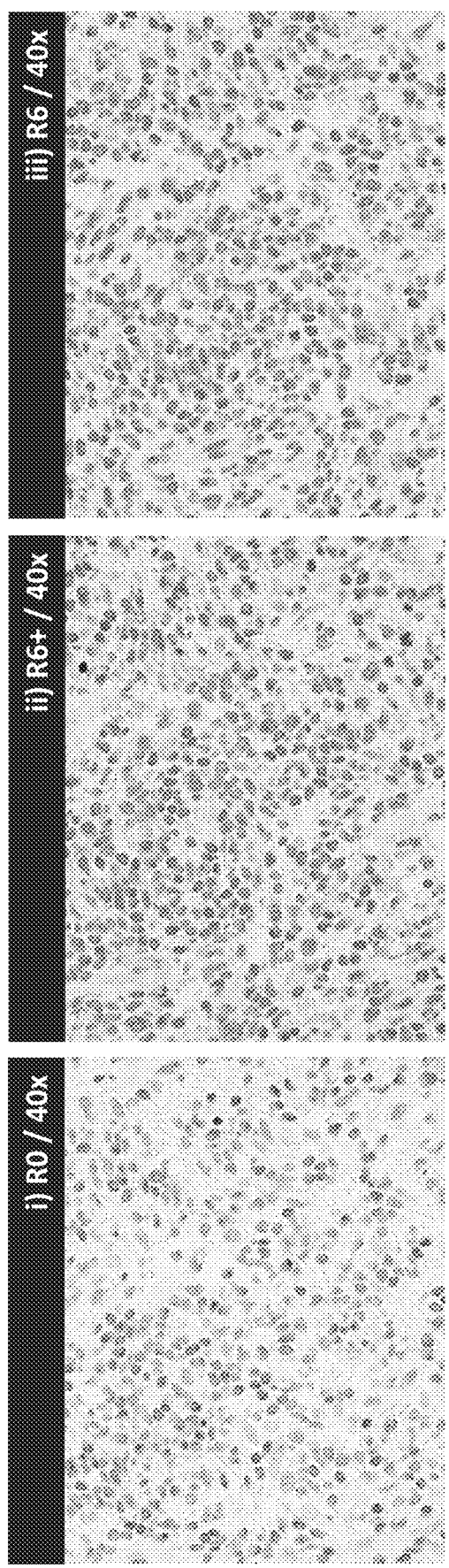

After enrichment, we used the Br_Rd6_Lib and Br_Rd6+_ Lib as well as starting naïve F-TRin library (i.e., Rd0) to stain normal breast, colon, kidney and lung tissue slides. Slides were stained generally as described in Example 40 above using a SA-HRP system using 50 ng of library per slide. We observed higher level of staining when probing breast tissue with the Br_Rd6_Lib and Br_Rd6+_Lib oligonucleotide probe libraries than with the Rd0 naïve control. Representative results are shown in FIG. 23B. Some background staining was observed in the Rd0 slides (FIG. 23Bi) but much higher levels of staining with the Br_Rd6+_Lib (FIG. 23Bii) and Br_Rd6_Lib slides (FIG. 23Biii).

The above results demonstrated oligonucleotide probe library enrichment with selection on FFPE tissue lysate bound to film slides. We further showed that the enriched aptamers can stain FFPE tissue slides. See, e.g., FIG. 23B. This approach has utility if the amount of working material is limited and has the ability to perform competitive selection using the same library against multiple targets.

We next selected certain high abundance and high fold-change oligonucleotide aptamers from the Rd6_Lib and Br_Rd6+_Lib oligonucleotide probe libraries for use in on-slide staining of normal breast tissue. As controls for the staining experiments, we used oligonucleotides with complement sequences in the variable regions. The selected sequences were synthesized with 5'-biotin. Each group of sequences was pooled at a final concentration of 10 ng/μL. For example, eight probes with high abundance sequences selected from the Br_Rd6_Lib and Br_Rd6+_Lib library were combined in a single tube and the eight corresponding reverse complement oligonucleotides were pooled in a separate tube. We applied 25 ng, 50 ng or 100 ng of each oligonucleotide pools to the tissue slides for staining. Normal breast tissue slides from the same block as those used for lysate preparation were used for staining. Slides were pre-treated for 10 minutes in 0.1% Triton X-100 and rinsed in distilled $H_2O$. Epitope retrieval was performed at 96° C. for 45 minutes. The staining protocol is as described in this Example above uing a streptavidin-HRP system. The selected sequences are shown in Table 45. The table indicates the variable region of the identified sequences. The full length sequences comprised 5' region 5'-CTAGCATGACTGCAGTACGT (SEQ ID NO 4) and a 3' region 5'-CTGTCTCTTATACACATCTGACGCTGCCGACGA (SEQ ID NO 5) surrounding the variable region.

TABLE 45

Sequences Selected for Staining

| Criteria | Variable Sequence (5' -> 3') | SEQ ID NO |
|---|---|---|
| High Abundance (Br_Rd6_Lib and Br_Rd6+_Lib) | GGGGGCCCCTTTTGTTTTCTTTTTGTTATTTTTGC | 206491 |
| | GGCTTCCTGGGGGTTTTTGTAATTGTATTTTCTGTTGA | 206492 |
| | ACCCTTTAGGTGTTTTTTTTGGTTTTCATTTTTTA | 206493 |
| | TTCGCCGTTTTTGTTTTGTTGTCTTAGGTTACCTC | 206494 |
| High Abundance (Br_Rd6_Lib) | TGCTGGGTGGTTTGTTTTTTTATTTGGTGCATTCT | 206495 |
| | GCCGTGATTCATTTGAGGGTTCCTTGTTTGATTTTA | 206496 |
| | TTAGGTATGCCACGTGCCTAATTGGGGTTTTTGTTTGA | 206497 |
| | TGTCATCTCACCTAACCACACAACCTACTACCTCA | 206498 |
| High Fold-Difference (Br_Rd6_Lib and Br_Rd6+_Lib) | TTCAATCTACACTGGTATTTCGCCTCCTCGCTGGGTGA | 206499 |
| | GGTCCTCCGGCGCATATTCCTTACCGTAAATTATA | 206500 |
| | TTGTTTCCAACTCTTGAATTTCTTGGTACTTGTCCA | 206501 |
| | TGGACTCTCTCCTCTGCCTCTGTGATAGCGGTTTTTGA | 206502 |
| High Fold-Difference (Br_Rd6_Lib) | CTTGAATTCCCATGTCTCTCCTGCCCCCCTCACTA | 206503 |
| | TTCTGAGGCTCACCACTTTGCACAAACTTTTCACCGA | 206504 |
| | GGGTTTATTCTGCTTATCCTTTCGTTTTCTTGTTGA | 206505 |
| | ATGCCACCACTGATCGCTAAGTTACCCCAACTGTTTGA | 206506 |

We observed greater staining the higher the input of probes. Thus, probing with 100 ng of the oligonucleotide probes yielded the highest level staining, albeit with the highest levels of background staining. Representative results are shown in FIG. 23C and FIG. 23D (both are 20× magnifications). FIG. 23C shows results for probing with 100 ng pools of eight sequences selected by abundance (i.e., first eight sequences in Table 45), which shows the most staining intensity. FIG. 23D shows results for probing with 25 ng pools of eight sequences selected by high fold change (i.e., last eight sequences in Table 45), which shows lower staining intensity but also reduced background with the negative controls. In both figures, the left most panel (i) shows slides stained with these oligonucleotides wherein the right panel (ii) shows the staining with their reverse complements.

Example 30: Oligonucleotide Probe Enrichment on Scraped Tissue

As another alternate enrichment scheme, in this Example we performed oligonucleotide probe library enrichment in an Eppendorf tube on tissue scraped from an FFPE slide. As in Example 29, this approach may be beneficial in certain scenarios, including without limitation when limited tissue is available, such as a single FFPE slide.

We started with the naïve F-Trin library described herein. Positive selection was performed on colon cancer tissue samples with negative selection on non-cancer tissue from the same slide. Regions of cancer and non-cancer tissue were determined by a pathologist. Selected regions were scraped from the slide then placed in an Eppendorf tube. Three rounds of enrichment were performed with positive selection against cancer tissue. Five more rounds of enrichment were performed with positive selection against cancer tissue and negative selection on non-cancer tissue. In these experiments, separation of unbound library was performed by ultracentrifugation. For example, positive selection was performed by incubating the oligonucleotide probes with tumor tissue, and collecting oligonucleotides that co-precipitated with the tissue during ultracentrifugation. Similarly, negative selection was performed by incubating the oligonucleotide probes with non-cancer tissue, then collecting the supernatant after ultracentrifugation.

We used the library enriched after eight rounds (the "R8" library) to stain fixed tissue from four colon cancer cases used in the enrichment process. We used the unenriched library ("R0") as control. Staining was performed with the Ventana Discovery system as in Example 25 using 50 ng of library per slide with an SA-HRP system. We compared staining intensity on cancer and non-cancer regions from a single slide. See FIG. 24A. The figure shows staining with the R0 control library on cancer tissue (i), the R8 enriched library on cancer tissue (ii), the R0 control library on non-cancer tissue (iii), and the R8 enriched library on non-cancer tissue (iv). As shown in the figure, the strongest staining was observed on cancer tissue with enriched (round 8) library. Minimal staining was observed on non-cancer tissue with enriched (round 8) library. Finally, no staining was observed on any tissue with the unenriched (round 0) library. These results indicate the enrichment process was effective to generate an oligonucleotide probe library that can distinguish colon cancer tissue.

Figure 24B:
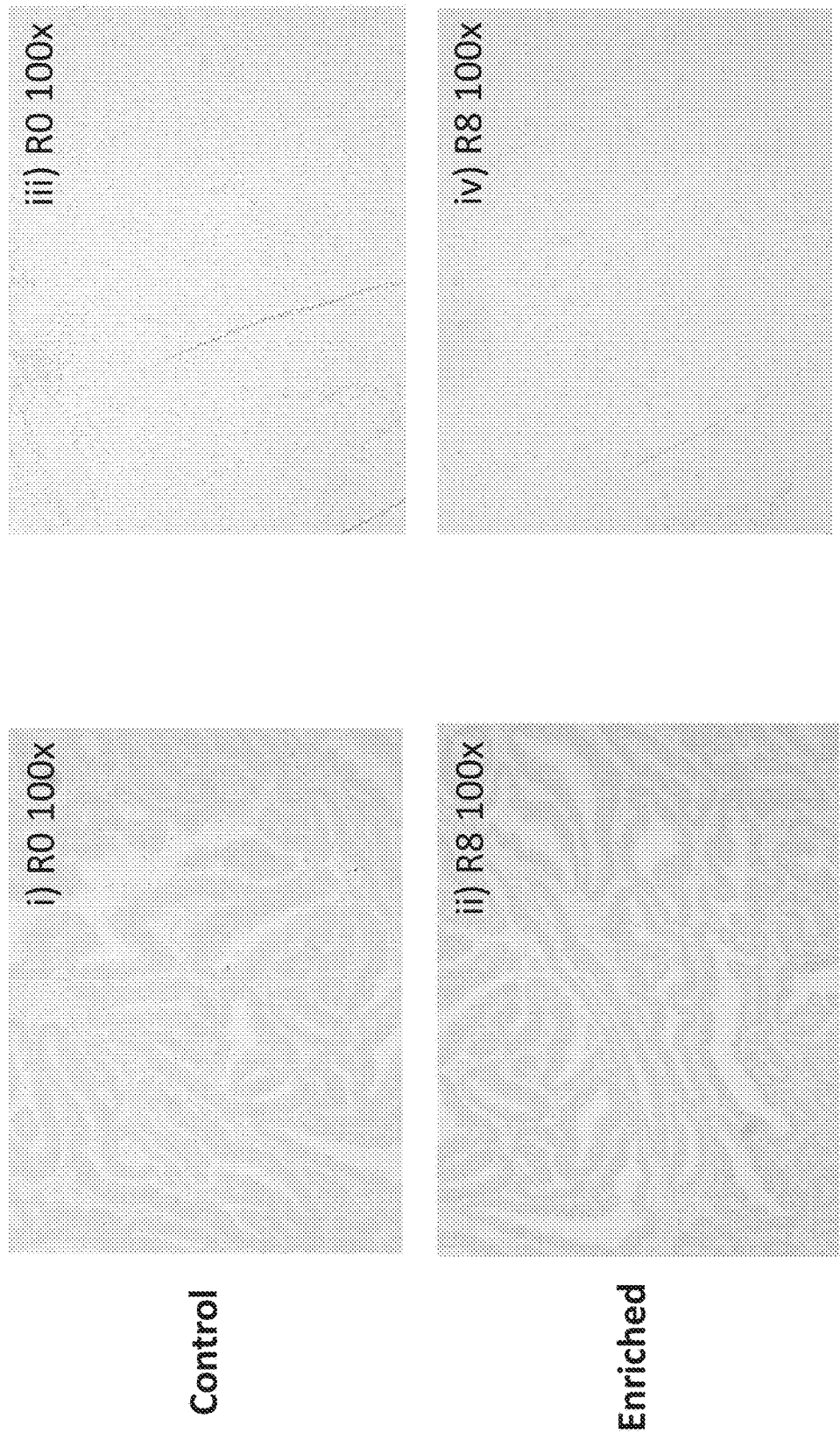

We also used the R8 library to stain fixed tissue from four colon cancer cases that were not used in the enrichment process. Representative results are shown in FIG. 24B. The figure shows staining with the R0 control library on cancer tissue (i), the R8 enriched library on cancer tissue (ii), the R0 control library on non-cancer tissue (iii), and the R8 enriched library on non-cancer tissue (iv). As shown in the figure, the strongest staining was observed on cancer tissue with enriched (round 8) library. For three cases we observed no staining on non-cancer tissue with the enriched (round 8) library, whereas one case showed slight staining. In addition, we observed no staining on any tissue with unenriched (round 0) library, whereas the same case that showed slight staining with the R8 library on non-cancer tissue also showed slight staining with the R0 library as well. These results indicate that the enriched oligonucleotide probe library can distinguish colon cancer tissue with high accuracy as we observed no false negatives and one potential false positive with this sample set.

Example 31: Oligonucleotide Probe Enrichment Using Microdissection

Laser capture microdissection (LCM), also called microdissection, laser microdissection (LMD), or laser-assisted microdissection (LMD or LAM), is a method for isolating specific cells of interest from microscopic regions of tissue/cells/organisms. In this Example, we used LCM as a method to extract tissue for oligonucleotide probe enrichment as described herein. The method comprises dissection on a microscopic scale with the help of a laser. LCM technology can harvest the cells of interest directly or can isolate specific cells by cutting away unwanted cells to give histologically pure enriched cell populations. A laser is coupled into a microscope and focuses onto the tissue on the slide. By movement of the laser an element is cut out and separated from the adjacent tissue.

An extraction process follows the cutting process. In one such method, a sticky surface is pressed onto the sample, which is then torn out. This extracts the desired region, but can also remove particles or unwanted tissue on the surface. In another method, a plastic membrane is melted onto the sample, which is then torn out. The membrane is heated with a laser to melt it to the sample. This method may also extract undesired debris. Extraction can also occur without contact. In one such approach, the sample is transported by laser pressure and gravity (gravity-assisted microdissection). In another approach, a cap coated with an adhesive is positioned directly on the thinly cut tissue section, the section itself resting on a thin membrane (e.g., polyethylene naphtalene). A laser gently heats the adhesive on the cap fusing it to the underlying tissue and another laser cuts through tissue and underlying membrane. The membrane-tissue entity now adheres to the cap and the cells on the cap can be used in downstream applications (DNA, RNA, protein analysis).

FFPE samples are commonly fixed to glass slides. We found that not all LCM methods are appropriate for oligonucleotide probe enrichment with such samples. For example, LCM after epitope retrieval but before addition of the oligonucleotide probe library is problematic because the sample should not be dehydrated after epitope retrieval. LCM before epitope retrieval can be problematic with heat induced epitope retrieval if the transfer film doesn't hold up during the standard heat epitope retrieval. For example, we tested sample extraction using the CapSure® Macro LCM Caps and the ArcturusXT Microdissection System from ThermoFisher Scientific (Waltham, Mass.) and found that standard heated epitope retrieval conditions (95° C.) may either melt or destroy the capture film.

Figure 25B:
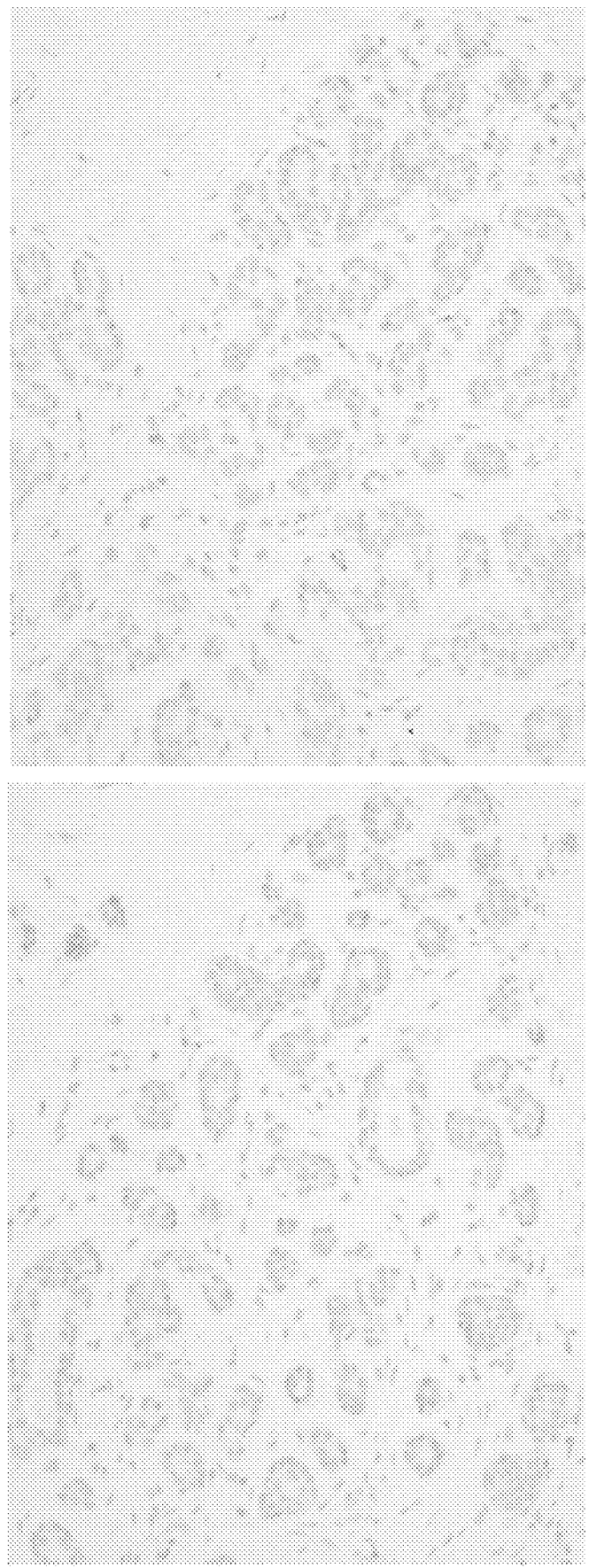

To address such issues, we performed four rounds of enrichment starting with the naïve F-Trin library described herein on breast tissue attached to LCM SureCaps with epitope retrieval at 75° C. We used the resulting R4 oligonucleotide probe library to stain fixed breast tissue using the Dako platform as in Example 19, with epitope retrieval at 75° C. or 97 C with between one and three wash steps after addition of library. With epitope retrieval at 75° C. and one wash step (i.e., least stringent wash conditions), no staining was observed. Epitope retrieval at 97 C and one wash step produced the strongest staining with the enriched library (R4). Under these conditions, we obtained slightly less staining with R0 library and minimal background with a no DNA control. Conditions including epitope retrieval at 97 C and stringent three wash steps resulted in the strongest staining with enriched library (R4) and slightly less staining with the R0 library. Minimal background was found the no DNA control but clearly less than with one wash step. We then tested both the Dako and Ventana IHC systems for staining of fixed breast tissue. See Examples 19 and 25, respectively. We performed library inputs titers (Dako: 50 ng, 25 ng and 12 ng; Ventana: 50 ng and 25 ng) in combination with a stringent staining protocol, comprising 25% BlockAid in library, 19% BlockAid in SA-HRP, 0.01% Triton X-100 and four washes after addition of library. When using the Dako system, we observed stronger staining with the R4 library than the unenriched R0 library with all library inputs (i.e., 50 ng, 25 ng and 12 ng). Representative results are shown in FIG. 25A, which shows the samples stained with 50 ng of the R4 library (FIG. 25Ai) or R0 control (FIG. 25Aii). When using the Ventana system, we also observed stronger staining with the R4 library than the unenriched R0 library with both library inputs (i.e., 50 ng and 25 ng). Representative results are shown in FIG. 25B, which shows the samples stained with 25 ng of the R4 library (FIG. 25Bi) or R0 control (FIG. 25Bii). Under these conditions, background staining was minimal with the R0 control.

These results demonstrate enrichment of an oligonucleotide probe library using microdissected FFPE tissue samples. As with Example 30, this approach may provide more pure samples, e.g., by dissecting purely cancer cells for analysis. As with Examples 30-31, approach may also prove beneficial under some conditions such as when limited sample is available. And as in Example 30, cancer and non-cancer samples can be extracted from a single slide.

Although preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (206506 sequences)

SEQ ID NO: 1 - DNA, 32 bp, Artificial Sequence
  Synthetic oligonucleotide
ccccccgaatcacatgacttgggcgggggtcg

SEQ ID NO: 2 - DNA, 32 bp, Artificial Sequence
  Synthetic oligonucleotide
accggatagcggttggaggcgtgctccactcg

SEQ ID NO: 3 - RNA, 70 nt, Artificial Sequence
  Synthetic oligonucleotide
auccagagugacgcagcagucuuuucugauggacacgugguggucuaguaucacuaagccaccgugucca

SEQ ID NO: 4 - DNA, 20 bp, Artificial Sequence
  Synthetic oligonucleotide
ctagcatgactgcagtacgt

SEQ ID NO: 5 - DNA, 33 bp, Artificial Sequence
  Synthetic oligonucleotide
ctgtctcttatacacatctgacgctgccgacga

SEQ ID NO: 6 - DNA, 15 bp, Artificial Sequence
  Synthetic oligonucleotide
tcgtcggcagcgtca

SEQ ID NO: 7 - protein, 8 aa, Artificial Sequence
  Synthetic peptide
DYKDDDDK

SEQ ID NO: 8 - protein, 9 aa, Artificial Sequence
  Synthetic peptide
YPYDVPDYA

SEQ ID NO: 9 - protein, 10 aa, Artificial Sequence
  Synthetic peptide
EQKLISEEDL

SEQ ID NO: 10 - DNA, 35 bp, Artificial Sequence
  Synthetic oligonucleotide
aacccgcgtgattggggtactgcccatgcgacttt

SEQ ID NO: 11 - DNA, 35 bp, Artificial Sequence
  Synthetic oligonucleotide
aactgaaggccaattaaactccactgtgctaatct

SEQ ID NO: 12 - DNA, 38 bp, Artificial Sequence
  Synthetic oligonucleotide
acatgccggcgttgatactctactgtgctccattatga

SEQ ID NO: 13 - DNA, 36 bp, Artificial Sequence
  Synthetic oligonucleotide
agacatgccacgccctttacatactccactgtgcca

SEQ ID NO: 14 - DNA, 34 bp, Artificial Sequence
  Synthetic oligonucleotide
agccacgcagacctatctctactgtgccaatgtt

SEQ ID NO: 15 - DNA, 37 bp, Artificial Sequence
  Synthetic oligonucleotide
aggtacgtaaggctgccattactctctactgtgccga

SEQ ID NO: 16 - DNA, 35 bp, Artificial Sequence
  Synthetic oligonucleotide
agtctagcgatcgacttttctctacggtgcccttc

SEQ ID NO: 17 - DNA, 37 bp, Artificial Sequence
  Synthetic oligonucleotide
agtgtgcgcatgaatccattactccactgtgccttga

SEQ ID NO: 18 - DNA, 37 bp, Artificial Sequence
  Synthetic oligonucleotide
agttgcagacccttgtattctctaccgtgccctatga

SEQ ID NO: 19 - DNA, 34 bp, Artificial Sequence
  Synthetic oligonucleotide
cactgctaactgatattgttgaactccaccgtgc

SEQ ID NO: 20 - DNA, 38 bp, Artificial Sequence
  Synthetic oligonucleotide
catgcgacaagcttccattaaccatccgctatttatga

SEQ ID NO: 21 - DNA, 36 bp, Artificial Sequence
  Synthetic oligonucleotide
catgcggaccacgctttcacaaactcatgattcaaa

SEQ ID NO: 22 - DNA, 35 bp, Artificial Sequence
  Synthetic oligonucleotide
catgcgtacgtcctattctctctactgtgcattaa

SEQ ID NO: 23 - DNA, 35 bp, Artificial Sequence
  Synthetic oligonucleotide
cctgcaatgcggaaacccttctactctactgtgcc

SEQ ID NO: 24 - DNA, 36 bp, Artificial Sequence
  Synthetic oligonucleotide
cgcgagccagggtactgcctgcggtctaaacaatca

SEQ ID NO: 25 - DNA, 36 bp, Artificial Sequence
  Synthetic oligonucleotide
cgtgcgacttgttctctactgtgccaataaaccata

SEQ ID NO: 26 - DNA, 35 bp, Artificial Sequence
  Synthetic oligonucleotide
gatagcgcatattcctctactgtgctacttgttat

SEQ ID NO: 27 - DNA, 36 bp, Artificial Sequence
  Synthetic oligonucleotide
gcaaaccaattagtgtacctctaccgtgcccaatga

SEQ ID NO: 28 - DNA, 38 bp, Artificial Sequence
  Synthetic oligonucleotide
gcaactactctctaccgtgcccagtgatttctccatga

SEQ ID NO: 29 - DNA, 36 bp, Artificial Sequence
  Synthetic oligonucleotide
gcaccacatgtcaatctctactgtgcttatctcata

SEQ ID NO: 30 - DNA, 36 bp, Artificial Sequence
  Synthetic oligonucleotide
gcagcacaaaagttactctcctctaccgtgccccta

SEQ ID NO: 31 - DNA, 36 bp, Artificial Sequence
  Synthetic oligonucleotide
gcagtttgcgtggatactctactgtgctgaccctta

SEQ ID NO: 32 - DNA, 36 bp, Artificial Sequence
  Synthetic oligonucleotide
gcatacatgaactctaccgtgcccgttgacttgaaa

SEQ ID NO: 33 - DNA, 35 bp, Artificial Sequence
  Synthetic oligonucleotide
gcatagcggttcacattattttactctaccgtgcc

SEQ ID NO: 34 - DNA, 34 bp, Artificial Sequence
  Synthetic oligonucleotide
gccacagtatcgttctcgagctggttcccgccat

SEQ ID NO: 35 - DNA, 38 bp, Artificial Sequence
  Synthetic oligonucleotide
gcgaacatcactctaccgtgccatctgaaatgacgtga

SEQ ID NO: 36 - DNA, 38 bp, Artificial Sequence
  Synthetic oligonucleotide
gcgaacttgtaactctactgtgcttatattaaggttga

SEQ ID NO: 37 - DNA, 35 bp, Artificial Sequence
  Synthetic oligonucleotide
gcgaccaatactctactgtgctgatacggatttta

SEQ ID NO: 38 - DNA, 35 bp, Artificial Sequence
  Synthetic oligonucleotide
gcgaccactctataacctcaaccgtgctcactcct

SEQ ID NO: 39 - DNA, 37 bp, Artificial Sequence
  Synthetic oligonucleotide
gcgcaagttgtctctaccgtgccccgaaagttttgga

SEQ ID NO: 40 - DNA, 35 bp, Artificial Sequence
  Synthetic oligonucleotide
gcgcaccacctacattgtctccaccgtgctttatt

SEQ ID NO: 41 - DNA, 36 bp, Artificial Sequence
  Synthetic oligonucleotide
gcgcacccacgtgaactctaccgtgcctatttccta

SEQ ID NO: 42 - DNA, 38 bp, Artificial Sequence
  Synthetic oligonucleotide
gcgcaccgacctctaccgtgccaaaataggttatctga

SEQ ID NO: 43 - DNA, 35 bp, Artificial Sequence
  Synthetic oligonucleotide
gcgccaccacacaaaccttccctatcgagggagat

SEQ ID NO: 44 - DNA, 37 bp, Artificial Sequence
  Synthetic oligonucleotide
gcgcggactatattactctactgtgccctgcttatga

SEQ ID NO: 45 - DNA, 35 bp, Artificial Sequence
  Synthetic oligonucleotide
gcggataggacaataacttactccactgtgccatc

SEQ ID NO: 46 - DNA, 35 bp, Artificial Sequence
  Synthetic oligonucleotide
gcggtgacctctactgtgcgccccaagccttagtt

SEQ ID NO: 47 - DNA, 38 bp, Artificial Sequence
  Synthetic oligonucleotide
gcgtacagaacctctaccgtgcccactcacttccatga

SEQ ID NO: 48 - DNA, 35 bp, Artificial Sequence
  Synthetic oligonucleotide
gcgtcccctcccggatggtcctttctctactgtgc

SEQ ID NO: 49 - DNA, 35 bp, Artificial Sequence
  Synthetic oligonucleotide
gcgtgctaacggtatgcaagacgtatgcgattttc

SEQ ID NO: 50 - DNA, 35 bp, Artificial Sequence
  Synthetic oligonucleotide
gctagaccgatccacctcaaacctctactgtgcct

SEQ ID NO: 51 - DNA, 35 bp, Artificial Sequence
  Synthetic oligonucleotide
gctagcttagctctaccgtgcacattccgctattt

SEQ ID NO: 52 - DNA, 35 bp, Artificial Sequence
  Synthetic oligonucleotide
ggtgcaggcaagatattttactctactgtgcattt

SEQ ID NO: 53 - DNA, 35 bp, Artificial Sequence
  Synthetic oligonucleotide
gtaaatgtacatgcgtatcctcacctctactgtgc

SEQ ID NO: 54 - DNA, 35 bp, Artificial Sequence
  Synthetic oligonucleotide
taacacgtctttcactctactgtgccctttatgcc

SEQ ID NO: 55 - DNA, 38 bp, Artificial Sequence
  Synthetic oligonucleotide
taatggcatgcggacctatcctctaccgtgctccttga

SEQ ID NO: 56 - DNA, 35 bp, Artificial Sequence
  Synthetic oligonucleotide
tatgcgatttctctaccgtgccaatatgccttgtt

SEQ ID NO: 57 - DNA, 36 bp, Artificial Sequence
  Synthetic oligonucleotide
tctgcgattctaccgttactctaccgtgccaccaaa

SEQ ID NO: 58 - DNA, 36 bp, Artificial Sequence
  Synthetic oligonucleotide
tgcgcagtcatttcgccatgttctctaccgtgccaa

SEQ ID NO: 59 - DNA, 38 bp, Artificial Sequence
  Synthetic oligonucleotide
tgtcaggcggtagtactctccaccgtgcctattgttga

SEQ ID NO: 60 - DNA, 35 bp, Artificial Sequence
  Synthetic oligonucleotide
acatgcataccctacgaatcgttccatcaccatac

SEQ ID NO: 61 - DNA, 35 bp, Artificial Sequence
  Synthetic oligonucleotide
agtcagtgcgcccgctatttacgatctcactgttc

SEQ ID NO: 62 - DNA, 35 bp, Artificial Sequence
  Synthetic oligonucleotide
agtgcagtcgcgatgggaacttcttctttgcttta

SEQ ID NO: 63 - DNA, 36 bp, Artificial Sequence
  Synthetic oligonucleotide
atggccatgcgaaccgaaacctagcccattttccta

SEQ ID NO: 64 - DNA, 34 bp, Artificial Sequence
  Synthetic oligonucleotide
attgcggtcatccccttccacgctataccaccat

SEQ ID NO: 65 - DNA, 35 bp, Artificial Sequence
  Synthetic oligonucleotide
cactgcaggtcactggcgccctatttcctcacatt

SEQ ID NO: 66 - DNA, 35 bp, Artificial Sequence
  Synthetic oligonucleotide
catgcccgtaaacgcctaatctaccaccttttgct

SEQ ID NO: 67 - DNA, 35 bp, Artificial Sequence
  Synthetic oligonucleotide
catgccgcctttcgacttccatatcccaacacgcc

SEQ ID NO: 68 - DNA, 35 bp, Artificial Sequence
  Synthetic oligonucleotide
catgccggtcattccatactcaaactcattcactc

SEQ ID NO: 69 - DNA, 35 bp, Artificial Sequence
  Synthetic oligonucleotide
catgcgagctacccttatcatctcatgtttgcttt

SEQ ID NO: 70 - DNA, 35 bp, Artificial Sequence
  Synthetic oligonucleotide
catgcgattgcgccccattccttgccttatctcac

SEQ ID NO: 71 - DNA, 36 bp, Artificial Sequence
  Synthetic oligonucleotide
catgcgcacatcgtactccgtagccctaaattatca

SEQ ID NO: 72 - DNA, 35 bp, Artificial Sequence
  Synthetic oligonucleotide
catgcgccctgtgcgttctctactaccctaatcat

SEQ ID NO: 73 - DNA, 38 bp, Artificial Sequence
  Synthetic oligonucleotide
catgtacgcacacccactgattctttaccacccactga

SEQ ID NO: 74 - DNA, 35 bp, Artificial Sequence
  Synthetic oligonucleotide
gcaggacaccccctcattatttgtttcatcctacg

SEQ ID NO: 75 - DNA, 35 bp, Artificial Sequence
  Synthetic oligonucleotide
gcatcaggcgcactttcatttgctaatcgtttttt

SEQ ID NO: 76 - DNA, 35 bp, Artificial Sequence
  Synthetic oligonucleotide
gccatgcgagagggttattgttgatctcatgggtt

SEQ ID NO: 77 - DNA, 35 bp, Artificial Sequence
  Synthetic oligonucleotide
gcgataaagcccatgtaaccctctgaaaacccgat

SEQ ID NO: 78 - DNA, 35 bp, Artificial Sequence
  Synthetic oligonucleotide
gcgccacgagctacccgacttccgattactttctt

SEQ ID NO: 79 - DNA, 35 bp, Artificial Sequence
  Synthetic oligonucleotide
gcggacatcgggcactttatacaaccacctttttg

SEQ ID NO: 80 - DNA, 36 bp, Artificial Sequence
  Synthetic oligonucleotide
gctgcaggccgtcccaaatattcgctcccacacata

SEQ ID NO: 81 - DNA, 35 bp, Artificial Sequence
  Synthetic oligonucleotide
gctggtcaggcgttccacacttcctacccgctttt

SEQ ID NO: 82 - DNA, 35 bp, Artificial Sequence
  Synthetic oligonucleotide
tatgcgcaggaccacctattacacgaccttatcct

SEQ ID NO: 83 - DNA, 35 bp, Artificial Sequence
  Synthetic oligonucleotide
tcaactggggtcagtgccaacgcttactttcttct

SEQ ID NO: 84 - DNA, 35 bp, Artificial Sequence
  Synthetic oligonucleotide
tcaagcagtcatagccggtttcacgctttacttac

SEQ ID NO: 85 - DNA, 35 bp, Artificial Sequence
  Synthetic oligonucleotide
aaaacacgcaaactacctggaaacttgacttcttt

SEQ ID NO: 86 - DNA, 35 bp, Artificial Sequence
  Synthetic oligonucleotide
aaaacactcacgatacctaccctggtcttcacaac

SEQ ID NO: 87 - DNA, 35 bp, Artificial Sequence
  Synthetic oligonucleotide
aaaacagcaggcattttcctgtactttcgaattca

SEQ ID NO: 88 - DNA, 35 bp, Artificial Sequence
  Synthetic oligonucleotide
aaaaccacagctaccattatcgcattggccctact

SEQ ID NO: 89 - DNA, 35 bp, Artificial Sequence
  Synthetic oligonucleotide
aaaacccaagcaccgaacgaactatccctttttct

SEQ ID NO: 90 - DNA, 35 bp, Artificial Sequence
  Synthetic oligonucleotide
aaaacccaccacgcgtcgtacgcataccacccttt

SEQ ID NO: 91 - DNA, 35 bp, Artificial Sequence
  Synthetic oligonucleotide
aaaaccggtcctgcgccttcttctccgcttttatt

SEQ ID NO: 92 - DNA, 35 bp, Artificial Sequence
  Synthetic oligonucleotide
caggtactgtggcaggcgatccattgctctctttt

SEQ ID NO: 93 - DNA, 35 bp, Artificial Sequence
  Synthetic oligonucleotide
caggtcagcagtccaggcgattactttctcttttc

SEQ ID NO: 94 - DNA, 35 bp, Artificial Sequence
  Synthetic oligonucleotide
cagtaaccgctgtctgtcatttttcaacattctgt

SEQ ID NO: 95 - DNA, 36 bp, Artificial Sequence
  Synthetic oligonucleotide
cagtaactgtagtcgtcgaaccttgcttacaaccca

SEQ ID NO: 96 - DNA, 35 bp, Artificial Sequence
  Synthetic oligonucleotide
cagtaaggaagctcatgcggtacaggtctacctcg

SEQ ID NO: 97 - DNA, 38 bp, Artificial Sequence
  Synthetic oligonucleotide
cagtaagtgctgtcactgcgccacttgtaaatacttga

SEQ ID NO: 98 - DNA, 36 bp, Artificial Sequence
  Synthetic oligonucleotide
cagtaatgcgaagctagtacgttctctcttatttta

SEQ ID NO: 99 - DNA, 35 bp, Artificial Sequence
  Synthetic oligonucleotide
cagtacaaacatcgcgattctttccttgatactgt

SEQ ID NO: 100 - DNA, 35 bp, Artificial Sequence
  Synthetic oligonucleotide
gagggcggctctaatgcatgcgctttcatctttgc

SEQ ID NO: 101 - DNA, 36 bp, Artificial Sequence
  Synthetic oligonucleotide
gagggcgggcagtcatttcgattatatctgcctaca

SEQ ID NO: 102 - DNA, 37 bp, Artificial Sequence
  Synthetic oligonucleotide
gagggcggtccaacgcgcaatgtcttttttcttccga

SEQ ID NO: 103 - DNA, 35 bp, Artificial Sequence
  Synthetic oligonucleotide
gagggcgtacaggagtcttgcggtccacattttat

SEQ ID NO: 104 - DNA, 35 bp, Artificial Sequence
  Synthetic oligonucleotide
gagggctactgaagttaatggcattcttctctatc

SEQ ID NO: 105 - DNA, 35 bp, Artificial Sequence
  Synthetic oligonucleotide
gagggctcatgccagccgcttttcttacctttatc

SEQ ID NO: 106 - DNA, 38 bp, Artificial Sequence
  Synthetic oligonucleotide
gagggctgaacaagtagtgcgtacattttccttcctga

SEQ ID NO: 107 - DNA, 35 bp, Artificial Sequence
  Synthetic oligonucleotide
gagggctgcaggcatccaatttcctccttgtccct

SEQ ID NO: 108 - DNA, 35 bp, Artificial Sequence
  Synthetic oligonucleotide
gaggggccgtccttcgtacggaatgtgcatgcgct

SEQ ID NO: 109 - DNA, 35 bp, Artificial Sequence
  Synthetic oligonucleotide
gaggggcggtcattgccgttagcctcctttcgcct

SEQ ID NO: 110 - DNA, 37 bp, Artificial Sequence
  Synthetic oligonucleotide
gcgaaactcgccatatacttaaacttgcccttttgga

SEQ ID NO: 111 - DNA, 38 bp, Artificial Sequence
  Synthetic oligonucleotide
aactgcacgtaaccttaatcactccaccgtgccattga

SEQ ID NO: 112 - DNA, 36 bp, Artificial Sequence
  Synthetic oligonucleotide
ttcgccgttaagcatcgtgtcatgcgcaactgttaa

SEQ ID NO: 113 - DNA, 35 bp, Artificial Sequence
  Synthetic oligonucleotide
acgcggacctagcatatcgtagtgcgtggcacttt

SEQ ID NO: 114 - DNA, 35 bp, Artificial Sequence
  Synthetic oligonucleotide
tatgcgcgccatcaccggaactaggtttgggcttt

SEQ ID NO: 115 - DNA, 35 bp, Artificial Sequence
  Synthetic oligonucleotide
gagtacggaatcgtgtcatcagctggatacttttt

SEQ ID NO: 116 - DNA, 38 bp, Artificial Sequence
  Synthetic oligonucleotide
atgcactgggctgaccggtattgcgtatttctctttga

SEQ ID NO: 117 - DNA, 35 bp, Artificial Sequence
  Synthetic oligonucleotide
tatgccccgttccattcttcattcactactagccc

SEQ ID NO: 118 - DNA, 36 bp, Artificial Sequence
  Synthetic oligonucleotide
aagcacaggtactagcaggttcgcactccctgacta

SEQ ID NO: 119 - DNA, 35 bp, Artificial Sequence
  Synthetic oligonucleotide
cacgccccaatatgccatactctactgtgcccctt

SEQ ID NO: 120 - DNA, 35 bp, Artificial Sequence
  Synthetic oligonucleotide
aatgcgcgctaaagaaggacttgtcttgccagccc

SEQ ID NO: 121 - DNA, 35 bp, Artificial Sequence
  Synthetic oligonucleotide
gaacggatcgtagtgaaacaggactggagcggccc

SEQ ID NO: 122 - DNA, 35 bp, Artificial Sequence
  Synthetic oligonucleotide
tcgtaggacaaaggcactggttgaatcttttctat

SEQ ID NO: 123 - DNA, 35 bp, Artificial Sequence
  Synthetic oligonucleotide
tgcgcgctaaacactgcaagtctagccccgcattc

SEQ ID NO: 124 - DNA, 35 bp, Artificial Sequence
  Synthetic oligonucleotide
tcacctaccaagtctccaatcattgcaccctctac

SEQ ID NO: 125 - DNA, 36 bp, Artificial Sequence
  Synthetic oligonucleotide
gcctatcaatgtctctctactgtgccggacttttta

SEQ ID NO: 126 - DNA, 36 bp, Artificial Sequence
  Synthetic oligonucleotide
aggactgcccccgcctgactctactgtgccatctca

SEQ ID NO: 127 - DNA, 35 bp, Artificial Sequence
  Synthetic oligonucleotide
ggtagctccaccgtgccatactcgatctttgttac

SEQ ID NO: 128 - DNA, 38 bp, Artificial Sequence
  Synthetic oligonucleotide
ttccgcgacctaactccaccgtgccataatccctttga

SEQ ID NO: 129 - DNA, 36 bp, Artificial Sequence
  Synthetic oligonucleotide
agacttaagcaaggtcgtacgtaggtagtcccacca

SEQ ID NO: 130 - DNA, 36 bp, Artificial Sequence
  Synthetic oligonucleotide
gctaactgcaggccccctatccgacctaaatataca

SEQ ID NO: 131 - DNA, 36 bp, Artificial Sequence
  Synthetic oligonucleotide
atcgtagtacgaatgtcaagcgtacacgctttccta

SEQ ID NO: 132 - DNA, 36 bp, Artificial Sequence
  Synthetic oligonucleotide
gcgttgatctctaccgtgcaccgaacactccccaca

SEQ ID NO: 133 - DNA, 38 bp, Artificial Sequence
  Synthetic oligonucleotide
gccgctatatcaatcctctactgtgcgaattaacctga

SEQ ID NO: 134 - DNA, 35 bp, Artificial Sequence
  Synthetic oligonucleotide
ttgctgttatcgtcctctactgtgccggtattcct

SEQ ID NO: 135 - DNA, 35 bp, Artificial Sequence
  Synthetic oligonucleotide
gtcatgcggaagctttcctgttttggtataatgtc

SEQ ID NO: 136 - DNA, 36 bp, Artificial Sequence
  Synthetic oligonucleotide
gcgaacagatttctctacggtgcttacacatattta

SEQ ID NO: 137 - DNA, 36 bp, Artificial Sequence
  Synthetic oligonucleotide
actggaaggagtcctacctgcctgacgcgtgacgta

SEQ ID NO: 138 - DNA, 38 bp, Artificial Sequence
  Synthetic oligonucleotide
gccaatactccactgtgcttgattttacttttgaatga

SEQ ID NO: 139 - DNA, 35 bp, Artificial Sequence
  Synthetic oligonucleotide
tgacctactaagtcagcgcacatcctgggctttct

SEQ ID NO: 140 - DNA, 35 bp, Artificial Sequence
  Synthetic oligonucleotide
tgtctctactgtgcccaattgttcggaaataactt

SEQ ID NO: 141 - DNA, 35 bp, Artificial Sequence
  Synthetic oligonucleotide
aacctctgctgtgcgttaaactctaccgtgcctac

SEQ ID NO: 142 - DNA, 36 bp, Artificial Sequence
  Synthetic oligonucleotide
tacaacgcgtgcttggggtgacgtggtgcctcttta

SEQ ID NO: 143 - DNA, 36 bp, Artificial Sequence
  Synthetic oligonucleotide
tagtcttgccgtctatctctaccgtgcctggcccta

SEQ ID NO: 144 - DNA, 35 bp, Artificial Sequence
  Synthetic oligonucleotide
gcggaactcgcccccttacatcattttttttggtt

SEQ ID NO: 145 - DNA, 35 bp, Artificial Sequence
  Synthetic oligonucleotide
tgcgtgctaaacggtctagcacatgcgggcctcac

SEQ ID NO: 146 - DNA, 38 bp, Artificial Sequence
  Synthetic oligonucleotide
gctgcagtgcgactctggcctccactgtgctaccttga

SEQ ID NO: 147 - DNA, 35 bp, Artificial Sequence
  Synthetic oligonucleotide
ggccacgactggttccccaattcacaggtatacat

SEQ ID NO: 148 - DNA, 35 bp, Artificial Sequence
  Synthetic oligonucleotide
gcgatagccttaacttgccttctgtgaactcgcct

SEQ ID NO: 149 - DNA, 35 bp, Artificial Sequence
  Synthetic oligonucleotide
tcacctactaggtccatccaatacttattgtccca

SEQ ID NO: 150 - DNA, 35 bp, Artificial Sequence
  Synthetic oligonucleotide
catgcggcaagcttttaactcagctttatctcata

SEQ ID NO: 151 - DNA, 38 bp, Artificial Sequence
  Synthetic oligonucleotide
catgacattttctccactgtgcttgtaattagtattga

SEQ ID NO: 152 - DNA, 36 bp, Artificial Sequence
  Synthetic oligonucleotide
aactccaccgtgcccacttcttgtttcatagtttaa

SEQ ID NO: 153 - DNA, 38 bp, Artificial Sequence
  Synthetic oligonucleotide
ccatgcgattttgtttcccctctactgtgcttatctga

SEQ ID NO: 154 - DNA, 35 bp, Artificial Sequence
  Synthetic oligonucleotide
tgttcacctgtccttcctctctactgtgccgttct

SEQ ID NO: 155 - DNA, 35 bp, Artificial Sequence
  Synthetic oligonucleotide
atgcgcgcgatcgaggtccccgatggcttcgctcc

SEQ ID NO: 156 - DNA, 36 bp, Artificial Sequence
  Synthetic oligonucleotide
tccgcgtgtaaccttggcatgtacctagtgtccaca

SEQ ID NO: 157 - DNA, 36 bp, Artificial Sequence
  Synthetic oligonucleotide
catgccaagctttcatttaggatttcgcccacatca

SEQ ID NO: 158 - DNA, 37 bp, Artificial Sequence
  Synthetic oligonucleotide
gcgtctgcgtcctagttttctctaccgtgcttttcga

SEQ ID NO: 159 - DNA, 36 bp, Artificial Sequence
  Synthetic oligonucleotide
ggctgctagacctccaccgtgccctttctttggtta

SEQ ID NO: 160 - DNA, 35 bp, Artificial Sequence
  Synthetic oligonucleotide
gagtcaggcccaggcttacatatcactagctttta

SEQ ID NO: 161 - DNA, 36 bp, Artificial Sequence
  Synthetic oligonucleotide
aatactctactgtgccccccgttttctcatcgatca

SEQ ID NO: 162 - DNA, 35 bp, Artificial Sequence
  Synthetic oligonucleotide
aggcatgcgcagagttaatttttttctctactgtg

SEQ ID NO: 163 - DNA, 36 bp, Artificial Sequence
  Synthetic oligonucleotide
gacctgcagcgcacgcccgatatctctactgtgcca

SEQ ID NO: 164 - DNA, 36 bp, Artificial Sequence
  Synthetic oligonucleotide
ccggggctaggaaagctaccacgtcatgcggaacta

SEQ ID NO: 165 - DNA, 35 bp, Artificial Sequence
  Synthetic oligonucleotide
catctcaaaactttcctctaccgtgcaaacattta

SEQ ID NO: 166 - DNA, 35 bp, Artificial Sequence
  Synthetic oligonucleotide
gcgatcgaacttgcctcctacaatcatcaactagc

SEQ ID NO: 167 - DNA, 38 bp, Artificial Sequence
  Synthetic oligonucleotide
cagtcatcccgtggactctgtgctcgtatctccattga

SEQ ID NO: 168 - DNA, 36 bp, Artificial Sequence
  Synthetic oligonucleotide
tcgtagtacgcggtgaaccctcaatttacgccccta

SEQ ID NO: 169 - DNA, 37 bp, Artificial Sequence
  Synthetic oligonucleotide
gcgtcgtccaactccactgtgcccattttaggtctga

SEQ ID NO: 170 - DNA, 35 bp, Artificial Sequence
  Synthetic oligonucleotide
gcatatgcggtgtttctactctaccgtgcaaaacc

SEQ ID NO: 171 - DNA, 36 bp, Artificial Sequence
  Synthetic oligonucleotide
gcggcaacacttcctctactgtgcttcctggcttaa

SEQ ID NO: 172 - DNA, 35 bp, Artificial Sequence
  Synthetic oligonucleotide
gattcggtccccttcttctctactgtgccttttct

SEQ ID NO: 173 - DNA, 35 bp, Artificial Sequence
  Synthetic oligonucleotide
ccgcgtgcttggtgcgtgctgcaggaaattggaaa

SEQ ID NO: 174 - DNA, 36 bp, Artificial Sequence
  Synthetic oligonucleotide
gcgtgccaacggactggagctctattgattgttcta

SEQ ID NO: 175 - DNA, 35 bp, Artificial Sequence
  Synthetic oligonucleotide
atgtacgtgcgtaccttttatattctctactgtgc

SEQ ID NO: 176 - DNA, 36 bp, Artificial Sequence
  Synthetic oligonucleotide
agagcctgggcttgctagctggatttggtcacgaaa

SEQ ID NO: 177 - DNA, 35 bp, Artificial Sequence
  Synthetic oligonucleotide
tactgcgcgcctggacccgtgtgctagacatgcgc

SEQ ID NO: 178 - DNA, 36 bp, Artificial Sequence
  Synthetic oligonucleotide
ccgtggtgccctgcgcgctaagaggctcacggagta

SEQ ID NO: 179 - DNA, 35 bp, Artificial Sequence
  Synthetic oligonucleotide
gtaccggacctagggactaacgtactggcacctct

SEQ ID NO: 180 - DNA, 36 bp, Artificial Sequence
  Synthetic oligonucleotide
taccgcgagcttgggaagtgctgctacgtctgccga

SEQ ID NO: 181 - DNA, 35 bp, Artificial Sequence
  Synthetic oligonucleotide
ggtatgcccgcttttactctactgtgcccgacata

SEQ ID NO: 182 - DNA, 36 bp, Artificial Sequence
  Synthetic oligonucleotide
gtgcaacactaagttgaccggattgagtctagcgaa

SEQ ID NO: 183 - DNA, 35 bp, Artificial Sequence
  Synthetic oligonucleotide
gactgcagggtgtcacctctaccgtgccatgaggt

SEQ ID NO: 184 - DNA, 35 bp, Artificial Sequence
  Synthetic oligonucleotide
ttcgtagtaccaatagtcagtaatgccctttcgcc

SEQ ID NO: 185 - DNA, 38 bp, Artificial Sequence
  Synthetic oligonucleotide
atgcactgtatgcgggctatgcgaatacctagttatga

SEQ ID NO: 186 - DNA, 36 bp, Artificial Sequence
  Synthetic oligonucleotide
cccggcgcgctacgggacgattatgagctcttgcaa

SEQ ID NO: 187 - DNA, 35 bp, Artificial Sequence
  Synthetic oligonucleotide
catgcgcacaggctttttaatctccatgaagtttc

SEQ ID NO: 188 - DNA, 38 bp, Artificial Sequence
  Synthetic oligonucleotide
gcgggcttacacgtactggaggggttgcatgccattga

SEQ ID NO: 189 - DNA, 35 bp, Artificial Sequence
  Synthetic oligonucleotide
gtcgtagtactcgcggtcaagagattccttatttc

SEQ ID NO: 190 - DNA, 35 bp, Artificial Sequence
  Synthetic oligonucleotide
cacgcgtgcttggcgacgttcacttgcgggcctat

SEQ ID NO: 191 - DNA, 36 bp, Artificial Sequence
  Synthetic oligonucleotide
gccacctcactccactgtgctatcttatcgccttca

SEQ ID NO: 192 - DNA, 36 bp, Artificial Sequence
  Synthetic oligonucleotide
cgtgtcctttgaccgtactgcgaaacgcctaccaaa

SEQ ID NO: 193 - DNA, 35 bp, Artificial Sequence
  Synthetic oligonucleotide
gaatcgtaacaaactgcaggcctatctctacttgt

SEQ ID NO: 194 - DNA, 37 bp, Artificial Sequence
  Synthetic oligonucleotide
gcaggaaacctctactgtgccttgtagtatactttga

SEQ ID NO: 195 - DNA, 38 bp, Artificial Sequence
  Synthetic oligonucleotide
gcagtccatagcgctcctggtctcctcttttgctttga

SEQ ID NO: 196 - DNA, 35 bp, Artificial Sequence
  Synthetic oligonucleotide
cgtgccactcaaatcctcctctaccgtgctttttt

SEQ ID NO: 197 - DNA, 35 bp, Artificial Sequence
  Synthetic oligonucleotide
tggagcacgccgccaatggacagtccaccttacct

SEQ ID NO: 198 - DNA, 35 bp, Artificial Sequence
  Synthetic oligonucleotide
gatgggcctgcgtgctaaggcgcgataacgggtgt

SEQ ID NO: 199 - DNA, 35 bp, Artificial Sequence
  Synthetic oligonucleotide
cgcgggccaggtctgcatgcatgcgaggtcacacc

SEQ ID NO: 200 - DNA, 37 bp, Artificial Sequence
  Synthetic oligonucleotide
gcgtgcttacgaacaaggtgcgtgcccgattctccga

SEQ ID NO: 201 - DNA, 36 bp, Artificial Sequence
  Synthetic oligonucleotide
tcagcggacctagcgaacgattgcggccaccactta

SEQ ID NO: 202 - DNA, 38 bp, Artificial Sequence
  Synthetic oligonucleotide
gccgcgcgtgccagcataatcgtactatgtctgcgtga

SEQ ID NO: 203 - DNA, 35 bp, Artificial Sequence
  Synthetic oligonucleotide
atcgtagaactagctagtctgcaatttctggttac

SEQ ID NO: 204 - DNA, 35 bp, Artificial Sequence
  Synthetic oligonucleotide
gccgcgtgcctggccaaactgggtcaacttttctc

SEQ ID NO: 205 - DNA, 38 bp, Artificial Sequence
  Synthetic oligonucleotide
tctatcgcgtgccagtgtacgtacggtgtcttatttga

SEQ ID NO: 206 - DNA, 35 bp, Artificial Sequence
  Synthetic oligonucleotide
ttacgttcccggactctactgtgcccctccctata

SEQ ID NO: 207 - DNA, 35 bp, Artificial Sequence
  Synthetic oligonucleotide
ccaaccgcgcgcctggggactacgtgacatctagc

SEQ ID NO: 208 - DNA, 36 bp, Artificial Sequence
  Synthetic oligonucleotide
tcgtagtactgctgctttgtgcgtccatactcgtta

SEQ ID NO: 209 - DNA, 37 bp, Artificial Sequence
  Synthetic oligonucleotide
atcgtagtactgcaactgggattattcacacactaga

SEQ ID NO: 210 - DNA, 36 bp, Artificial Sequence
  Synthetic oligonucleotide
gaattccgcgcgtagtcgagtactagggaaatcgaa

SEQ ID NO: 211 - DNA, 35 bp, Artificial Sequence
  Synthetic oligonucleotide
catgcggaccatgatttttattgagtttttgcttt

SEQ ID NO: 212 - DNA, 35 bp, Artificial Sequence
  Synthetic oligonucleotide
attcgagcggtcttgcgggtatccctccactgtgc

SEQ ID NO: 213 - DNA, 36 bp, Artificial Sequence
  Synthetic oligonucleotide
catgcgcattactctggtcaacttgccgaatcgaaa

SEQ ID NO: 214 - DNA, 37 bp, Artificial Sequence
  Synthetic oligonucleotide
gggcgtatcgtagccacgtacaagggttgcatattga

SEQ ID NO: 215 - DNA, 36 bp, Artificial Sequence
  Synthetic oligonucleotide
gcgagaagctttcaatcctcaaccttacgctttata

SEQ ID NO: 216 - DNA, 35 bp, Artificial Sequence
  Synthetic oligonucleotide
acgcctaagttgcctctaccgtgccgagccctcca

SEQ ID NO: 217 - DNA, 35 bp, Artificial Sequence
  Synthetic oligonucleotide
tgcggagctagcaacgagggtagagtgcgaattcc

SEQ ID NO: 218 - DNA, 35 bp, Artificial Sequence
  Synthetic oligonucleotide
gataagtcacggacggtttctctactgtgcctttt

SEQ ID NO: 219 - DNA, 36 bp, Artificial Sequence
  Synthetic oligonucleotide
gcgtgccaacaacctgcggacaaaagaccccctaaa

SEQ ID NO: 220 - DNA, 38 bp, Artificial Sequence
  Synthetic oligonucleotide
ggtcatgccgctaggggcgaactcctctgagcctgtga

SEQ ID NO: 221 - DNA, 38 bp, Artificial Sequence
  Synthetic oligonucleotide
cctcgcgcgccagggacgttgcaagttaaaccatatga

SEQ ID NO: 222 - DNA, 35 bp, Artificial Sequence
  Synthetic oligonucleotide
gcaggcgggccaggcttaatacacgcttctactta

SEQ ID NO: 223 - DNA, 34 bp, Artificial Sequence
  Synthetic oligonucleotide
atcgtagtaatgcagcaattgcaatactcctatt

SEQ ID NO: 224 - DNA, 36 bp, Artificial Sequence
  Synthetic oligonucleotide
accgaacctagggacgccccaggaatcacaatgtta

SEQ ID NO: 225 - DNA, 35 bp, Artificial Sequence
  Synthetic oligonucleotide
tactgctaactttcactctaccgtgcaaaccacca

SEQ ID NO: 226 - DNA, 35 bp, Artificial Sequence
  Synthetic oligonucleotide
cccggaagtgggttcgagctgcatcgtgtcaggcc

SEQ ID NO: 227 - DNA, 36 bp, Artificial Sequence
  Synthetic oligonucleotide
tagtaacttcatgcccccagtggaactcctctgaca

SEQ ID NO: 228 - DNA, 35 bp, Artificial Sequence
  Synthetic oligonucleotide
gtccacgcgtgcctgaggacacagccaggaaactt

SEQ ID NO: 229 - DNA, 36 bp, Artificial Sequence
  Synthetic oligonucleotide
aatcgctggccagaaagttagcagtcgaggcccaaa

SEQ ID NO: 230 - DNA, 36 bp, Artificial Sequence
  Synthetic oligonucleotide
agggcgtgccacctcgaacacgcaggtaatttttca

SEQ ID NO: 231 - DNA, 35 bp, Artificial Sequence
  Synthetic oligonucleotide
tcacctaccatgtccgagtaacactcgcccctcca

SEQ ID NO: 232 - DNA, 35 bp, Artificial Sequence
  Synthetic oligonucleotide
cgtggccggtggtccgtactgccaaaatatttaca

SEQ ID NO: 233 - DNA, 35 bp, Artificial Sequence
  Synthetic oligonucleotide
cgcgtgccagcggactttcaccatgcgatacgtgg

SEQ ID NO: 234 - DNA, 36 bp, Artificial Sequence
  Synthetic oligonucleotide
gagttaaagctatctctaccgtgccccctaaagtta

SEQ ID NO: 235 - DNA, 36 bp, Artificial Sequence
  Synthetic oligonucleotide
tatcgcgcgccagaagagtaagcaagtcatgaccca

SEQ ID NO: 236 - DNA, 37 bp, Artificial Sequence
  Synthetic oligonucleotide
tgaccaagggttccgctgtggggatacggttaaggga

SEQ ID NO: 237 - DNA, 36 bp, Artificial Sequence
  Synthetic oligonucleotide
agccggagctaggctagtgcgcaccagtcaaaccta

SEQ ID NO: 238 - DNA, 38 bp, Artificial Sequence
  Synthetic oligonucleotide
tcgtagtattgcaagggcaccttactcccaccatttga

SEQ ID NO: 239 - DNA, 35 bp, Artificial Sequence
  Synthetic oligonucleotide
gcgcagcttatcgccatccgcaaatccacacgctt

SEQ ID NO: 240 - DNA, 37 bp, Artificial Sequence
  Synthetic oligonucleotide
cccacgcgtgcctgtggatggcgcactcgggcataga

SEQ ID NO: 241 - DNA, 36 bp, Artificial Sequence
  Synthetic oligonucleotide
caaggagcacgtatgcactgtgcgagttggtccgta

SEQ ID NO: 242 - DNA, 36 bp, Artificial Sequence
  Synthetic oligonucleotide
agttagtctctaccgtgcccattattccgttctgaa

SEQ ID NO: 243 - DNA, 35 bp, Artificial Sequence
  Synthetic oligonucleotide
gcctgtgaaccttaaactctaccgtgcctctttgt

SEQ ID NO: 244 - DNA, 36 bp, Artificial Sequence
  Synthetic oligonucleotide
gctaaccaagtcatgggaccacgctctattgggata

SEQ ID NO: 245 - DNA, 35 bp, Artificial Sequence
  Synthetic oligonucleotide
gcaggcattattagtgtctctaccgtgctctggac

SEQ ID NO: 246 - DNA, 38 bp, Artificial Sequence
  Synthetic oligonucleotide
taccgcgcgcctggtagttgcagtattcctttgtttga

SEQ ID NO: 247 - DNA, 35 bp, Artificial Sequence
  Synthetic oligonucleotide
taacctaccaggccatgcgcaggactgtaatgcca

SEQ ID NO: 248 - DNA, 36 bp, Artificial Sequence
  Synthetic oligonucleotide
gcgccacatcgcaagcttatcgacaccccgctttca

SEQ ID NO: 249 - DNA, 35 bp, Artificial Sequence
  Synthetic oligonucleotide
cccggggctagggatcgggtgcaatcattgaattt

SEQ ID NO: 250 - DNA, 35 bp, Artificial Sequence
  Synthetic oligonucleotide
gcgagcctagcccgtaactggaaggccactactct

SEQ ID NO: 251 - DNA, 37 bp, Artificial Sequence
  Synthetic oligonucleotide
gacgggtgcgggctagcaagctttacctctattatga

SEQ ID NO: 252 - DNA, 35 bp, Artificial Sequence
  Synthetic oligonucleotide
gcgtgccaacgtgactgtgtcgcctttgctctgta

SEQ ID NO: 253 - DNA, 35 bp, Artificial Sequence
  Synthetic oligonucleotide
atcgtaggactgcgaaatcattgcgggtttattgt

SEQ ID NO: 254 - DNA, 35 bp, Artificial Sequence
  Synthetic oligonucleotide
ttacctaccaaggcacgccgttttatataaggtgg

SEQ ID NO: 255 - DNA, 35 bp, Artificial Sequence
  Synthetic oligonucleotide
ccgcgtgcttggattgtgcagtcctccctctgact

SEQ ID NO: 256 - DNA, 36 bp, Artificial Sequence
  Synthetic oligonucleotide
ttacctaccagtgcatggcgataagtctttcctata

SEQ ID NO: 257 - DNA, 35 bp, Artificial Sequence
  Synthetic oligonucleotide
gacgtctgcaggtgagcattggtctacttattggt

SEQ ID NO: 258 - DNA, 38 bp, Artificial Sequence
  Synthetic oligonucleotide
cgcgatcgtagcagtacggaggttcttctagcatatga

SEQ ID NO: 259 - DNA, 35 bp, Artificial Sequence
  Synthetic oligonucleotide
cgcgaatcgtagccgacgtgcttgggcttgcgacc

SEQ ID NO: 260 - DNA, 36 bp, Artificial Sequence
  Synthetic oligonucleotide
aagcacggtacgcacagtccgacttttgccttcaaa

SEQ ID NO: 261 - DNA, 35 bp, Artificial Sequence
  Synthetic oligonucleotide
tccggaactaggagacgtacacgccgcaatgcccc

SEQ ID NO: 262 - DNA, 35 bp, Artificial Sequence
  Synthetic oligonucleotide
ccgcggacctagcgaggacagcgcattgctagcta

SEQ ID NO: 263 - DNA, 35 bp, Artificial Sequence
  Synthetic oligonucleotide
agcccgcgtgcctgggagacgacctccgacttgcg

SEQ ID NO: 264 - DNA, 35 bp, Artificial Sequence
  Synthetic oligonucleotide
gcgtgctaaggtactgtacagtctacgcctatgtt

SEQ ID NO: 265 - DNA, 38 bp, Artificial Sequence
  Synthetic oligonucleotide
taccgcgatactgcacgtgtgcgaccgcttttccttga

SEQ ID NO: 266 - DNA, 36 bp, Artificial Sequence
  Synthetic oligonucleotide
tgacctaccaaggagagtttcatttgatctaaacta

SEQ ID NO: 267 - DNA, 35 bp, Artificial Sequence
  Synthetic oligonucleotide
cttagtgccctaagtctgcgtgactctactgtgcc

SEQ ID NO: 268 - DNA, 36 bp, Artificial Sequence
  Synthetic oligonucleotide
tgcaggcagagcccgttaagctttttatcaactcca

SEQ ID NO: 269 - DNA, 35 bp, Artificial Sequence
  Synthetic oligonucleotide
gaggcgaatcgtagctccacgtggtgccatgcaga

SEQ ID NO: 270 - DNA, 35 bp, Artificial Sequence
  Synthetic oligonucleotide
catccgctagttgcttttaatgaccaccgcttcca

SEQ ID NO: 271 - DNA, 36 bp, Artificial Sequence
  Synthetic oligonucleotide
aagcactgtacaaactggatgcgtacacttcctcca

SEQ ID NO: 272 - DNA, 35 bp, Artificial Sequence
  Synthetic oligonucleotide
gcgtgccaaggtacggaaggtccatgcaacggttt

SEQ ID NO: 273 - DNA, 36 bp, Artificial Sequence
  Synthetic oligonucleotide
cgtgtaccgcttgtaccgtacaaagtcaccttgtta

SEQ ID NO: 274 - DNA, 36 bp, Artificial Sequence
  Synthetic oligonucleotide
catgcgcgctccactggtcttaattttcctccatga

SEQ ID NO: 275 - DNA, 37 bp, Artificial Sequence
  Synthetic oligonucleotide
tctgcgtgctaagagcggccctgtagttgcgccttga

SEQ ID NO: 276 - DNA, 36 bp, Artificial Sequence
  Synthetic oligonucleotide
gcgtgccaacgattctgcgctgggctagtaccatta

SEQ ID NO: 277 - DNA, 35 bp, Artificial Sequence
  Synthetic oligonucleotide
gcgcgctaacggacaaatcccctaacctcgataaa

SEQ ID NO: 278 - DNA, 35 bp, Artificial Sequence
  Synthetic oligonucleotide
attctctaccgtgccacattttatcctctgcaaac

SEQ ID NO: 279 - DNA, 37 bp, Artificial Sequence
  Synthetic oligonucleotide
tgtctggatgccatgcgccacgcttttctcactatga

SEQ ID NO: 280 - DNA, 37 bp, Artificial Sequence
  Synthetic oligonucleotide
atcgtagtgctgcaggatctacctacattattctgga

SEQ ID NO: 281 - DNA, 36 bp, Artificial Sequence
  Synthetic oligonucleotide
gcagtctcatctgtcttctctaccgtgctcgaatca

SEQ ID NO: 282 - DNA, 35 bp, Artificial Sequence
  Synthetic oligonucleotide
gtctccggcgatatctccactgtgcccttctctat

SEQ ID NO: 283 - DNA, 35 bp, Artificial Sequence
  Synthetic oligonucleotide
gcaagtcattccagtcctgactctaccgtgcttac

SEQ ID NO: 284 - DNA, 35 bp, Artificial Sequence
  Synthetic oligonucleotide
gtgatggtcgtgcccgctttatcttacatctgctt

SEQ ID NO: 285 - DNA, 35 bp, Artificial Sequence
  Synthetic oligonucleotide
gcgtcgacgagatttttgacctctaccgtgccgac

SEQ ID NO: 286 - DNA, 35 bp, Artificial Sequence
  Synthetic oligonucleotide
tgcgtcaggcgtccgcttttaccccaccatgcttt

SEQ ID NO: 287 - DNA, 37 bp, Artificial Sequence
  Synthetic oligonucleotide
atgacacgcgcgcctgctagtactgcgctccatgcga

SEQ ID NO: 288 - DNA, 36 bp, Artificial Sequence
  Synthetic oligonucleotide
ggtcaagcattgcgactctaccgtgcctcaaactaa

SEQ ID NO: 289 - DNA, 35 bp, Artificial Sequence
  Synthetic oligonucleotide
cacgtactgtttactctaccgtgcattaaacgttt

SEQ ID NO: 290 - DNA, 35 bp, Artificial Sequence
  Synthetic oligonucleotide
agcaggcccttttcacatactctctactgtgctcc

SEQ ID NO: 291 - DNA, 35 bp, Artificial Sequence
  Synthetic oligonucleotide
taatgcaggagtgtgccaagcttttatttcatgtc

SEQ ID NO: 292 - DNA, 38 bp, Artificial Sequence
  Synthetic oligonucleotide
catgcgaccgctttacctacataggattactcttctga

SEQ ID NO: 293 - DNA, 35 bp, Artificial Sequence
  Synthetic oligonucleotide
ttgcggatctagcaacgaatggaaggaacacgtac

SEQ ID NO: 294 - DNA, 35 bp, Artificial Sequence
  Synthetic oligonucleotide
atcgtagtacccgcgggaaaaaaccacttatcatc

SEQ ID NO: 295 - DNA, 35 bp, Artificial Sequence
  Synthetic oligonucleotide
tcgctgcaccgtgtccatgcggctacaccaattcg

SEQ ID NO: 296 - DNA, 35 bp, Artificial Sequence
  Synthetic oligonucleotide
gcagaataccttactctaccgtgccattaatacat

SEQ ID NO: 297 - DNA, 38 bp, Artificial Sequence
  Synthetic oligonucleotide
gcgccgaatagcctctactgtgcgttaccctggattga

SEQ ID NO: 298 - DNA, 35 bp, Artificial Sequence
  Synthetic oligonucleotide
gcaggccgtatcactctaccgtgcaaaaagtatac

SEQ ID NO: 299 - DNA, 37 bp, Artificial Sequence
  Synthetic oligonucleotide
tactgaggcgacaattctctaccgtgcccccatttga

SEQ ID NO: 300 - DNA, 37 bp, Artificial Sequence
  Synthetic oligonucleotide
gccactagtatcctccactgtgcaaaattacaataga

SEQ ID NO: 301 - DNA, 38 bp, Artificial Sequence
  Synthetic oligonucleotide
ggtattgccgtgtagttcgttctctactgtgcctttga

SEQ ID NO: 302 - DNA, 35 bp, Artificial Sequence
  Synthetic oligonucleotide
cttgcgagattagctttatcacctgttttccgctt

SEQ ID NO: 303 - DNA, 35 bp, Artificial Sequence
  Synthetic oligonucleotide
gcacctctactgtgcccacaacgaattggactcac

SEQ ID NO: 304 - DNA, 35 bp, Artificial Sequence
  Synthetic oligonucleotide
ctccgcggtcatccactgctccattcaactcgcct

SEQ ID NO: 305 - DNA, 35 bp, Artificial Sequence
  Synthetic oligonucleotide
aatctccaccgtgcactatcttgtctcaaagtttc

SEQ ID NO: 306 - DNA, 36 bp, Artificial Sequence
  Synthetic oligonucleotide
gctagctgaattcaccatatctctactgtgcactaa

SEQ ID NO: 307 - DNA, 37 bp, Artificial Sequence
  Synthetic oligonucleotide
ctgcgtgctaagacgtacggtgtcaacatctctccga

SEQ ID NO: 308 - DNA, 35 bp, Artificial Sequence
  Synthetic oligonucleotide
gcgacgggacttagcttatattagatttcgcttct

SEQ ID NO: 309 - DNA, 36 bp, Artificial Sequence
  Synthetic oligonucleotide
catgcggaagcttactcatttttattcgattaccaa

SEQ ID NO: 310 - DNA, 35 bp, Artificial Sequence
  Synthetic oligonucleotide
taacctaccaagcaatcaccgttttggaaatcatt

SEQ ID NO: 311 - DNA, 36 bp, Artificial Sequence
  Synthetic oligonucleotide
gcccagaaaaactctactgtgcgatgacctgttaaa

SEQ ID NO: 312 - DNA, 36 bp, Artificial Sequence
  Synthetic oligonucleotide
tccgcgtgcctggaaaggtactgtccacttgaacaa

SEQ ID NO: 313 - DNA, 38 bp, Artificial Sequence
  Synthetic oligonucleotide
gagtttgcaggcttggggactctactgtgcaattttga

SEQ ID NO: 314 - DNA, 36 bp, Artificial Sequence
  Synthetic oligonucleotide
ttcgcctccaccgtgcatttctaactttatttctta

SEQ ID NO: 315 - DNA, 35 bp, Artificial Sequence
  Synthetic oligonucleotide
ccctcggactgagcactgcatacaagaagccttgc

SEQ ID NO: 316 - DNA, 37 bp, Artificial Sequence
  Synthetic oligonucleotide
cccgtgcctccccttatctctaccgtgcctcctatga

SEQ ID NO: 317 - DNA, 36 bp, Artificial Sequence
  Synthetic oligonucleotide
actcagtcatcgtacgctttccgatatcgctttata

SEQ ID NO: 318 - DNA, 35 bp, Artificial Sequence
  Synthetic oligonucleotide
tacgcgtgccaggaactgtaccagtcttatgccgc

SEQ ID NO: 319 - DNA, 36 bp, Artificial Sequence
  Synthetic oligonucleotide
gcggatttggtctctaccgtgcctactactagttaa

SEQ ID NO: 320 - DNA, 38 bp, Artificial Sequence
  Synthetic oligonucleotide
ggcacggaatgcatcgtgtcatggcgtctttcccctga

SEQ ID NO: 321 - DNA, 35 bp, Artificial Sequence
  Synthetic oligonucleotide
gtgcaggccacccagatctctactgtgcctcttac

SEQ ID NO: 322 - DNA, 35 bp, Artificial Sequence
  Synthetic oligonucleotide
atcgtaggactgcacatcgtagtttagttactcac

SEQ ID NO: 323 - DNA, 35 bp, Artificial Sequence
  Synthetic oligonucleotide
tcacctacaaatgtcaggcatatactactctatta

SEQ ID NO: 324 - DNA, 36 bp, Artificial Sequence
  Synthetic oligonucleotide
gtacaagcagtttggcgtatatctctactgtgctga

SEQ ID NO: 325 - DNA, 35 bp, Artificial Sequence
  Synthetic oligonucleotide
gataacgtttgattactccactgtgccataccctt

SEQ ID NO: 326 - DNA, 37 bp, Artificial Sequence
  Synthetic oligonucleotide
tgagcgatcgtagccaacgtactgcctttcctattga

SEQ ID NO: 327 - DNA, 35 bp, Artificial Sequence
  Synthetic oligonucleotide
gcgtcgaccacgttaatatttaccctctactgtgc

SEQ ID NO: 328 - DNA, 35 bp, Artificial Sequence
  Synthetic oligonucleotide
gcctggtcaactcgccgcaatacttttacccatcc

SEQ ID NO: 329 - DNA, 37 bp, Artificial Sequence
  Synthetic oligonucleotide
gtcaccctaaccgtattctccaccgtgccttacttga

SEQ ID NO: 330 - DNA, 35 bp, Artificial Sequence
  Synthetic oligonucleotide
gatagaattgagctctactgtgcctatctggttat

SEQ ID NO: 331 - DNA, 35 bp, Artificial Sequence
  Synthetic oligonucleotide
gtccaaattagctctctactgtgcctatccgttaa

SEQ ID NO: 332 - DNA, 37 bp, Artificial Sequence
  Synthetic oligonucleotide
gcgcacttgttcttcttggtcgcggcgtgccacgcga

SEQ ID NO: 333 - DNA, 36 bp, Artificial Sequence
  Synthetic oligonucleotide
gcggtcagagctaattctgtcaactcgccctttcta

SEQ ID NO: 334 - DNA, 36 bp, Artificial Sequence
  Synthetic oligonucleotide
gagcggaactagcgatgcgtacaaggttaatttcta

SEQ ID NO: 335 - DNA, 35 bp, Artificial Sequence
  Synthetic oligonucleotide
aacactctactgtgcctccacgatattttcatact

SEQ ID NO: 336 - DNA, 35 bp, Artificial Sequence
  Synthetic oligonucleotide
gtagtgatgccacctcaactgtgcccttgttttct

SEQ ID NO: 337 - DNA, 36 bp, Artificial Sequence
  Synthetic oligonucleotide
ttcctgcagttctattctctactgtgccctttgtta

SEQ ID NO: 338 - DNA, 37 bp, Artificial Sequence
  Synthetic oligonucleotide
gactgctctcatagtatgaactccactgtgcccttga

SEQ ID NO: 339 - DNA, 38 bp, Artificial Sequence
  Synthetic oligonucleotide
accatgcgcgcaaccttctctaccgtgcatctttttga

SEQ ID NO: 340 - DNA, 36 bp, Artificial Sequence
  Synthetic oligonucleotide
gcgttatacctccactgtgctcaattttcatctaaa

SEQ ID NO: 341 - DNA, 38 bp, Artificial Sequence
  Synthetic oligonucleotide
acgcgtgcctggtttactgcagacgagccccttcatga

SEQ ID NO: 342 - DNA, 38 bp, Artificial Sequence
  Synthetic oligonucleotide
gcacacacactttactctaccgtgccattttgaagtga

SEQ ID NO: 343 - DNA, 38 bp, Artificial Sequence
  Synthetic oligonucleotide
atctgcgggcatccatagataatactctactgtgctga

SEQ ID NO: 344 - DNA, 35 bp, Artificial Sequence
  Synthetic oligonucleotide
aaatcattcctgtggtctctctaccgtgccaatat

SEQ ID NO: 345 - DNA, 36 bp, Artificial Sequence
  Synthetic oligonucleotide
gccataacctatctctactgtgctaaaccggttaca

SEQ ID NO: 346 - DNA, 38 bp, Artificial Sequence
  Synthetic oligonucleotide
gcgactctacggaaatttgggatctctaccgtgcctga

SEQ ID NO: 347 - DNA, 35 bp, Artificial Sequence
  Synthetic oligonucleotide
acctctactgtgccgattccattgttcttccactc

SEQ ID NO: 348 - DNA, 35 bp, Artificial Sequence
  Synthetic oligonucleotide
gcgaccaagccattccaaactagccctgatttcaa

SEQ ID NO: 349 - DNA, 36 bp, Artificial Sequence
  Synthetic oligonucleotide
ctgtacggctgtctgggcctagtattcccgctttaa

SEQ ID NO: 350 - DNA, 36 bp, Artificial Sequence
  Synthetic oligonucleotide
gggaactgcaggttaaactctactgtgctatgttta

SEQ ID NO: 351 - DNA, 36 bp, Artificial Sequence
  Synthetic oligonucleotide
gcgtgggttcctctaccgtgccgaggttgttcctaa

SEQ ID NO: 352 - DNA, 38 bp, Artificial Sequence
  Synthetic oligonucleotide
tcgcggtcagcaattctccaccgtgcgattacctttga

SEQ ID NO: 353 - DNA, 36 bp, Artificial Sequence
  Synthetic oligonucleotide
tacacgtcaccttactctactgtgccgtaatcctca

SEQ ID NO: 354 - DNA, 38 bp, Artificial Sequence
  Synthetic oligonucleotide
atgcactgtacgcaggtcacgcgttttaccactactga

SEQ ID NO: 355 - DNA, 38 bp, Artificial Sequence
  Synthetic oligonucleotide
gttgcgtgctaacacacgtgactgcctatttcctatga

SEQ ID NO: 356 - DNA, 38 bp, Artificial Sequence
  Synthetic oligonucleotide
gctactgcgataactctaccgtgccactcccttgttga

SEQ ID NO: 357 - DNA, 36 bp, Artificial Sequence
  Synthetic oligonucleotide
tatccaaccactagtaagcctccaccgtgccattta

SEQ ID NO: 358 - DNA, 37 bp, Artificial Sequence
  Synthetic oligonucleotide
gctagttaccagtaacctctaccgtgcctcttctgga

SEQ ID NO: 359 - DNA, 36 bp, Artificial Sequence
  Synthetic oligonucleotide
cggcgaactcctctgtagcagtcgtgcggttcataa

SEQ ID NO: 360 - DNA, 35 bp, Artificial Sequence
  Synthetic oligonucleotide
aactgcgtgcctagtacggacttgcacccttgtgg

SEQ ID NO: 361 - DNA, 35 bp, Artificial Sequence
  Synthetic oligonucleotide
gcaggatccgttctttcaactcgcctatttctgga

SEQ ID NO: 362 - DNA, 35 bp, Artificial Sequence
  Synthetic oligonucleotide
actgcgaagccttgcatccaattactctactgtgc

SEQ ID NO: 363 - DNA, 35 bp, Artificial Sequence
  Synthetic oligonucleotide
gcgataatcttgtcattactctaccgtgccgttta

SEQ ID NO: 364 - DNA, 36 bp, Artificial Sequence
  Synthetic oligonucleotide
atgccggcctattactacctaactctactgtgctta

SEQ ID NO: 365 - DNA, 37 bp, Artificial Sequence
  Synthetic oligonucleotide
gcgatcaagcgtatttcttcttacctctactgtgcga

SEQ ID NO: 366 - DNA, 38 bp, Artificial Sequence
  Synthetic oligonucleotide
gatgacacgccctttccactccactgtgcctgttttga

SEQ ID NO: 367 - DNA, 36 bp, Artificial Sequence
  Synthetic oligonucleotide
tacatactccactgtgccacctttcccgactttcca

SEQ ID NO: 368 - DNA, 35 bp, Artificial Sequence
  Synthetic oligonucleotide
catgcaagattttgcgtaacttaattaattgcttt

SEQ ID NO: 369 - DNA, 35 bp, Artificial Sequence
  Synthetic oligonucleotide
gcactatatccgtacctaaacctccactgtgcttt

SEQ ID NO: 370 - DNA, 35 bp, Artificial Sequence
  Synthetic oligonucleotide
gcgctataactccgatgtattctccaccgtgccca

SEQ ID NO: 371 - DNA, 36 bp, Artificial Sequence
  Synthetic oligonucleotide
atcgtagtgctgcaggaaacgagattgatgcaccca

SEQ ID NO: 372 - DNA, 35 bp, Artificial Sequence
  Synthetic oligonucleotide
tgcgagtgggatttcgtccgacacctcaccatgca

SEQ ID NO: 373 - DNA, 35 bp, Artificial Sequence
  Synthetic oligonucleotide
agggtcatctagaacggttgacacgaaccgttgct

SEQ ID NO: 374 - DNA, 35 bp, Artificial Sequence
  Synthetic oligonucleotide
gctaggaaaggacccaaatctctactgtgcctacc

SEQ ID NO: 375 - DNA, 35 bp, Artificial Sequence
  Synthetic oligonucleotide
gcgaggaatacctatctctactgtgccaccaaacg

SEQ ID NO: 376 - DNA, 36 bp, Artificial Sequence
  Synthetic oligonucleotide
gccgtttactctaccgtgccgtatcgatttccatta

SEQ ID NO: 377 - DNA, 35 bp, Artificial Sequence
  Synthetic oligonucleotide
aggtcgtgcgtcccgttcaactagccctgttctca

SEQ ID NO: 378 - DNA, 35 bp, Artificial Sequence
  Synthetic oligonucleotide
cattgcgttctggctttcgttcattttcgctttac

SEQ ID NO: 379 - DNA, 35 bp, Artificial Sequence
  Synthetic oligonucleotide
gcactcatcgcggattatctccaccgtgccgacct

SEQ ID NO: 380 - DNA, 35 bp, Artificial Sequence
  Synthetic oligonucleotide
catgccagctttaactttgagatctgttagttttc

SEQ ID NO: 381 - DNA, 36 bp, Artificial Sequence
  Synthetic oligonucleotide
gccaggatctcaactgtgccattgcctttttctgaa

SEQ ID NO: 382 - DNA, 38 bp, Artificial Sequence
  Synthetic oligonucleotide
ttacctccaccgtgccaatcactgtttgatcgccttga

SEQ ID NO: 383 - DNA, 36 bp, Artificial Sequence
  Synthetic oligonucleotide
taacctaccaagtccaatttggagtctctacgatta

SEQ ID NO: 384 - DNA, 35 bp, Artificial Sequence
  Synthetic oligonucleotide
gcctcaacttgagtttctatcattctccactgtgc

SEQ ID NO: 385 - DNA, 37 bp, Artificial Sequence
  Synthetic oligonucleotide
catagctgcatactctaccgtgcactcattccctaga

SEQ ID NO: 386 - DNA, 37 bp, Artificial Sequence
  Synthetic oligonucleotide
gacatcaactgcgaactcccctgagtgtgatatcgga

SEQ ID NO: 387 - DNA, 35 bp, Artificial Sequence
  Synthetic oligonucleotide
tatctccaccgtgcccgttaataatctgatctgaa

SEQ ID NO: 388 - DNA, 36 bp, Artificial Sequence
  Synthetic oligonucleotide
tgcgtgccaaacggactcaaggtaccatgcatcaca

SEQ ID NO: 389 - DNA, 36 bp, Artificial Sequence
  Synthetic oligonucleotide
acatagactgccgagcgttcttctctaccgtgccca

SEQ ID NO: 390 - DNA, 36 bp, Artificial Sequence
  Synthetic oligonucleotide
atgaccgaggtacccgacggcctcataggatccata

SEQ ID NO: 391 - DNA, 35 bp, Artificial Sequence
  Synthetic oligonucleotide
gcggttatggggttctcaactgtgccaatctccat

SEQ ID NO: 392 - DNA, 35 bp, Artificial Sequence
  Synthetic oligonucleotide
gggtcatgcgatttctttgttcactcaactcgccc

SEQ ID NO: 393 - DNA, 37 bp, Artificial Sequence
  Synthetic oligonucleotide
gctgttgcgtccatatctccactgtgcttttggttga

SEQ ID NO: 394 - DNA, 35 bp, Artificial Sequence
  Synthetic oligonucleotide
atgcgtgccaatacgacgtcaggccatgaagccat

SEQ ID NO: 395 - DNA, 36 bp, Artificial Sequence
  Synthetic oligonucleotide
atgaactggtggacctttatcctctactgtgcaaaa

SEQ ID NO: 396 - DNA, 35 bp, Artificial Sequence
  Synthetic oligonucleotide
ccgcgtgcctggaccttgcacgacatgcggcaata

SEQ ID NO: 397 - DNA, 38 bp, Artificial Sequence
  Synthetic oligonucleotide
tctgcgggctagtatctaatgatctctaccgtgcttga

SEQ ID NO: 398 - DNA, 34 bp, Artificial Sequence
  Synthetic oligonucleotide
catgcggaggcttttaacaccatgcattctcacc

SEQ ID NO: 399 - DNA, 37 bp, Artificial Sequence
  Synthetic oligonucleotide
ttacgtatctgagcgctagtaccagtacctcgagtga

SEQ ID NO: 400 - DNA, 35 bp, Artificial Sequence
  Synthetic oligonucleotide
agtcaggcccgcttttatttttgtggttatttttg

SEQ ID NO: 401 - DNA, 38 bp, Artificial Sequence
  Synthetic oligonucleotide
cttgccctccgacatgaactctactgtgcaacctatga

SEQ ID NO: 402 - DNA, 32 bp, Artificial Sequence
  Synthetic oligonucleotide
atcgcgtgccagaacgtaactcgcccatcgac

SEQ ID NO: 403 - DNA, 35 bp, Artificial Sequence
  Synthetic oligonucleotide
tgacgcgtgcttggcaacgtggcaggacaattatt

SEQ ID NO: 404 - DNA, 36 bp, Artificial Sequence
  Synthetic oligonucleotide
accgcgtgattggaagatactgcgtcttcgatttaa

SEQ ID NO: 405 - DNA, 35 bp, Artificial Sequence
  Synthetic oligonucleotide
gtgtgctgaccttagcaaccgaactgaggccctac

SEQ ID NO: 406 - DNA, 36 bp, Artificial Sequence
  Synthetic oligonucleotide
gcgcgccaaggtactgcggatagcgcattggacaca

SEQ ID NO: 407 - DNA, 35 bp, Artificial Sequence
  Synthetic oligonucleotide
taccgacgcgctattttctactctactgtgctcat

SEQ ID NO: 408 - DNA, 35 bp, Artificial Sequence
  Synthetic oligonucleotide
aaccgaacgtccgataaactcgccctactaatact

SEQ ID NO: 409 - DNA, 35 bp, Artificial Sequence
  Synthetic oligonucleotide
accaggtccactttcggtgatagaccctgcacaca

SEQ ID NO: 410 - DNA, 35 bp, Artificial Sequence
  Synthetic oligonucleotide
taaattgcccgtttgttctctactgtgccactccg

SEQ ID NO: 411 - DNA, 38 bp, Artificial Sequence
  Synthetic oligonucleotide
gccaccttgactctgatccaactctactgtgccattga

SEQ ID NO: 412 - DNA, 38 bp, Artificial Sequence
  Synthetic oligonucleotide
cgtgccaccgctggcttcctacttcgctttaactatga

SEQ ID NO: 413 - DNA, 35 bp, Artificial Sequence
  Synthetic oligonucleotide
tgttctctactgtgcccgataacacgcttttgttc

SEQ ID NO: 414 - DNA, 36 bp, Artificial Sequence
  Synthetic oligonucleotide
ctggtgctgcaccgtgtcacctatctttacgcatta

SEQ ID NO: 415 - DNA, 36 bp, Artificial Sequence
  Synthetic oligonucleotide
atcgtagtacgaagctagccataacctgttatctca

SEQ ID NO: 416 - DNA, 38 bp, Artificial Sequence
  Synthetic oligonucleotide
gcgtgttttatctctactgtgcgaacgtttggaattga

SEQ ID NO: 417 - DNA, 38 bp, Artificial Sequence
  Synthetic oligonucleotide
agctaggggtatctctactgtgcgattcttccgggtga

SEQ ID NO: 418 - DNA, 36 bp, Artificial Sequence
  Synthetic oligonucleotide
cgtgcccgctttattctccctggcttattggtccca

SEQ ID NO: 419 - DNA, 38 bp, Artificial Sequence
  Synthetic oligonucleotide
gatgcgccgctttacactcttgttcttacccgctttga

SEQ ID NO: 420 - DNA, 35 bp, Artificial Sequence
  Synthetic oligonucleotide
ggggcatgtaccaaccgttatttactctactgtgc

SEQ ID NO: 421 - DNA, 35 bp, Artificial Sequence
  Synthetic oligonucleotide
gcatcgtgtccatgcccaaatggttcgtcttttta

SEQ ID NO: 422 - DNA, 38 bp, Artificial Sequence
  Synthetic oligonucleotide
atgcactggacgcgcatgtcgtttcatttctccattga

SEQ ID NO: 423 - DNA, 34 bp, Artificial Sequence
  Synthetic oligonucleotide
aagcacgggctgcattcgattcaggtaaacaatt

SEQ ID NO: 424 - DNA, 37 bp, Artificial Sequence
  Synthetic oligonucleotide
acacccgcatgaggtatcctgtggatcgtgggacgga

SEQ ID NO: 425 - DNA, 35 bp, Artificial Sequence
  Synthetic oligonucleotide
gccagctttcgttcatataccactatcgctttgta

SEQ ID NO: 426 - DNA, 38 bp, Artificial Sequence
  Synthetic oligonucleotide
acagtcataacagactccgctgcgtgctaagcggatga

SEQ ID NO: 427 - DNA, 36 bp, Artificial Sequence
  Synthetic oligonucleotide
gcgcgctaacgggtatctgcaggtcctactagttta

SEQ ID NO: 428 - DNA, 35 bp, Artificial Sequence
  Synthetic oligonucleotide
atgcacctgtctgtcagtccccgctaggccatatt

SEQ ID NO: 429 - DNA, 38 bp, Artificial Sequence
  Synthetic oligonucleotide
ccatgcgcccggttgagatttaacggatctcgctttga

SEQ ID NO: 430 - DNA, 35 bp, Artificial Sequence
  Synthetic oligonucleotide
gcacacctcgctttaacacttgtaactacgcttca

SEQ ID NO: 431 - DNA, 35 bp, Artificial Sequence
  Synthetic oligonucleotide
tcacctactaaggactgatagctgcctacattgtt

SEQ ID NO: 432 - DNA, 36 bp, Artificial Sequence
  Synthetic oligonucleotide
ccacgagtctaggggcgtaacgcagtaaggcataca

SEQ ID NO: 433 - DNA, 38 bp, Artificial Sequence
  Synthetic oligonucleotide
acatgcgtgctaaggtactactggtgtcgaacctttga

SEQ ID NO: 434 - DNA, 35 bp, Artificial Sequence
  Synthetic oligonucleotide
atcgtagtacatacagtgcgtttcgtaaattgcct

SEQ ID NO: 435 - DNA, 35 bp, Artificial Sequence
  Synthetic oligonucleotide
gcgccccgactgccactagcttttaattctcgctt

SEQ ID NO: 436 - DNA, 36 bp, Artificial Sequence
  Synthetic oligonucleotide
tgctagctggcccatactcaactgtgcgttactcaa

SEQ ID NO: 437 - DNA, 35 bp, Artificial Sequence
  Synthetic oligonucleotide
actctgcatccttcaactctactgtgcggttattt

SEQ ID NO: 438 - DNA, 38 bp, Artificial Sequence
  Synthetic oligonucleotide
gctaactgcagggcacacaatctcttaaggcttaatga

SEQ ID NO: 439 - DNA, 35 bp, Artificial Sequence
  Synthetic oligonucleotide
gcgtgggcctggtctttactactaaacaaattggt

SEQ ID NO: 440 - DNA, 35 bp, Artificial Sequence
  Synthetic oligonucleotide
gatcgtaacgcactgagggtcaggcattacccgcc

SEQ ID NO: 441 - DNA, 37 bp, Artificial Sequence
  Synthetic oligonucleotide
gcccggggctaggggaaagaacctgccggtcatggga

SEQ ID NO: 442 - DNA, 35 bp, Artificial Sequence
  Synthetic oligonucleotide
gcgacctagggtaacgatcgtagttcacccataat

SEQ ID NO: 443 - DNA, 36 bp, Artificial Sequence
  Synthetic oligonucleotide
ttacctaccacagtctccgcctcgttatccttatca

SEQ ID NO: 444 - DNA, 36 bp, Artificial Sequence
  Synthetic oligonucleotide
gccgcgtgcctggccgtggtgcatcactaagttgaa

SEQ ID NO: 445 - DNA, 35 bp, Artificial Sequence
  Synthetic oligonucleotide
ggcgcgcgctagccatacgaactgcttgaacattt

SEQ ID NO: 446 - DNA, 37 bp, Artificial Sequence
  Synthetic oligonucleotide
tgcgaatcgtagccatcgtccactgctgatttgcgga

SEQ ID NO: 447 - DNA, 36 bp, Artificial Sequence
  Synthetic oligonucleotide
gcgaccgattcttctctcaaacgcttacttctatga

SEQ ID NO: 448 - DNA, 35 bp, Artificial Sequence
  Synthetic oligonucleotide
gccaaatgatctccactgtgcgaaatgggcttttt

SEQ ID NO: 449 - DNA, 38 bp, Artificial Sequence
  Synthetic oligonucleotide
tgagcacacaatggacgtgacaccaatctttcttatga

SEQ ID NO: 450 - DNA, 36 bp, Artificial Sequence
  Synthetic oligonucleotide
tcatcacgcgctagtgaacgtgttgtagcaccccta

SEQ ID NO: 451 - DNA, 36 bp, Artificial Sequence
  Synthetic oligonucleotide
tcatgtgcgtgccaactgacgaggtgcaggctagcc

SEQ ID NO: 452 - DNA, 38 bp, Artificial Sequence
  Synthetic oligonucleotide
atcgtagctgctgcagtcccctgtcttaatatccctga

SEQ ID NO: 453 - DNA, 36 bp, Artificial Sequence
  Synthetic oligonucleotide
cgtatcgtagacgttacggaaggagataatgcgcaa

SEQ ID NO: 454 - DNA, 36 bp, Artificial Sequence
  Synthetic oligonucleotide
cttgccagctttccttgtcttcgctttcattacata

SEQ ID NO: 455 - DNA, 38 bp, Artificial Sequence
  Synthetic oligonucleotide
gctgtcattgaatctctactgtgcgatccactttttga

SEQ ID NO: 456 - DNA, 38 bp, Artificial Sequence
  Synthetic oligonucleotide
catgcgccagcttcttctgattttatctatctctatga

SEQ ID NO: 457 - DNA, 36 bp, Artificial Sequence
  Synthetic oligonucleotide
ccatgcccgcttaagcttcttttctatgtttctacg

SEQ ID NO: 458 - DNA, 35 bp, Artificial Sequence
  Synthetic oligonucleotide
tagcaggagtaccctccaccgtgcacattgtttcc

SEQ ID NO: 459 - DNA, 37 bp, Artificial Sequence
  Synthetic oligonucleotide
catgcccgctttgtttctccgctttttggtattccga

SEQ ID NO: 460 - DNA, 36 bp, Artificial Sequence
  Synthetic oligonucleotide
atgcacgtcgaaaggcatgcggtacaactcctatga

SEQ ID NO: 461 - DNA, 35 bp, Artificial Sequence
  Synthetic oligonucleotide
agacagcaggcatagcggggaacctctaccgtgcc

SEQ ID NO: 462 - DNA, 35 bp, Artificial Sequence
  Synthetic oligonucleotide
aagtaacgcgggttacaactttttctccaccgtgc

SEQ ID NO: 463 - DNA, 36 bp, Artificial Sequence
  Synthetic oligonucleotide
acagtctcatgcccgcttttaatcataccgcttaca

SEQ ID NO: 464 - DNA, 38 bp, Artificial Sequence
  Synthetic oligonucleotide
gcgcccgaccattccctaagcttttgaccccactatga

SEQ ID NO: 465 - DNA, 37 bp, Artificial Sequence
  Synthetic oligonucleotide
gcgacgactatcgcttgttcttgaatacctcgcttta

SEQ ID NO: 466 - DNA, 34 bp, Artificial Sequence
  Synthetic oligonucleotide
aaactctactgtgcctcagtttcaaaccggttct

SEQ ID NO: 467 - DNA, 35 bp, Artificial Sequence
  Synthetic oligonucleotide
gtcgtagtactgcgaaatgggccatgcgcaaactt

SEQ ID NO: 468 - DNA, 35 bp, Artificial Sequence
  Synthetic oligonucleotide
cgtgcggatttctccaccgtgcttttgacctctga

SEQ ID NO: 469 - DNA, 38 bp, Artificial Sequence
  Synthetic oligonucleotide
gactgcgacctacacttatttgctctactgtgccttga

SEQ ID NO: 470 - DNA, 35 bp, Artificial Sequence
  Synthetic oligonucleotide
catgcggcttctaccaggtcaaactagccccaatt

SEQ ID NO: 471 - DNA, 36 bp, Artificial Sequence
  Synthetic oligonucleotide
aaccggagctaggtacgtgtctgtcaggcatgaaga

SEQ ID NO: 472 - DNA, 36 bp, Artificial Sequence
  Synthetic oligonucleotide
atgagtccgcgtgcctggacctttacccccgacgaa

SEQ ID NO: 473 - DNA, 38 bp, Artificial Sequence
  Synthetic oligonucleotide
catgccgtacgcttattggatacaccatcgctttttga

SEQ ID NO: 474 - DNA, 37 bp, Artificial Sequence
  Synthetic oligonucleotide
gcgttggtgttcctctctactgtgcctgattttttga

SEQ ID NO: 475 - DNA, 37 bp, Artificial Sequence
  Synthetic oligonucleotide
atcgtagtactgcacgggtgccacgtgtcttcccaga

SEQ ID NO: 476 - DNA, 35 bp, Artificial Sequence
  Synthetic oligonucleotide
aggcacgtacaggcatcgaccgctttcttctttcc

SEQ ID NO: 477 - DNA, 36 bp, Artificial Sequence
  Synthetic oligonucleotide
gccatgcgggataatattaaatcctctaccgtgcca

SEQ ID NO: 478 - DNA, 37 bp, Artificial Sequence
  Synthetic oligonucleotide
tctgccatgcggctcattccgaaactctactgtgcga

SEQ ID NO: 479 - DNA, 35 bp, Artificial Sequence
  Synthetic oligonucleotide
ttttgcgattcctctactgtgccttctggttttgt

SEQ ID NO: 480 - DNA, 35 bp, Artificial Sequence
  Synthetic oligonucleotide
ctgcagcaatcatgcaggctttcatcgctttcatc

SEQ ID NO: 481 - DNA, 35 bp, Artificial Sequence
  Synthetic oligonucleotide
tcacctaccaagatctctcgcgccctatagtttct

SEQ ID NO: 482 - DNA, 35 bp, Artificial Sequence
  Synthetic oligonucleotide
caccgcgtgccaggggatcggaatgatatcaactg

SEQ ID NO: 483 - DNA, 36 bp, Artificial Sequence
  Synthetic oligonucleotide
taaactaccaagggcatgccaccatctactacatga

SEQ ID NO: 484 - DNA, 35 bp, Artificial Sequence
  Synthetic oligonucleotide
atcgtagtactgaaaagcgggatccagttctaatt

SEQ ID NO: 485 - DNA, 35 bp, Artificial Sequence
  Synthetic oligonucleotide
gaaggcaagcacccccctgctcaactagccaacaa

SEQ ID NO: 486 - DNA, 38 bp, Artificial Sequence
  Synthetic oligonucleotide
ctgccctcgttctccaccgtgcccactttgtaaactga

SEQ ID NO: 487 - DNA, 36 bp, Artificial Sequence
  Synthetic oligonucleotide
gatgcaagggcccgttagtactggggtctaattaaa

SEQ ID NO: 488 - DNA, 38 bp, Artificial Sequence
  Synthetic oligonucleotide
catgcgatggtcttgcacttggttagtaatctccttga

SEQ ID NO: 489 - DNA, 35 bp, Artificial Sequence
  Synthetic oligonucleotide
gtgcgcgctaacacggagagtctcaacttaacctg

SEQ ID NO: 490 - DNA, 36 bp, Artificial Sequence
  Synthetic oligonucleotide
aacaaattgccgtggggacgtggtcatgcggattta

SEQ ID NO: 491 - DNA, 36 bp, Artificial Sequence
  Synthetic oligonucleotide
gcgtggcacgaagctttctatttttacttgattcca

SEQ ID NO: 492 - DNA, 35 bp, Artificial Sequence
  Synthetic oligonucleotide
caatgccagcttacgtttatatcccaattcgcttt

SEQ ID NO: 493 - DNA, 35 bp, Artificial Sequence
  Synthetic oligonucleotide
aacggtcatgccagcttttggtacttagttctcct

SEQ ID NO: 494 - DNA, 37 bp, Artificial Sequence
  Synthetic oligonucleotide
gaacgcaggcatccgcattagctttttccttctatga

SEQ ID NO: 495 - DNA, 36 bp, Artificial Sequence
  Synthetic oligonucleotide
gcgccccgtacagcatcgtgtcatggacctacccta

SEQ ID NO: 496 - DNA, 37 bp, Artificial Sequence
  Synthetic oligonucleotide
tcgtagtaactgcaggatccactccactctcatttga

SEQ ID NO: 497 - DNA, 35 bp, Artificial Sequence
  Synthetic oligonucleotide
atgcactgtacgagcgggatcgctagtttacaaca

SEQ ID NO: 498 - DNA, 35 bp, Artificial Sequence
  Synthetic oligonucleotide
gcgcgctaacgtcactgcacatccagggccctatc

SEQ ID NO: 499 - DNA, 38 bp, Artificial Sequence
  Synthetic oligonucleotide
acccgatcgtagggaacgtaccgataacaaaattatga

SEQ ID NO: 500 - DNA, 36 bp, Artificial Sequence
  Synthetic oligonucleotide
actggtaggcatcgacctcaagctttctcaacatca

SEQ ID NO: 501 - DNA, 35 bp, Artificial Sequence
  Synthetic oligonucleotide
acacctaccaggtcacgcgttcgaacttcacttaa

SEQ ID NO: 502 - DNA, 35 bp, Artificial Sequence
  Synthetic oligonucleotide
accgcgcgctagggacgggatgcttcggcctgtta

SEQ ID NO: 503 - DNA, 35 bp, Artificial Sequence
  Synthetic oligonucleotide
taagcaactagggtgctgtcatcgcgatctctttt

SEQ ID NO: 504 - DNA, 35 bp, Artificial Sequence
  Synthetic oligonucleotide
atcccgggactagggcgacgtgatgcatctctcat

SEQ ID NO: 505 - DNA, 35 bp, Artificial Sequence
  Synthetic oligonucleotide
gacaaggtctgcccgcttcccacactacgcttaca

SEQ ID NO: 506 - DNA, 36 bp, Artificial Sequence
  Synthetic oligonucleotide
gcgcccgcttctcataactatggctttattctcaca

SEQ ID NO: 507 - DNA, 36 bp, Artificial Sequence
  Synthetic oligonucleotide
tgctccgggcctaggagattctacgtacgcaatgca

SEQ ID NO: 508 - DNA, 36 bp, Artificial Sequence
  Synthetic oligonucleotide
gccagactcgccccctatttttttggaactcgccta

SEQ ID NO: 509 - DNA, 38 bp, Artificial Sequence
  Synthetic oligonucleotide
gcatccgttaaactcgcctctcaaatcgaatcccatga

SEQ ID NO: 510 - DNA, 35 bp, Artificial Sequence
  Synthetic oligonucleotide
ctcgcagcatgcgaaggctttactcacaactatcg

SEQ ID NO: 511 - DNA, 37 bp, Artificial Sequence
  Synthetic oligonucleotide
ccgtgcgaacgttatgcgaccatgcgctctctcttga

SEQ ID NO: 512 - DNA, 38 bp, Artificial Sequence
  Synthetic oligonucleotide
gtctagccgcttttgttatgatattcttctctttatga

SEQ ID NO: 513 - DNA, 36 bp, Artificial Sequence
  Synthetic oligonucleotide
gcgtgccaacgtaccttccttatctggtgaactaca

SEQ ID NO: 514 - DNA, 35 bp, Artificial Sequence
  Synthetic oligonucleotide
gtgcgcgctaacactcctctcggtcatttgctgga

SEQ ID NO: 515 - DNA, 35 bp, Artificial Sequence
  Synthetic oligonucleotide
agcgcgtgattgcacgtgactgcacttctaatctt

SEQ ID NO: 516 - DNA, 35 bp, Artificial Sequence
  Synthetic oligonucleotide
tccgaacctaggaagccggatggaacatgcgccca

SEQ ID NO: 517 - DNA, 35 bp, Artificial Sequence
  Synthetic oligonucleotide
catcgcaagctttaatacaaaccctatccattgct

SEQ ID NO: 518 - DNA, 36 bp, Artificial Sequence
  Synthetic oligonucleotide
actgcgtgccgagtacaggactacagttaatggcaa

SEQ ID NO: 519 - DNA, 35 bp, Artificial Sequence
  Synthetic oligonucleotide
ccatgcgtgcctatggacgtccccaaacattgtct

SEQ ID NO: 520 - DNA, 35 bp, Artificial Sequence
  Synthetic oligonucleotide
tatcgcgggcaggcgattcgcttgtatttaatccg

SEQ ID NO: 521 - DNA, 36 bp, Artificial Sequence
  Synthetic oligonucleotide
actgcaccgtgtcatggcgagagctcacctaattca

SEQ ID NO: 522 - DNA, 35 bp, Artificial Sequence
  Synthetic oligonucleotide
gacatgcaaaggcccttaattgactccactgtgcc

SEQ ID NO: 523 - DNA, 35 bp, Artificial Sequence
  Synthetic oligonucleotide
catttgcgtgcctaaatgcggcgcgggctggcgac

SEQ ID NO: 524 - DNA, 35 bp, Artificial Sequence
  Synthetic oligonucleotide
gctggccaatgtatctcaaccgtgccgaaattatt

SEQ ID NO: 525 - DNA, 35 bp, Artificial Sequence
  Synthetic oligonucleotide
tgctaggactagccggttttctattactctatttt

SEQ ID NO: 526 - DNA, 36 bp, Artificial Sequence
  Synthetic oligonucleotide
tccggagctaggaactacggcgatctctgcgcctaa

SEQ ID NO: 527 - DNA, 35 bp, Artificial Sequence
  Synthetic oligonucleotide
gcctagtggacaccccgattcgaccttttttgctt

SEQ ID NO: 528 - DNA, 36 bp, Artificial Sequence
  Synthetic oligonucleotide
agtggaccaacggatcgcgtgccaggccgatgggca

SEQ ID NO: 529 - DNA, 36 bp, Artificial Sequence
  Synthetic oligonucleotide
gataaccagtgtcatgcaaacactatacattcctta

SEQ ID NO: 530 - DNA, 35 bp, Artificial Sequence
  Synthetic oligonucleotide
actgcacaacattgattctgacaggttgacaccaa

SEQ ID NO: 531 - DNA, 38 bp, Artificial Sequence
  Synthetic oligonucleotide
agtgcgcaatagtgcgacaagcttctatccatttttga

SEQ ID NO: 532 - DNA, 36 bp, Artificial Sequence
  Synthetic oligonucleotide
gctgacgttcgtagtccatgtacgggctgtcatcaa

SEQ ID NO: 533 - DNA, 36 bp, Artificial Sequence
  Synthetic oligonucleotide
tcgtgcagtatcgcggtcatgtcacactcccgtaca

SEQ ID NO: 534 - DNA, 36 bp, Artificial Sequence
  Synthetic oligonucleotide
agcacgatcgtagtgcgaatcgaacggggtctgcga

SEQ ID NO: 535 - DNA, 36 bp, Artificial Sequence
  Synthetic oligonucleotide
gcgcgctaacgactgtaggaatccaattctgaccga

SEQ ID NO: 536 - DNA, 38 bp, Artificial Sequence
  Synthetic oligonucleotide
agtgactgcgggcactgcgatcgcttttgattatttga

SEQ ID NO: 537 - DNA, 36 bp, Artificial Sequence
  Synthetic oligonucleotide
agccacccatcctcaaccgtgccataatcgcctcta

SEQ ID NO: 538 - DNA, 35 bp, Artificial Sequence
  Synthetic oligonucleotide
gcctctaccgtgcctgtgacccaccagttttttat

SEQ ID NO: 539 - DNA, 35 bp, Artificial Sequence
  Synthetic oligonucleotide
tcgtagtacgcaggtggtcaagcacgatttcttta

SEQ ID NO: 540 - DNA, 38 bp, Artificial Sequence
  Synthetic oligonucleotide
tcagtacgcactagtacattgccaagctttccacatga

SEQ ID NO: 541 - DNA, 35 bp, Artificial Sequence
  Synthetic oligonucleotide
aagcggaactagccaaggcaagggaaatgccctca

SEQ ID NO: 542 - DNA, 35 bp, Artificial Sequence
  Synthetic oligonucleotide
ggaccgaatctaggctgtactgtgcacgcatcgcc

SEQ ID NO: 543 - DNA, 35 bp, Artificial Sequence
  Synthetic oligonucleotide
ttacctacctggtcaggcataacatttagttcctc

SEQ ID NO: 544 - DNA, 38 bp, Artificial Sequence
  Synthetic oligonucleotide
aagaccgcgtgccaggtcaacgtacgcacatgcaatga

SEQ ID NO: 545 - DNA, 38 bp, Artificial Sequence
  Synthetic oligonucleotide
atcgtagtactgtagggcctctgtttcactcaatatga

SEQ ID NO: 546 - DNA, 35 bp, Artificial Sequence
  Synthetic oligonucleotide
aggacaggcgggttttgctgacgttgtctatactg

SEQ ID NO: 547 - DNA, 35 bp, Artificial Sequence
  Synthetic oligonucleotide
tactccactgtgcatccgatcttcttccccaactc

SEQ ID NO: 548 - DNA, 37 bp, Artificial Sequence
  Synthetic oligonucleotide
tctccactgtgcccgtaacttttcttttactgtccga

SEQ ID NO: 549 - DNA, 36 bp, Artificial Sequence
  Synthetic oligonucleotide
ccgggcctaggaggactgcatgacccctttaaccaa

SEQ ID NO: 550 - DNA, 35 bp, Artificial Sequence
  Synthetic oligonucleotide
ccgggcctaggacggttccacagtcagcgaatcct

SEQ ID NO: 551 - DNA, 35 bp, Artificial Sequence
  Synthetic oligonucleotide
aacgcgcgcttgggatgtatgcatcatctagattt

SEQ ID NO: 552 - DNA, 35 bp, Artificial Sequence
  Synthetic oligonucleotide
cacgacgcaccttaccgctttctatttttccgctt

SEQ ID NO: 553 - DNA, 35 bp, Artificial Sequence
  Synthetic oligonucleotide
gcacttggccgctttaactactacgctttgtcctc

SEQ ID NO: 554 - DNA, 37 bp, Artificial Sequence
  Synthetic oligonucleotide
cgtgtacgccagtgccgtgcagtcaggcgatctatga

SEQ ID NO: 555 - DNA, 36 bp, Artificial Sequence
  Synthetic oligonucleotide
cttaggcaatgacgtgcccttatgcgacttcgccca

SEQ ID NO: 556 - DNA, 38 bp, Artificial Sequence
  Synthetic oligonucleotide
gcaccgtttccaccgcgcgtggatcttcccaactttga

SEQ ID NO: 557 - DNA, 35 bp, Artificial Sequence
  Synthetic oligonucleotide
gcggacctagcttacggactgtaattaacgttttt

SEQ ID NO: 558 - DNA, 38 bp, Artificial Sequence
  Synthetic oligonucleotide
atgcgcatcccctctaccgtgcaattttccatccctga

SEQ ID NO: 559 - DNA, 36 bp, Artificial Sequence
  Synthetic oligonucleotide
gacgcgcgccagacagggaactgcacaggcatgcca

SEQ ID NO: 560 - DNA, 35 bp, Artificial Sequence
  Synthetic oligonucleotide
ccgagactaggacccctgtgttcatgcgctatttc

SEQ ID NO: 561 - DNA, 35 bp, Artificial Sequence
  Synthetic oligonucleotide
gctaactgcaggcacagcctaagaaacctcatgta

SEQ ID NO: 562 - DNA, 38 bp, Artificial Sequence
  Synthetic oligonucleotide
tgcagtctagcccgcttaatgtattccttgattcttga

SEQ ID NO: 563 - DNA, 35 bp, Artificial Sequence
  Synthetic oligonucleotide
gcgtgctagcgtactgcatggatactttggtagct

SEQ ID NO: 564 - DNA, 38 bp, Artificial Sequence
  Synthetic oligonucleotide
tcgtagtacagcagaccctccctacctacaattggtga

SEQ ID NO: 565 - DNA, 35 bp, Artificial Sequence
  Synthetic oligonucleotide
gccgctgactgagttctctctactgtgcgtatttt

SEQ ID NO: 566 - DNA, 36 bp, Artificial Sequence
  Synthetic oligonucleotide
gccagcagccctgaactcctctgaagcatcgccgca

SEQ ID NO: 567 - DNA, 35 bp, Artificial Sequence
  Synthetic oligonucleotide
taggtctgcacatgcgctaggcttttcttaccctg

SEQ ID NO: 568 - DNA, 38 bp, Artificial Sequence
  Synthetic oligonucleotide
gcgacgccccacgctttgacctaaacccatcaatatga

SEQ ID NO: 569 - DNA, 38 bp, Artificial Sequence
  Synthetic oligonucleotide
cgctacagacatgcgcatcttgacttatattcaattga

SEQ ID NO: 570 - DNA, 35 bp, Artificial Sequence
  Synthetic oligonucleotide
atgcactactgcgagcgagcacaggtttcctcctt

SEQ ID NO: 571 - DNA, 38 bp, Artificial Sequence
  Synthetic oligonucleotide
aacgcgtgccagagaagaaccgcggtctcgccccatga

SEQ ID NO: 572 - DNA, 35 bp, Artificial Sequence
  Synthetic oligonucleotide
cattgcgaactagctttcttctccttctagctttt

SEQ ID NO: 573 - DNA, 35 bp, Artificial Sequence
  Synthetic oligonucleotide
catgccctagaacattgctttaacactttcgcttt

SEQ ID NO: 574 - DNA, 38 bp, Artificial Sequence
  Synthetic oligonucleotide
tcatgcgatcaatcgctctgcgtgcctagatcgattga

SEQ ID NO: 575 - DNA, 34 bp, Artificial Sequence
  Synthetic oligonucleotide
gcgaccgtggcttcctacctccaagctttccgac

SEQ ID NO: 576 - DNA, 36 bp, Artificial Sequence
  Synthetic oligonucleotide
gcgtgctaacgtactagaccaaagcgagtaacatca

SEQ ID NO: 577 - DNA, 37 bp, Artificial Sequence
  Synthetic oligonucleotide
tcacgcgcgcttgggattacgtacaatcatcaatgga

SEQ ID NO: 578 - DNA, 36 bp, Artificial Sequence
  Synthetic oligonucleotide
gcactacaccctattcccgcgtaggtccccgagcct

SEQ ID NO: 579 - DNA, 36 bp, Artificial Sequence
  Synthetic oligonucleotide
taactccactgtgcgatcattgtttttcttttttga

SEQ ID NO: 580 - DNA, 35 bp, Artificial Sequence
  Synthetic oligonucleotide
atcgtagtactggtactcctgccctatttcgataa

SEQ ID NO: 581 - DNA, 35 bp, Artificial Sequence
  Synthetic oligonucleotide
acactctgcagcctagaactctaccgtgctaattt

SEQ ID NO: 582 - DNA, 35 bp, Artificial Sequence
  Synthetic oligonucleotide
gtgcgcgcgctagcatgcgtaatcatgtcatttaa

SEQ ID NO: 583 - DNA, 35 bp, Artificial Sequence
  Synthetic oligonucleotide
tcaatctcaactgtgcttccctggtttttagtttc

SEQ ID NO: 584 - DNA, 38 bp, Artificial Sequence
  Synthetic oligonucleotide
gtcctgcgtgctaaggaccctaagcttcatgcgtatga

SEQ ID NO: 585 - DNA, 36 bp, Artificial Sequence
  Synthetic oligonucleotide
tcgccgcccaaggatccctctactgtgccactttaa

SEQ ID NO: 586 - DNA, 35 bp, Artificial Sequence
  Synthetic oligonucleotide
gcgtgcctacgtaacgttcatgcggatggaccgat

SEQ ID NO: 587 - DNA, 35 bp, Artificial Sequence
  Synthetic oligonucleotide
cgtgccttggccggaccagtccttttgatcactac

SEQ ID NO: 588 - DNA, 35 bp, Artificial Sequence
  Synthetic oligonucleotide
caggcatgacgatttggcttaacttcccttgctta

SEQ ID NO: 589 - DNA, 35 bp, Artificial Sequence
  Synthetic oligonucleotide
tatgcgtatccaatcgcttttcaattcctatgctt

SEQ ID NO: 590 - DNA, 35 bp, Artificial Sequence
  Synthetic oligonucleotide
ccgcgtgccaggcgtaatgtaggcaggccctttat

SEQ ID NO: 591 - DNA, 35 bp, Artificial Sequence
  Synthetic oligonucleotide
gctaacagcagtcattgaatcctgtacgctccaaa

SEQ ID NO: 592 - DNA, 35 bp, Artificial Sequence
  Synthetic oligonucleotide
atcgcctgcgccaggactggggtgcagatcatgcg

SEQ ID NO: 593 - DNA, 37 bp, Artificial Sequence
  Synthetic oligonucleotide
ctgagcagtcaccattctttatctctactgtgctcga

SEQ ID NO: 594 - DNA, 35 bp, Artificial Sequence
  Synthetic oligonucleotide
acccacatcctgcgtgctaaggacggtggggccgg

SEQ ID NO: 595 - DNA, 36 bp, Artificial Sequence
  Synthetic oligonucleotide
ccggacctaggaatcgactcaggcgtggtagaacaa

SEQ ID NO: 596 - DNA, 35 bp, Artificial Sequence
  Synthetic oligonucleotide
tcatggccactaaactcgccccataaaaccttgtc

SEQ ID NO: 597 - DNA, 35 bp, Artificial Sequence
  Synthetic oligonucleotide
gactctactgtgcccgtttgttgttcttcccgaac

SEQ ID NO: 598 - DNA, 36 bp, Artificial Sequence
  Synthetic oligonucleotide
ggagccgggcctgccacgtagctcggaaaatgcgga

SEQ ID NO: 599 - DNA, 37 bp, Artificial Sequence
  Synthetic oligonucleotide
gatttcactagctctctactgtgcccatttctgttga

SEQ ID NO: 600 - DNA, 35 bp, Artificial Sequence
  Synthetic oligonucleotide
agcggatctagccagtatgcactcatgtcactttt

SEQ ID NO: 601 - DNA, 35 bp, Artificial Sequence
  Synthetic oligonucleotide
actgcacgtgcgcgcttaagttttcgcttctcttt

SEQ ID NO: 602 - DNA, 38 bp, Artificial Sequence
  Synthetic oligonucleotide
gtcgaggggaactcctctgaggctcaacacatatctga

SEQ ID NO: 603 - DNA, 35 bp, Artificial Sequence
  Synthetic oligonucleotide
gcgatccggttaaactacacactctactgtgcgaa

SEQ ID NO: 604 - DNA, 35 bp, Artificial Sequence
  Synthetic oligonucleotide
gctaaccaaggaatgcgctgccttagacagaattg

SEQ ID NO: 605 - DNA, 35 bp, Artificial Sequence
  Synthetic oligonucleotide
tcacctaccagggcgtggtaggtttttctctctac

SEQ ID NO: 606 - DNA, 37 bp, Artificial Sequence
  Synthetic oligonucleotide
cctcgcgtgccagggacctagtgcaatctatccgaga

SEQ ID NO: 607 - DNA, 38 bp, Artificial Sequence
  Synthetic oligonucleotide
ccgagcgaacgtacggaaagtgcgtactttatctttga

SEQ ID NO: 608 - DNA, 36 bp, Artificial Sequence
  Synthetic oligonucleotide
agtacgtgaccactactttccctcctttgtacttga

SEQ ID NO: 609 - DNA, 38 bp, Artificial Sequence
  Synthetic oligonucleotide
tcatgcggttgattggtctactcatgtttcttaattga

SEQ ID NO: 610 - DNA, 36 bp, Artificial Sequence
  Synthetic oligonucleotide
gcacaatcccacgcttcctattataccacgattcta

SEQ ID NO: 611 - DNA, 35 bp, Artificial Sequence
  Synthetic oligonucleotide
acaacccggcgcgccacggggtgatcgacaactgt

SEQ ID NO: 612 - DNA, 35 bp, Artificial Sequence
  Synthetic oligonucleotide
gatcgtccgcgtgcctggcaacgatacccgacaag

SEQ ID NO: 613 - DNA, 35 bp, Artificial Sequence
  Synthetic oligonucleotide
gcgtgtctctctactgtgcgcctcattcttatata

SEQ ID NO: 614 - DNA, 35 bp, Artificial Sequence
  Synthetic oligonucleotide
tcgtagtacacgcagtcgacaaacaagctagtatt

SEQ ID NO: 615 - DNA, 36 bp, Artificial Sequence
  Synthetic oligonucleotide
ttacctaccaacgtaatgcgctacaaccagagagta

SEQ ID NO: 616 - DNA, 35 bp, Artificial Sequence
  Synthetic oligonucleotide
ttagcgaaactagcgtacgacaaggtccaatgtaa

SEQ ID NO: 617 - DNA, 36 bp, Artificial Sequence
  Synthetic oligonucleotide
tgggcggatctagcaaaaacggacgcctcctgcgaa

SEQ ID NO: 618 - DNA, 35 bp, Artificial Sequence
  Synthetic oligonucleotide
aagcacgggacgcatgtcgtggctacctgaattct

SEQ ID NO: 619 - DNA, 38 bp, Artificial Sequence
  Synthetic oligonucleotide
gtgtgcaggcatgacgataagctttctaactcctatga

SEQ ID NO: 620 - DNA, 35 bp, Artificial Sequence
  Synthetic oligonucleotide
tctgcgcgcctagaagtacgcaatcaccacgcgac

SEQ ID NO: 621 - DNA, 38 bp, Artificial Sequence
  Synthetic oligonucleotide
atgtcgctgcaggtgcgtgcaagctttaatctccttga

SEQ ID NO: 622 - DNA, 37 bp, Artificial Sequence
  Synthetic oligonucleotide
tccgggcctaggaacggtcactagggaatgcccctga

SEQ ID NO: 623 - DNA, 36 bp, Artificial Sequence
  Synthetic oligonucleotide
acgtagtgcacatcctagactccactgtgcctctta

SEQ ID NO: 624 - DNA, 35 bp, Artificial Sequence
  Synthetic oligonucleotide
tcatgcataggcttatatgacaccatcgcttcttt

SEQ ID NO: 625 - DNA, 36 bp, Artificial Sequence
  Synthetic oligonucleotide
actgccggctgcaagcttttaggtacacttgattca

SEQ ID NO: 626 - DNA, 38 bp, Artificial Sequence
  Synthetic oligonucleotide
cacgcgccgctttttcgcctatacgctttttattttga

SEQ ID NO: 627 - DNA, 37 bp, Artificial Sequence
  Synthetic oligonucleotide
tctgactgcacgcatgggaccgcttaccactaaccga

SEQ ID NO: 628 - DNA, 36 bp, Artificial Sequence
  Synthetic oligonucleotide
tgcgggactagcataagttccacatgcgaagacaaa

SEQ ID NO: 629 - DNA, 35 bp, Artificial Sequence
  Synthetic oligonucleotide
gcgtgcctacgtacaggcggatatgcgcgtttccc

SEQ ID NO: 630 - DNA, 38 bp, Artificial Sequence
  Synthetic oligonucleotide
gcagtcgcgtatcgattcgctttcttatctggttatga

SEQ ID NO: 631 - DNA, 38 bp, Artificial Sequence
  Synthetic oligonucleotide
cgcaggcatgcaggcttttagtttaattactcctttga

SEQ ID NO: 632 - DNA, 36 bp, Artificial Sequence
  Synthetic oligonucleotide
gacactccagcactaaagctagtgtggtatcactta

SEQ ID NO: 633 - DNA, 38 bp, Artificial Sequence
  Synthetic oligonucleotide
cactgcgcttctagtactacctccactgtgctttttga

SEQ ID NO: 634 - DNA, 35 bp, Artificial Sequence
  Synthetic oligonucleotide
acacatgccgcttaatattgattcgcttttatcat

SEQ ID NO: 635 - DNA, 35 bp, Artificial Sequence
  Synthetic oligonucleotide
gagtagccaaacgcgtgcttggtggcgatcacgta

SEQ ID NO: 636 - DNA, 35 bp, Artificial Sequence
  Synthetic oligonucleotide
tactaaggaaagcggtaaaacgtacactgaaatct

SEQ ID NO: 637 - DNA, 35 bp, Artificial Sequence
  Synthetic oligonucleotide
ggtggtgcgaaaaatgcggtgtgaactcccctgaa

SEQ ID NO: 638 - DNA, 35 bp, Artificial Sequence
  Synthetic oligonucleotide
tatcgcgagccaggagacgtaaaaaggaaatgcgg

SEQ ID NO: 639 - DNA, 35 bp, Artificial Sequence
  Synthetic oligonucleotide
ggccaccgaccactatgcatcgtgtcatgacgtaa

SEQ ID NO: 640 - DNA, 36 bp, Artificial Sequence
  Synthetic oligonucleotide
atccgatctctaccgtgcaacccacccctttgttta

SEQ ID NO: 641 - DNA, 37 bp, Artificial Sequence
  Synthetic oligonucleotide
gcggtcgatcctctcaactgtgcactttttactacga

SEQ ID NO: 642 - DNA, 37 bp, Artificial Sequence
  Synthetic oligonucleotide
attcgtagctcaactctactgtgcattttttgtttga

SEQ ID NO: 643 - DNA, 37 bp, Artificial Sequence
  Synthetic oligonucleotide
gccgctaaactgtctccactgtgctaccttatcttga

SEQ ID NO: 644 - DNA, 35 bp, Artificial Sequence
  Synthetic oligonucleotide
cgcgtgcttgcgtactgtccgcgtaatcacacaca

SEQ ID NO: 645 - DNA, 36 bp, Artificial Sequence
  Synthetic oligonucleotide
tctccactgtgccgtttcctccgttcttactcctaa

SEQ ID NO: 646 - DNA, 35 bp, Artificial Sequence
  Synthetic oligonucleotide
acctgcgtgctaaggaacgtagcattcgtgtgcga

SEQ ID NO: 647 - DNA, 35 bp, Artificial Sequence
  Synthetic oligonucleotide
acacgcgcgcttgggactgaactcagcaatgcacc

SEQ ID NO: 648 - DNA, 35 bp, Artificial Sequence
  Synthetic oligonucleotide
tcacctactaacgtgtgcggggtttttacatcact

SEQ ID NO: 649 - DNA, 36 bp, Artificial Sequence
  Synthetic oligonucleotide
gatagccgcttagccaacacaaccgcttttgattca

SEQ ID NO: 650 - DNA, 35 bp, Artificial Sequence
  Synthetic oligonucleotide
gcggccttgcatcgattcaactcgccctatttcaa

SEQ ID NO: 651 - DNA, 35 bp, Artificial Sequence
  Synthetic oligonucleotide
agcgcatcgtagccgtacagcaatgtaatattctc

SEQ ID NO: 652 - DNA, 35 bp, Artificial Sequence
  Synthetic oligonucleotide
gctaactgcaggccaccacgcttgccctggctacc

SEQ ID NO: 653 - DNA, 35 bp, Artificial Sequence
  Synthetic oligonucleotide
aagcactgtgccgcagatatgcgatttttgtgatt

SEQ ID NO: 654 - DNA, 38 bp, Artificial Sequence
  Synthetic oligonucleotide
tgagccgcgcgcctggccacgacgattcatgtgattga

SEQ ID NO: 655 - DNA, 37 bp, Artificial Sequence
  Synthetic oligonucleotide
catgcgtaagcttatgtttcgattacgttcccattga

SEQ ID NO: 656 - DNA, 35 bp, Artificial Sequence
  Synthetic oligonucleotide
gtggtccgcgcgaaccaccatgggtgcaggcgaat

SEQ ID NO: 657 - DNA, 35 bp, Artificial Sequence
  Synthetic oligonucleotide
tcacctaccagggaaatgtccagccaccccgagct

SEQ ID NO: 658 - DNA, 35 bp, Artificial Sequence
  Synthetic oligonucleotide
gcagggcttgcaggcttttaattgtttcactatcg

SEQ ID NO: 659 - DNA, 36 bp, Artificial Sequence
  Synthetic oligonucleotide
gctaagtgcggtcactgccccaggagcttgatgcta

SEQ ID NO: 660 - DNA, 35 bp, Artificial Sequence
  Synthetic oligonucleotide
gtgcgggactagcacgcagtacagctttctgcgtc

SEQ ID NO: 661 - DNA, 35 bp, Artificial Sequence
  Synthetic oligonucleotide
gcgggactagcgagtttagcctgatactacattga

SEQ ID NO: 662 - DNA, 37 bp, Artificial Sequence
  Synthetic oligonucleotide
gcggacgattcctgttcctttgcttatttctctgaga

SEQ ID NO: 663 - DNA, 35 bp, Artificial Sequence
  Synthetic oligonucleotide
acacggacctagggtcgtactgcaggaagttgttc

SEQ ID NO: 664 - DNA, 37 bp, Artificial Sequence
  Synthetic oligonucleotide
actccactgtgcctctttaacttctttccatatatga

SEQ ID NO: 665 - DNA, 35 bp, Artificial Sequence
  Synthetic oligonucleotide
gcgtgcctacgacgccaggcactagtttagtaaac

SEQ ID NO: 666 - DNA, 38 bp, Artificial Sequence
  Synthetic oligonucleotide
aagcggggagcaacgtactgccatttactattccatga

SEQ ID NO: 667 - DNA, 35 bp, Artificial Sequence
  Synthetic oligonucleotide
tttaacggaacgacctgtggctgcacgtttctcca

SEQ ID NO: 668 - DNA, 35 bp, Artificial Sequence
  Synthetic oligonucleotide
tttgtactgagcaagcgtacataccgaagccccgt

SEQ ID NO: 669 - DNA, 35 bp, Artificial Sequence
  Synthetic oligonucleotide
catgcgcgattagcttgttctaccaccgctttaca

SEQ ID NO: 670 - DNA, 38 bp, Artificial Sequence
  Synthetic oligonucleotide
catgtcgacctctttgtaaactcgccctattttcctga

SEQ ID NO: 671 - DNA, 35 bp, Artificial Sequence
  Synthetic oligonucleotide
cattgcgcgctttcaataacctccgcttataacac

SEQ ID NO: 672 - DNA, 35 bp, Artificial Sequence
  Synthetic oligonucleotide
catctagaggctcattcatattaacacgctttcct

SEQ ID NO: 673 - DNA, 37 bp, Artificial Sequence
  Synthetic oligonucleotide
tcgtagtgctgcaagtccttagtaccttggatcttga

SEQ ID NO: 674 - DNA, 35 bp, Artificial Sequence
  Synthetic oligonucleotide
atgcacggttctgctcaggccatcattttcttcac

SEQ ID NO: 675 - DNA, 35 bp, Artificial Sequence
  Synthetic oligonucleotide
gcgcgcctacgttaatgcacttcgtgacatcttcc

SEQ ID NO: 676 - DNA, 35 bp, Artificial Sequence
  Synthetic oligonucleotide
ccggtcgtagggtgactgcgggcataagctgggtt

SEQ ID NO: 677 - DNA, 35 bp, Artificial Sequence
  Synthetic oligonucleotide
tgcgcaggcccgttgtactcgctcactgctagatt

SEQ ID NO: 678 - DNA, 36 bp, Artificial Sequence
  Synthetic oligonucleotide
aagcacggacaagcatgtatgcgatcacgcccttta

SEQ ID NO: 679 - DNA, 35 bp, Artificial Sequence
  Synthetic oligonucleotide
gactgcgggactagcaacgtactgtggctggcgat

SEQ ID NO: 680 - DNA, 35 bp, Artificial Sequence
  Synthetic oligonucleotide
gcctccgtaacctacccgcgtgcctgggggttacc

SEQ ID NO: 681 - DNA, 35 bp, Artificial Sequence
  Synthetic oligonucleotide
gcagggaatccagcgaccgttcctctaccgtgcct

SEQ ID NO: 682 - DNA, 38 bp, Artificial Sequence
  Synthetic oligonucleotide
catgcggaagctttctctgttgatgatgaaccctttga

SEQ ID NO: 683 - DNA, 35 bp, Artificial Sequence
  Synthetic oligonucleotide
actgcgctaatgcccgcttaacctccatgattgtt

SEQ ID NO: 684 - DNA, 35 bp, Artificial Sequence
  Synthetic oligonucleotide
ggggtcgcgtgccagaccacgactcatgtctgtgc

SEQ ID NO: 685 - DNA, 35 bp, Artificial Sequence
  Synthetic oligonucleotide
atcgtagaactgcagacccgcatggctacctttgt

SEQ ID NO: 686 - DNA, 36 bp, Artificial Sequence
  Synthetic oligonucleotide
attgcggatcgtagctctaactgcgcatgcggtaca

SEQ ID NO: 687 - DNA, 35 bp, Artificial Sequence
  Synthetic oligonucleotide
tacacaccgctttactatcctcaatttcgctttcc

SEQ ID NO: 688 - DNA, 35 bp, Artificial Sequence
  Synthetic oligonucleotide
tgcctctactgtgccgataccggtttctttatatt

SEQ ID NO: 689 - DNA, 36 bp, Artificial Sequence
  Synthetic oligonucleotide
tcccgcgcgctagggtaatgatccagcagacatgta

SEQ ID NO: 690 - DNA, 36 bp, Artificial Sequence
  Synthetic oligonucleotide
tcgtagtactcgcgcttcccgtatcacaattttgaa

SEQ ID NO: 691 - DNA, 37 bp, Artificial Sequence
  Synthetic oligonucleotide
aggtcgcgcgccagggacgtgctgcagaaccacctga

SEQ ID NO: 692 - DNA, 36 bp, Artificial Sequence
  Synthetic oligonucleotide
tctaccgcgcgcttggaggaacgttccggactggca

SEQ ID NO: 693 - DNA, 35 bp, Artificial Sequence
  Synthetic oligonucleotide
gcaaaataataccgctacattctctacaactcgcc

SEQ ID NO: 694 - DNA, 36 bp, Artificial Sequence
  Synthetic oligonucleotide
gcgtggggtgcgcgctaaccacacttgaccagacta

SEQ ID NO: 695 - DNA, 35 bp, Artificial Sequence
  Synthetic oligonucleotide
cccggcgagccacgggctgtacgagcaagtcacac

SEQ ID NO: 696 - DNA, 36 bp, Artificial Sequence
  Synthetic oligonucleotide
gcgaggaccatcccgcgtgcctgggagtcactttaa

SEQ ID NO: 697 - DNA, 38 bp, Artificial Sequence
  Synthetic oligonucleotide
atgcacggatgcggctagcgatctcccctaaacactga

SEQ ID NO: 698 - DNA, 37 bp, Artificial Sequence
  Synthetic oligonucleotide
atgcactgtacgtagagtaatgcggttcattccttga

SEQ ID NO: 699 - DNA, 35 bp, Artificial Sequence
  Synthetic oligonucleotide
gatcgtaacgctgcaaggtcactccgggaaaacca

SEQ ID NO: 700 - DNA, 38 bp, Artificial Sequence
  Synthetic oligonucleotide
cctgcgcgctaggggagatactggttcgtgcgatttga

SEQ ID NO: 701 - DNA, 35 bp, Artificial Sequence
  Synthetic oligonucleotide
acgcgtgctaggacggactgaacggtaaaactaag

SEQ ID NO: 702 - DNA, 38 bp, Artificial Sequence
  Synthetic oligonucleotide
actgcagagtatgcaagcttgaccaccatacgctttga

SEQ ID NO: 703 - DNA, 37 bp, Artificial Sequence
  Synthetic oligonucleotide
catgcgcaggctttctctttagttctcttctggttga

SEQ ID NO: 704 - DNA, 35 bp, Artificial Sequence
  Synthetic oligonucleotide
tcaagcgaatctagcggtacacctcgcaggctcgc

SEQ ID NO: 705 - DNA, 35 bp, Artificial Sequence
  Synthetic oligonucleotide
catgcaagcttcgttcaacatccaacctagctgta

SEQ ID NO: 706 - DNA, 35 bp, Artificial Sequence
  Synthetic oligonucleotide
gcgtgccaacgttgcatcaactattttcatgaatt

SEQ ID NO: 707 - DNA, 38 bp, Artificial Sequence
  Synthetic oligonucleotide
gcgtgctgtgactccaccgtgccttatactttgaatga

SEQ ID NO: 708 - DNA, 36 bp, Artificial Sequence
  Synthetic oligonucleotide
catgcgcaagcttcaacgacacaactaaacctgcta

SEQ ID NO: 709 - DNA, 36 bp, Artificial Sequence
  Synthetic oligonucleotide
ggctgaccacgatgaagtttgcgcaagcttttatta

SEQ ID NO: 710 - DNA, 37 bp, Artificial Sequence
  Synthetic oligonucleotide
aacgcgagcctgtacggtactgcccctatcccaccga

SEQ ID NO: 711 - DNA, 35 bp, Artificial Sequence
  Synthetic oligonucleotide
gcgggcctacgactgcaggacccctgacccattct

SEQ ID NO: 712 - DNA, 36 bp, Artificial Sequence
  Synthetic oligonucleotide
gctaactgcgtgtcatttcggtttcctacatccata

SEQ ID NO: 713 - DNA, 36 bp, Artificial Sequence
  Synthetic oligonucleotide
ccggatctaggagagtactggctgcacatgcgacaa

SEQ ID NO: 714 - DNA, 36 bp, Artificial Sequence
  Synthetic oligonucleotide
tacgcgcgactaacattaatgcggtcttatcatcca

SEQ ID NO: 715 - DNA, 38 bp, Artificial Sequence
  Synthetic oligonucleotide
cgccgcgccagggtactgcaggaagcgctacgacttga

SEQ ID NO: 716 - DNA, 35 bp, Artificial Sequence
  Synthetic oligonucleotide
gcagtcagcaacgcttctttatgtcatacccgctt

SEQ ID NO: 717 - DNA, 35 bp, Artificial Sequence
  Synthetic oligonucleotide
catgcgaaagcttctcatacttgatcacgtttccc

SEQ ID NO: 718 - DNA, 36 bp, Artificial Sequence
  Synthetic oligonucleotide
cacgcggttcgtagcggaatgtactggtcaatccta

SEQ ID NO: 719 - DNA, 36 bp, Artificial Sequence
  Synthetic oligonucleotide
ccggggctaggaacgggggcagtcagagcgaccata

SEQ ID NO: 720 - DNA, 35 bp, Artificial Sequence
  Synthetic oligonucleotide
ccggcagtcttatctctactgtgccttctttaatc

SEQ ID NO: 721 - DNA, 38 bp, Artificial Sequence
  Synthetic oligonucleotide
gagttgcgagcatgcggacgcttttgttttgcttttga

SEQ ID NO: 722 - DNA, 38 bp, Artificial Sequence
  Synthetic oligonucleotide
tacgcaggagggccatgacgctgactatacgcttttga

SEQ ID NO: 723 - DNA, 38 bp, Artificial Sequence
  Synthetic oligonucleotide
ttctgcgcaatttcaaccctctactgtgcccaatttga

SEQ ID NO: 724 - DNA, 35 bp, Artificial Sequence
  Synthetic oligonucleotide
tcataccctcatgatcatgcagtcaccactcttag

SEQ ID NO: 725 - DNA, 38 bp, Artificial Sequence
  Synthetic oligonucleotide
gcggagctagcacggtactgcgcataaactatgattga

SEQ ID NO: 726 - DNA, 35 bp, Artificial Sequence
  Synthetic oligonucleotide
gaccggaactaggtacggctgcagagcgcaaccgc

SEQ ID NO: 727 - DNA, 38 bp, Artificial Sequence
  Synthetic oligonucleotide
tcgtagtcaccgcgggtcatccactattaacaccttga

SEQ ID NO: 728 - DNA, 35 bp, Artificial Sequence
  Synthetic oligonucleotide
acgcgacagctacgagtccccgcggagtgcaacgc

SEQ ID NO: 729 - DNA, 36 bp, Artificial Sequence
  Synthetic oligonucleotide
tcacctactagggaaggccacacggcacgcacatta

SEQ ID NO: 730 - DNA, 37 bp, Artificial Sequence
  Synthetic oligonucleotide
aaccggaactaggtgtgggacctgaaggcatggacga

SEQ ID NO: 731 - DNA, 37 bp, Artificial Sequence
  Synthetic oligonucleotide
gtaaactgcgctcttcttcgccctcccctgtctcgga

SEQ ID NO: 732 - DNA, 35 bp, Artificial Sequence
  Synthetic oligonucleotide
tcccatcgccggacgctccatatctttcggatcct

SEQ ID NO: 733 - DNA, 36 bp, Artificial Sequence
  Synthetic oligonucleotide
tgcctctaccgtgccgtgttgattttctccattcta

SEQ ID NO: 734 - DNA, 38 bp, Artificial Sequence
  Synthetic oligonucleotide
gcgggccgtgactgtttaccactctactgtgcgattga

SEQ ID NO: 735 - DNA, 35 bp, Artificial Sequence
  Synthetic oligonucleotide
gcgatccatgacgaccaatatataccgctttgaca

SEQ ID NO: 736 - DNA, 36 bp, Artificial Sequence
  Synthetic oligonucleotide
tgtactctctactgtgcccttcctgagtgtttatca

SEQ ID NO: 737 - DNA, 36 bp, Artificial Sequence
  Synthetic oligonucleotide
taaggcgaaactagctgaaggtactgcgaattttta

SEQ ID NO: 738 - DNA, 37 bp, Artificial Sequence
  Synthetic oligonucleotide
atgcacggtacggaaggattctgccttcccatcacga

SEQ ID NO: 739 - DNA, 36 bp, Artificial Sequence
  Synthetic oligonucleotide
ggtcgcgtgccaggcacggagatgcggtcctttgca

SEQ ID NO: 740 - DNA, 35 bp, Artificial Sequence
  Synthetic oligonucleotide
aacctgaaggaaccgcatctctaccgtgcctatat

SEQ ID NO: 741 - DNA, 35 bp, Artificial Sequence
  Synthetic oligonucleotide
catgcaggctttccaacccactttaatagctaact

SEQ ID NO: 742 - DNA, 36 bp, Artificial Sequence
  Synthetic oligonucleotide
tcatgccaggctttttctttgaattccgatttaata

SEQ ID NO: 743 - DNA, 36 bp, Artificial Sequence
  Synthetic oligonucleotide
gcgttagatctctaccgtgctcaacctcttctgtaa

SEQ ID NO: 744 - DNA, 36 bp, Artificial Sequence
  Synthetic oligonucleotide
gtgacgccgctatctttacaactctactgtgcttta

SEQ ID NO: 745 - DNA, 36 bp, Artificial Sequence
  Synthetic oligonucleotide
tattgcgaactcctctgagctacggtacgtgtggca

SEQ ID NO: 746 - DNA, 35 bp, Artificial Sequence
  Synthetic oligonucleotide
tctatcaactcgccccaaattacccgccccacata

SEQ ID NO: 747 - DNA, 35 bp, Artificial Sequence
  Synthetic oligonucleotide
catgtctaggtctttcgtaatcctctaccgtgcca

SEQ ID NO: 748 - DNA, 36 bp, Artificial Sequence
  Synthetic oligonucleotide
ctgcggtcagtgcccatccgctcccaactagcctta

SEQ ID NO: 749 - DNA, 38 bp, Artificial Sequence
  Synthetic oligonucleotide
ccactccaccgtgcccttctataggttttctcaactga

SEQ ID NO: 750 - DNA, 35 bp, Artificial Sequence
  Synthetic oligonucleotide
gccttcccacgtcgagtcagttcgacgtccccgtt

SEQ ID NO: 751 - DNA, 38 bp, Artificial Sequence
  Synthetic oligonucleotide
tcatccttttactcgaccgtgccccccttagttcctga

SEQ ID NO: 752 - DNA, 36 bp, Artificial Sequence
  Synthetic oligonucleotide
taaaggccacgcatcccccgttaaaacatcattaaa

SEQ ID NO: 753 - DNA, 36 bp, Artificial Sequence
  Synthetic oligonucleotide
ttcttctccactgtgccccaactcaatttttgatta

SEQ ID NO: 754 - DNA, 36 bp, Artificial Sequence
  Synthetic oligonucleotide
tctccaccgtgccatcgaaaatttactctctgctca

SEQ ID NO: 755 - DNA, 38 bp, Artificial Sequence
  Synthetic oligonucleotide
taacctactaaggcatgtcgactctatcatatgcttga

SEQ ID NO: 756 - DNA, 36 bp, Artificial Sequence
  Synthetic oligonucleotide
aaaggcatgacatatatcctctaccgtgcccgccta

SEQ ID NO: 757 - DNA, 36 bp, Artificial Sequence
  Synthetic oligonucleotide
catgccagatttcgcactagttacctccttagctta

SEQ ID NO: 758 - DNA, 38 bp, Artificial Sequence
  Synthetic oligonucleotide
catgccggagcgatttattcaatatcttctatgagtga

SEQ ID NO: 759 - DNA, 35 bp, Artificial Sequence
  Synthetic oligonucleotide
atcgtagtacaaaagggggttatctcttggtttcg

SEQ ID NO: 760 - DNA, 35 bp, Artificial Sequence
  Synthetic oligonucleotide
tagacatatcgttctggactttttctccactgtgc

SEQ ID NO: 761 - DNA, 37 bp, Artificial Sequence
  Synthetic oligonucleotide
atcgtagtactgtggtccgccactacccgaactatga

SEQ ID NO: 762 - DNA, 37 bp, Artificial Sequence
  Synthetic oligonucleotide
gaagagccccgcctgcttccttatccagatcatgcga

SEQ ID NO: 763 - DNA, 35 bp, Artificial Sequence
  Synthetic oligonucleotide
gcgcgatacgacatctccttagcttttgttttgct

SEQ ID NO: 764 - DNA, 35 bp, Artificial Sequence
  Synthetic oligonucleotide
gacgtcatggccaccctagcttcatttcttgcttt

SEQ ID NO: 765 - DNA, 38 bp, Artificial Sequence
  Synthetic oligonucleotide
ccggtcgtaggactaccgccaggcatattattgtttga

SEQ ID NO: 766 - DNA, 36 bp, Artificial Sequence
  Synthetic oligonucleotide
tgtggtagtacgcagtcagtcgctgtatcccgctaa

SEQ ID NO: 767 - DNA, 38 bp, Artificial Sequence
  Synthetic oligonucleotide
tatgcgcccctggtctatattcggaaaaccctacctga

SEQ ID NO: 768 - DNA, 35 bp, Artificial Sequence
  Synthetic oligonucleotide
ttaggtatcatgcggccacctggtctaatattttt

SEQ ID NO: 769 - DNA, 35 bp, Artificial Sequence
  Synthetic oligonucleotide
tcgtagtactcagggccccaccaaatttcttaaat

SEQ ID NO: 770 - DNA, 35 bp, Artificial Sequence
  Synthetic oligonucleotide
accgcgcgcctggtatcctgctatgtctagtccct

SEQ ID NO: 771 - DNA, 35 bp, Artificial Sequence
  Synthetic oligonucleotide
gatcgtagcgtacgtaggaaatccccgaaacaacg

SEQ ID NO: 772 - DNA, 37 bp, Artificial Sequence
  Synthetic oligonucleotide
cgtgccatggctttaaccgtatcttcgctttttctga

SEQ ID NO: 773 - DNA, 36 bp, Artificial Sequence
  Synthetic oligonucleotide
gcgatcgtagcacggtaaactggcccccttgcaata

SEQ ID NO: 774 - DNA, 36 bp, Artificial Sequence
  Synthetic oligonucleotide
acgcactgtataaagtctacgcgcccttcaaccata

SEQ ID NO: 775 - DNA, 38 bp, Artificial Sequence
  Synthetic oligonucleotide
cttacgcgtgcttggaacgatgtattgcggccaattga

SEQ ID NO: 776 - DNA, 36 bp, Artificial Sequence
  Synthetic oligonucleotide
tcgtaggactgcaaaccacacgccttgttcgaaaaa

SEQ ID NO: 777 - DNA, 35 bp, Artificial Sequence
  Synthetic oligonucleotide
ccgggtctaggacggctctgttgtctcctccctgt

SEQ ID NO: 778 - DNA, 35 bp, Artificial Sequence
  Synthetic oligonucleotide
atcgtagcactgcagggcgcctagtttacaatggg

SEQ ID NO: 779 - DNA, 35 bp, Artificial Sequence
  Synthetic oligonucleotide
gacgtcatcgtgccttcttggctgaccgtacagga

SEQ ID NO: 780 - DNA, 38 bp, Artificial Sequence
  Synthetic oligonucleotide
ttcatccgcgcgaatgaaaccgatctacatccctatga

SEQ ID NO: 781 - DNA, 35 bp, Artificial Sequence
  Synthetic oligonucleotide
atcgtagtaccataccccgcatgccgccaaaattt

SEQ ID NO: 782 - DNA, 37 bp, Artificial Sequence
  Synthetic oligonucleotide
aaacccgcgagcaggcattgaactcccctgaatacga

SEQ ID NO: 783 - DNA, 37 bp, Artificial Sequence
  Synthetic oligonucleotide
gcaatgacgtgcgttcgaccgattatctctactatga

SEQ ID NO: 784 - DNA, 36 bp, Artificial Sequence
  Synthetic oligonucleotide
aagcactgtacggaagtaggcccgcccccaaattaa

SEQ ID NO: 785 - DNA, 35 bp, Artificial Sequence
  Synthetic oligonucleotide
tcgtagtatctggaggtcgtgcgttgcactattac

SEQ ID NO: 786 - DNA, 36 bp, Artificial Sequence
  Synthetic oligonucleotide
gatcgtatacgtacgctaggtctctttcgcttatca

SEQ ID NO: 787 - DNA, 36 bp, Artificial Sequence
  Synthetic oligonucleotide
tgggcaaccggaactagtacagcccacgtacgttga

SEQ ID NO: 788 - DNA, 36 bp, Artificial Sequence
  Synthetic oligonucleotide
tcgcaaactcagcttcctctctaccgtgcatgttaa

SEQ ID NO: 789 - DNA, 38 bp, Artificial Sequence
  Synthetic oligonucleotide
gcgcgctaacaccctgcggtacaccaggaactccttga

SEQ ID NO: 790 - DNA, 35 bp, Artificial Sequence
  Synthetic oligonucleotide
ccggtcactgctggagtgcgaaagctttctcttgt

SEQ ID NO: 791 - DNA, 36 bp, Artificial Sequence
  Synthetic oligonucleotide
gcagaaggaaatgcgcgctaattgacaacgctcgaa

SEQ ID NO: 792 - DNA, 38 bp, Artificial Sequence
  Synthetic oligonucleotide
accgcgcgcctgggaccgtaatggatcctacataatga

SEQ ID NO: 793 - DNA, 36 bp, Artificial Sequence
  Synthetic oligonucleotide
gcgatcgtagctaagggatctactagggaatgccca

SEQ ID NO: 794 - DNA, 35 bp, Artificial Sequence
  Synthetic oligonucleotide
ttacctaccagggatgcggccccgaagccattctt

SEQ ID NO: 795 - DNA, 38 bp, Artificial Sequence
  Synthetic oligonucleotide
taggcaactaatgcagagacgcgacccacgacatttga

SEQ ID NO: 796 - DNA, 35 bp, Artificial Sequence
  Synthetic oligonucleotide
ctcctagcaggcgggccctgacaggcggtcgtagc

SEQ ID NO: 797 - DNA, 35 bp, Artificial Sequence
  Synthetic oligonucleotide
tcacctaccacggtcatctttacttgagacaacaa

SEQ ID NO: 798 - DNA, 35 bp, Artificial Sequence
  Synthetic oligonucleotide
taagcaactcctgccgtgccattaaagcttttata

SEQ ID NO: 799 - DNA, 36 bp, Artificial Sequence
  Synthetic oligonucleotide
taccgctgccatgaatcatctctgttaaactagcca

SEQ ID NO: 800 - DNA, 37 bp, Artificial Sequence
  Synthetic oligonucleotide
gagtacgcgacgccttggtctactactcttccctgga

SEQ ID NO: 801 - DNA, 35 bp, Artificial Sequence
  Synthetic oligonucleotide
gcggtcgtagcaacactgcatcctcatgatactta

SEQ ID NO: 802 - DNA, 35 bp, Artificial Sequence
  Synthetic oligonucleotide
tccgacggggcatcgtgtcaggcgcatgaaatttt

SEQ ID NO: 803 - DNA, 35 bp, Artificial Sequence
  Synthetic oligonucleotide
atcgtagtagtgccgcgctagcctgacgcaaaatt

SEQ ID NO: 804 - DNA, 38 bp, Artificial Sequence
  Synthetic oligonucleotide
aggcgtgcatgacgatttaattaaccaccgaaccatga

SEQ ID NO: 805 - DNA, 36 bp, Artificial Sequence
  Synthetic oligonucleotide
catcatacgaccgcgtgattggtgagttgtaacgga

SEQ ID NO: 806 - DNA, 35 bp, Artificial Sequence
  Synthetic oligonucleotide
catgcaagcttggattttctcacgtttcattgtta

SEQ ID NO: 807 - DNA, 35 bp, Artificial Sequence
  Synthetic oligonucleotide
gcgcataggctttttatatttattctctatgcttt

SEQ ID NO: 808 - DNA, 35 bp, Artificial Sequence
  Synthetic oligonucleotide
gcccgattccagaaaccacgcttttaccatttcct

SEQ ID NO: 809 - DNA, 37 bp, Artificial Sequence
  Synthetic oligonucleotide
gctagcattggcttttgtttatttgcttctatcttga

SEQ ID NO: 810 - DNA, 35 bp, Artificial Sequence
  Synthetic oligonucleotide
gcgctactagccgatatatttccgttccactcttt

SEQ ID NO: 811 - DNA, 36 bp, Artificial Sequence
  Synthetic oligonucleotide
gactaaatacctcactatctccactgtgccgttaaa

SEQ ID NO: 812 - DNA, 35 bp, Artificial Sequence
  Synthetic oligonucleotide
gcaaattctgttcgatccacactattaactcgctt

SEQ ID NO: 813 - DNA, 37 bp, Artificial Sequence
  Synthetic oligonucleotide
gaatcatccggccctaaactccactgtgccctcttga

SEQ ID NO: 814 - DNA, 35 bp, Artificial Sequence
  Synthetic oligonucleotide
tgctaggtgatgaattaatttggtctctttttggt

SEQ ID NO: 815 - DNA, 35 bp, Artificial Sequence
  Synthetic oligonucleotide
gcctacaggatttttgattgatcgatttcgcttct

SEQ ID NO: 816 - DNA, 36 bp, Artificial Sequence
  Synthetic oligonucleotide
catgcaattcttcgcttcctattccttaagcttgta

SEQ ID NO: 817 - DNA, 36 bp, Artificial Sequence
  Synthetic oligonucleotide
gctaactgcttggcgtgcgagctgaaccaacgctta

SEQ ID NO: 818 - DNA, 36 bp, Artificial Sequence
  Synthetic oligonucleotide
gccgaaaacatcgctgttcgtcttatcaactcgccc

SEQ ID NO: 819 - DNA, 36 bp, Artificial Sequence
  Synthetic oligonucleotide
atgcctgtccaaaaactctaccgtgccgtgttacta

SEQ ID NO: 820 - DNA, 37 bp, Artificial Sequence
  Synthetic oligonucleotide
catgcgtcgattcactatcttcgctttcaattgctga

SEQ ID NO: 821 - DNA, 35 bp, Artificial Sequence
  Synthetic oligonucleotide
gtcaaatgtcaatgggcaccacgcactgttcgcgc

SEQ ID NO: 822 - DNA, 36 bp, Artificial Sequence
  Synthetic oligonucleotide
gcgacacgattggtcaattcctcgctttcctctcta

SEQ ID NO: 823 - DNA, 36 bp, Artificial Sequence
  Synthetic oligonucleotide
catagggacggaacgggcacggtagctcctaacgta

SEQ ID NO: 824 - DNA, 36 bp, Artificial Sequence
  Synthetic oligonucleotide
taggcaactactaggtgatgcgtcaattacctctta

SEQ ID NO: 825 - DNA, 38 bp, Artificial Sequence
  Synthetic oligonucleotide
tcacctaccacaagatcgtgcccctgaatcacttgtga

SEQ ID NO: 826 - DNA, 36 bp, Artificial Sequence
  Synthetic oligonucleotide
agtcaggcatggtagacgcttctacttcgctttcta

SEQ ID NO: 827 - DNA, 37 bp, Artificial Sequence
  Synthetic oligonucleotide
taacctaccaagtacatgacctttcacttgatcttga

SEQ ID NO: 828 - DNA, 38 bp, Artificial Sequence
  Synthetic oligonucleotide
tatgccagcttctcatatatcccgctttctatcaatga

SEQ ID NO: 829 - DNA, 35 bp, Artificial Sequence
  Synthetic oligonucleotide
gaagccgcgcgccaagcaaagggtactgcccctct

SEQ ID NO: 830 - DNA, 36 bp, Artificial Sequence
  Synthetic oligonucleotide
atgcacggtgcggccggtcatgcaagacacttcgta

SEQ ID NO: 831 - DNA, 35 bp, Artificial Sequence
  Synthetic oligonucleotide
ttcatttatctccaccgtgcactccatggatctta

SEQ ID NO: 832 - DNA, 36 bp, Artificial Sequence
  Synthetic oligonucleotide
gcaggcttcgaatcctccactgtgctaatacatgaa

SEQ ID NO: 833 - DNA, 35 bp, Artificial Sequence
  Synthetic oligonucleotide
atgcactgttgtgatcggcctgagcaggcgcccaa

SEQ ID NO: 834 - DNA, 38 bp, Artificial Sequence
  Synthetic oligonucleotide
aacccctcgccgcgtgcctggcgacggagtagtaatga

SEQ ID NO: 835 - DNA, 37 bp, Artificial Sequence
  Synthetic oligonucleotide
actccaccgtgccctttaatctcatgtgccacactga

SEQ ID NO: 836 - DNA, 35 bp, Artificial Sequence
  Synthetic oligonucleotide
gcgattatattaatttctctaccgtgcgatcccaa

SEQ ID NO: 837 - DNA, 35 bp, Artificial Sequence
  Synthetic oligonucleotide
atgcatcagcgcgcttattaatcaatcgcttttgt

SEQ ID NO: 838 - DNA, 34 bp, Artificial Sequence
  Synthetic oligonucleotide
gcgtgccagcgtactcgcatctcacagaacccgt

SEQ ID NO: 839 - DNA, 35 bp, Artificial Sequence
  Synthetic oligonucleotide
caaccactattcgcgtgccagggtggggaaacgtt

SEQ ID NO: 840 - DNA, 36 bp, Artificial Sequence
  Synthetic oligonucleotide
tatgcaaccgggactgagagtcctagcgctttttta

SEQ ID NO: 841 - DNA, 36 bp, Artificial Sequence
  Synthetic oligonucleotide
gcccgctttgtcaccggaattaattaactcgcctca

SEQ ID NO: 842 - DNA, 35 bp, Artificial Sequence
  Synthetic oligonucleotide
tcacctactagattcgtgccagaatttcaaatttc

SEQ ID NO: 843 - DNA, 38 bp, Artificial Sequence
  Synthetic oligonucleotide
tcggacttgatctacacattgacacattgataccctga

SEQ ID NO: 844 - DNA, 37 bp, Artificial Sequence
  Synthetic oligonucleotide
cgtttgacttagacggactgccttgatcactgactga

SEQ ID NO: 845 - DNA, 37 bp, Artificial Sequence
  Synthetic oligonucleotide
gagttctccttaaaatctgaccctgacaacgagtgga

SEQ ID NO: 846 - DNA, 38 bp, Artificial Sequence
  Synthetic oligonucleotide
atactggaggtcatgattctgatcccgtgatattctga

SEQ ID NO: 847 - DNA, 38 bp, Artificial Sequence
  Synthetic oligonucleotide
ggatacacgggagtctgcgttgacacattttgatttga

SEQ ID NO: 848 - DNA, 38 bp, Artificial Sequence
  Synthetic oligonucleotide
gtttgcaattgcttaggatactcaacctgactccatga

SEQ ID NO: 849 - DNA, 38 bp, Artificial Sequence
  Synthetic oligonucleotide
gcggtatttatgataatgactcgtgaccccaatattga

SEQ ID NO: 850 - DNA, 38 bp, Artificial Sequence
  Synthetic oligonucleotide
ggtcagctagtaaagtttatccgatgatttgattttga

SEQ ID NO: 851 - DNA, 37 bp, Artificial Sequence
  Synthetic oligonucleotide
gcaggatagtcatgcaaaatattcaacgataattaga

SEQ ID NO: 852 - DNA, 38 bp, Artificial Sequence
  Synthetic oligonucleotide
tgtgactataacgcactaagccgattctgacgatatga

SEQ ID NO: 853 - DNA, 38 bp, Artificial Sequence
  Synthetic oligonucleotide
ttttgtacctgcttcgataaccaacagttaggatttga

SEQ ID NO: 854 - DNA, 38 bp, Artificial Sequence
  Synthetic oligonucleotide
gactatcaaatgaccccgatcgatacgtaggacactga

SEQ ID NO: 855 - DNA, 36 bp, Artificial Sequence
  Synthetic oligonucleotide
aactggccgtgtgtgccggtgggataactgttacta

SEQ ID NO: 856 - DNA, 36 bp, Artificial Sequence
  Synthetic oligonucleotide
gaggactagccgatacttgataatgattatgacgta

SEQ ID NO: 857 - DNA, 37 bp, Artificial Sequence
  Synthetic oligonucleotide
gtgaatgacacacgtctgaccttggatcgctgattga

SEQ ID NO: 858 - DNA, 38 bp, Artificial Sequence
  Synthetic oligonucleotide
accgtggacttattgcttatattggacttagagcctga

SEQ ID NO: 859 - DNA, 36 bp, Artificial Sequence
  Synthetic oligonucleotide
gaggacgtacgccttgatgtttaactggattactga

SEQ ID NO: 860 - DNA, 36 bp, Artificial Sequence
  Synthetic oligonucleotide
caccccttttgattatccttattgatacttatatga

SEQ ID NO: 861 - DNA, 38 bp, Artificial Sequence
  Synthetic oligonucleotide
tcccgtgatgtgggaacgtagatctttgactgatttga

SEQ ID NO: 862 - DNA, 38 bp, Artificial Sequence
  Synthetic oligonucleotide
tcgtaatgcccaataaccaactggttaagtagacctga

SEQ ID NO: 863 - DNA, 36 bp, Artificial Sequence
  Synthetic oligonucleotide
gcgatcacaatttaccggaccgatctccctagacaa

SEQ ID NO: 864 - DNA, 36 bp, Artificial Sequence
  Synthetic oligonucleotide
gcgtacggaacggaaccgacacaacctgaataccta

SEQ ID NO: 865 - DNA, 36 bp, Artificial Sequence
  Synthetic oligonucleotide
gcgtacggaacggaaccgacacaacctgaataccga

SEQ ID NO: 866 - DNA, 38 bp, Artificial Sequence
  Synthetic oligonucleotide
gcttgaatccacgacgaaattacttaaaataaccctga

SEQ ID NO: 867 - DNA, 38 bp, Artificial Sequence
  Synthetic oligonucleotide
gccggggcggagcctacgatttatatcgcgattattga

SEQ ID NO: 868 - DNA, 38 bp, Artificial Sequence
  Synthetic oligonucleotide
aagtgcacactgcctcgatttacatttcggacctatga

SEQ ID NO: 869 - DNA, 38 bp, Artificial Sequence
  Synthetic oligonucleotide
gcgtactgtgcgcgattccgggatatatattcgattga

SEQ ID NO: 870 - DNA, 38 bp, Artificial Sequence
  Synthetic oligonucleotide
cacagacgttctcgttgatacccggacccgatatttga

SEQ ID NO: 871 - DNA, 38 bp, Artificial Sequence
  Synthetic oligonucleotide
tccattttggaacgtcgaattactcggatactaattga

SEQ ID NO: 872 - DNA, 38 bp, Artificial Sequence
  Synthetic oligonucleotide
actcgacgtaaaactatctgtgactcctaatacattga

SEQ ID NO: 873 - DNA, 38 bp, Artificial Sequence
  Synthetic oligonucleotide
accgtaacttgctagccttccggatccctccaatctga

SEQ ID NO: 874 - DNA, 38 bp, Artificial Sequence
  Synthetic oligonucleotide
ttcgtacagatacccccgataccccgccacctgattga

SEQ ID NO: 875 - DNA, 34 bp, Artificial Sequence
  Synthetic oligonucleotide
atattaatgccttgatccgactccgacctcttga

SEQ ID NO: 876 - DNA, 38 bp, Artificial Sequence
  Synthetic oligonucleotide
ttgacgcgacgtactattttgatcgtattccaatctga

SEQ ID NO: 877 - DNA, 38 bp, Artificial Sequence
  Synthetic oligonucleotide
gcgccgccacggtacttaaaaactcggactttacttga

SEQ ID NO: 878 - DNA, 38 bp, Artificial Sequence
  Synthetic oligonucleotide
cgtagtactgctacatccgaaccgaccataaatactga

SEQ ID NO: 879 - DNA, 38 bp, Artificial Sequence
  Synthetic oligonucleotide
gaggacgcagttgaccggatttccaccgattatattga

SEQ ID NO: 880 - DNA, 38 bp, Artificial Sequence
  Synthetic oligonucleotide
gaggactgaaccatctcggaccacccatggatacttga

SEQ ID NO: 881 - DNA, 38 bp, Artificial Sequence
  Synthetic oligonucleotide
tgcgcgagcaaacgcgactattgaaccttagaacctga

SEQ ID NO: 882 - DNA, 35 bp, Artificial Sequence
  Synthetic oligonucleotide
gctggtgacccctcttgaccttccttattgatttg

SEQ ID NO: 883 - DNA, 38 bp, Artificial Sequence
  Synthetic oligonucleotide
gagtacctcaccgctttcgattatcgttctgaccttga

SEQ ID NO: 884 - DNA, 36 bp, Artificial Sequence
  Synthetic oligonucleotide
agccacttcctgctttgaaccggactccttatataa

SEQ ID NO: 885 - DNA, 38 bp, Artificial Sequence
  Synthetic oligonucleotide
attgagcgtacgcatctaccggattaccttacttttga

SEQ ID NO: 886 - DNA, 37 bp, Artificial Sequence
  Synthetic oligonucleotide
gaacttacgttactaacctgactctatcttacattga

SEQ ID NO: 887 - DNA, 37 bp, Artificial Sequence
  Synthetic oligonucleotide
gcaccactattgtgggaattcctgattttactattga

SEQ ID NO: 888 - DNA, 37 bp, Artificial Sequence
  Synthetic oligonucleotide
gcgtgcctgcctggctctgactccgattattcattga

SEQ ID NO: 889 - DNA, 38 bp, Artificial Sequence
  Synthetic oligonucleotide
agttccttactaacacaacttttggatatttaaattga

SEQ ID NO: 890 - DNA, 37 bp, Artificial Sequence
  Synthetic oligonucleotide
actgccttttcttactgggatacttattgattattga

SEQ ID NO: 891 - DNA, 38 bp, Artificial Sequence
  Synthetic oligonucleotide
atagtacactacctactgactccctatattatgaatga

SEQ ID NO: 892 - DNA, 38 bp, Artificial Sequence
  Synthetic oligonucleotide
gcgatacaacccttcatttctgactaccgatatattga

SEQ ID NO: 893 - DNA, 36 bp, Artificial Sequence
  Synthetic oligonucleotide
gcatctttcttcttaatgatttaccgttctcacata

SEQ ID NO: 894 - DNA, 36 bp, Artificial Sequence
  Synthetic oligonucleotide
accacgtgttattctctgtatttcactttgtctcaa

SEQ ID NO: 895 - DNA, 36 bp, Artificial Sequence
  Synthetic oligonucleotide
accgggaacatttctgtcgtttcatttcatcactaa

SEQ ID NO: 896 - DNA, 36 bp, Artificial Sequence
  Synthetic oligonucleotide
agtttattgctccttcccactattgtctatctcgca

SEQ ID NO: 897 - DNA, 36 bp, Artificial Sequence
  Synthetic oligonucleotide
tcgcttccttgtacttcctatacccttttcaccaca

SEQ ID NO: 898 - DNA, 35 bp, Artificial Sequence
  Synthetic oligonucleotide
actaactcgcccactcttctcatttggaacctatc

SEQ ID NO: 899 - DNA, 36 bp, Artificial Sequence
  Synthetic oligonucleotide
actccccctcagctatcatacatcactcgcatctaa

SEQ ID NO: 900 - DNA, 38 bp, Artificial Sequence
  Synthetic oligonucleotide
aatatatacgcgctacaaatcttttctcctactgatga

SEQ ID NO: 901 - DNA, 37 bp, Artificial Sequence
  Synthetic oligonucleotide
actatactcacatcctatttaattattggcttaatga

SEQ ID NO: 902 - DNA, 38 bp, Artificial Sequence
  Synthetic oligonucleotide
atcgatcctgcctaacctggtaaacaactcatttctga

SEQ ID NO: 903 - DNA, 35 bp, Artificial Sequence
  Synthetic oligonucleotide
ttagctgcttcccagacccaagctattatttttca

SEQ ID NO: 904 - DNA, 36 bp, Artificial Sequence
  Synthetic oligonucleotide
tccctgcatcttaacttctatagggtttgcttaaaa

SEQ ID NO: 905 - DNA, 36 bp, Artificial Sequence
  Synthetic oligonucleotide
gggtcactccgtaaggcctctactccaaattataaa

SEQ ID NO: 906 - DNA, 36 bp, Artificial Sequence
  Synthetic oligonucleotide
aactgtacggcgcaattttactctcaagtaccaaca

SEQ ID NO: 907 - DNA, 35 bp, Artificial Sequence
  Synthetic oligonucleotide
tgcggactttattcgcttgatgcctatcctgttat

SEQ ID NO: 908 - DNA, 36 bp, Artificial Sequence
  Synthetic oligonucleotide
tccgccacatcgggttatacttttgaactagttaaa

SEQ ID NO: 909 - DNA, 38 bp, Artificial Sequence
  Synthetic oligonucleotide
tgttccttcgagttccatcccaaagagttaattcatga

SEQ ID NO: 910 - DNA, 35 bp, Artificial Sequence
  Synthetic oligonucleotide
tcctgcgactctacggtatattcctttaatcgaca

SEQ ID NO: 911 - DNA, 38 bp, Artificial Sequence
  Synthetic oligonucleotide
agtaaaattccggttcatccacactgagctttcaatga

SEQ ID NO: 912 - DNA, 36 bp, Artificial Sequence
  Synthetic oligonucleotide
ttaactccttgaagtacgtcctaggccccctcacca

SEQ ID NO: 913 - DNA, 36 bp, Artificial Sequence
  Synthetic oligonucleotide
tggagtactggtgccgaacgtttttgaacgggttga

SEQ ID NO: 914 - DNA, 38 bp, Artificial Sequence
  Synthetic oligonucleotide
gagtactatagagccaagacctcatttagtcactctga

SEQ ID NO: 915 - DNA, 36 bp, Artificial Sequence
  Synthetic oligonucleotide
ccgacccataacactttcgcttcaagcatctaggca

SEQ ID NO: 916 - DNA, 36 bp, Artificial Sequence
  Synthetic oligonucleotide
cgtccgcacccctttttcaccttgttctgctatgca

SEQ ID NO: 917 - DNA, 35 bp, Artificial Sequence
  Synthetic oligonucleotide
gagcctctgtaacccaatcttcaactgcagggacc

SEQ ID NO: 918 - DNA, 35 bp, Artificial Sequence
  Synthetic oligonucleotide
gagttctccagctagatattccaatacggaaccga

SEQ ID NO: 919 - DNA, 38 bp, Artificial Sequence
  Synthetic oligonucleotide
gagtattgcgaagattgggtttatcggttctaacatga

SEQ ID NO: 920 - DNA, 37 bp, Artificial Sequence
  Synthetic oligonucleotide
aaacgctattacggctgacccggtgactcgggattga

SEQ ID NO: 921 - DNA, 36 bp, Artificial Sequence
  Synthetic oligonucleotide
accgactccagtttcacgggaatattctcaccggga

SEQ ID NO: 922 - DNA, 38 bp, Artificial Sequence
  Synthetic oligonucleotide
gttgtcggtttccattagttcgatatcttgccgtgaga

SEQ ID NO: 923 - DNA, 38 bp, Artificial Sequence
  Synthetic oligonucleotide
atgggaatcacgtagctgtaacgataatccatgggtga

SEQ ID NO: 924 - DNA, 35 bp, Artificial Sequence
  Synthetic oligonucleotide
aggtactgacgattctttaaagtgactactggtga

SEQ ID NO: 925 - DNA, 38 bp, Artificial Sequence
  Synthetic oligonucleotide
ggcggtggaagtccgaactgccgagttaaattccctga

SEQ ID NO: 926 - DNA, 38 bp, Artificial Sequence
  Synthetic oligonucleotide
tatcggtcttacgaaagccggcacgtacgtttctttga

SEQ ID NO: 927 - DNA, 38 bp, Artificial Sequence
  Synthetic oligonucleotide
tgacggatgataggcatgacctcgtagaccacatctga

SEQ ID NO: 928 - DNA, 38 bp, Artificial Sequence
  Synthetic oligonucleotide
tttgtaccatccttacaaatgagatcttgttatgttga

SEQ ID NO: 929 - DNA, 36 bp, Artificial Sequence
  Synthetic oligonucleotide
tacatgcgtactataaaccctattgtttactggtaa

SEQ ID NO: 930 - DNA, 35 bp, Artificial Sequence
  Synthetic oligonucleotide
gcaagtctagatcttcattcatttgttcatgtttt

SEQ ID NO: 931 - DNA, 35 bp, Artificial Sequence
  Synthetic oligonucleotide
gagtttgcgggaatcttccccgaacaaggggctaa

SEQ ID NO: 932 - DNA, 35 bp, Artificial Sequence
  Synthetic oligonucleotide
tagaccgttggaggtccggggttggtgcccgatta

SEQ ID NO: 933 - DNA, 37 bp, Artificial Sequence
  Synthetic oligonucleotide
acactcatacgagatctgattatacacgcgccttgga

SEQ ID NO: 934 - DNA, 37 bp, Artificial Sequence
  Synthetic oligonucleotide
gtcgtcgggagaccacttatcttttttccatgccgga

SEQ ID NO: 935 - DNA, 35 bp, Artificial Sequence
  Synthetic oligonucleotide
tcacctgacgttacactcctccgtacaaacgtgta

SEQ ID NO: 936 - DNA, 35 bp, Artificial Sequence
  Synthetic oligonucleotide
tcctgattaattcatggtcacaactcccggtttcc

SEQ ID NO: 937 - DNA, 36 bp, Artificial Sequence
  Synthetic oligonucleotide
tccttttgcccatgattattctcgatgtaaaaacga

SEQ ID NO: 938 - DNA, 37 bp, Artificial Sequence
  Synthetic oligonucleotide
aacgctaatatctgccgatgggaatcctcgattagga

SEQ ID NO: 939 - DNA, 37 bp, Artificial Sequence
  Synthetic oligonucleotide
agggtgatatttacgttatcttcgaatttctactgga

SEQ ID NO: 940 - DNA, 36 bp, Artificial Sequence
  Synthetic oligonucleotide
tctcacttacaaagcgtttaatcaacgcagttctta

SEQ ID NO: 941 - DNA, 37 bp, Artificial Sequence
  Synthetic oligonucleotide
ccgcaaacttaggggctaataattttcgttatccgga

SEQ ID NO: 942 - DNA, 37 bp, Artificial Sequence
  Synthetic oligonucleotide
tgccagaaaatcgaatttttatacgtaatggcatgga

SEQ ID NO: 943 - DNA, 35 bp, Artificial Sequence
  Synthetic oligonucleotide
atcgatcctgacgccgaaaacttgacacgactaaa

SEQ ID NO: 944 - DNA, 35 bp, Artificial Sequence
  Synthetic oligonucleotide
atgctggtaacttttgcacatcttacttggtaaac

SEQ ID NO: 945 - DNA, 36 bp, Artificial Sequence
  Synthetic oligonucleotide
gcgattactcagcacccccttacttgtttttaatca

SEQ ID NO: 946 - DNA, 35 bp, Artificial Sequence
  Synthetic oligonucleotide
actgcgggactatctgaattattggtattataaca

SEQ ID NO: 947 - DNA, 36 bp, Artificial Sequence
  Synthetic oligonucleotide
gagtactgaaggaactggaaccgagtattcttgtca

SEQ ID NO: 948 - DNA, 36 bp, Artificial Sequence
  Synthetic oligonucleotide
gagaactgcctggtaatatattcccaaacctggaca

SEQ ID NO: 949 - DNA, 36 bp, Artificial Sequence
  Synthetic oligonucleotide
gagtgcgtaggtcttacatcctatcgaatatttaca

SEQ ID NO: 950 - DNA, 36 bp, Artificial Sequence
  Synthetic oligonucleotide
ctcagactttacacaatctttctctccacacaagca

SEQ ID NO: 951 - DNA, 35 bp, Artificial Sequence
  Synthetic oligonucleotide
gccactttcagaatctcgtgtcacacccatcatca

SEQ ID NO: 952 - DNA, 36 bp, Artificial Sequence
  Synthetic oligonucleotide
gcgttccccgtggacaatatcactttcttatcgtca

SEQ ID NO: 953 - DNA, 35 bp, Artificial Sequence
  Synthetic oligonucleotide
tcctggtctacgacttacatctgatccgacccaaa

SEQ ID NO: 954 - DNA, 36 bp, Artificial Sequence
  Synthetic oligonucleotide
ggaccttatttgttcgacccccgttatcacctgaaa

SEQ ID NO: 955 - DNA, 35 bp, Artificial Sequence
  Synthetic oligonucleotide
gaggacttttactgatcaaccccacctttcgaaaa

SEQ ID NO: 956 - DNA, 36 bp, Artificial Sequence
  Synthetic oligonucleotide
gctactacttatccgactactctaaaaacaactaca

SEQ ID NO: 957 - DNA, 35 bp, Artificial Sequence
  Synthetic oligonucleotide
aactgtcatccgccgactaactcaatctaactcaa

SEQ ID NO: 958 - DNA, 35 bp, Artificial Sequence
  Synthetic oligonucleotide
aactgtcatccgccgactaactcaatctaactcta

SEQ ID NO: 959 - DNA, 35 bp, Artificial Sequence
  Synthetic oligonucleotide
aactgtcatccgccgactaactcaatctaactcga

SEQ ID NO: 960 - DNA, 35 bp, Artificial Sequence
  Synthetic oligonucleotide
tactccggcccaactatatacttctccacaccaac

SEQ ID NO: 961 - DNA, 35 bp, Artificial Sequence
  Synthetic oligonucleotide
tactccggcccaactatatacttctccacaccatc

SEQ ID NO: 962 - DNA, 35 bp, Artificial Sequence
  Synthetic oligonucleotide
tactccggcccaactatatacttctccacaccagc

SEQ ID NO: 963 - DNA, 35 bp, Artificial Sequence
  Synthetic oligonucleotide
tcctacctgcccaatccccttttgattacatatat

SEQ ID NO: 964 - DNA, 35 bp, Artificial Sequence
  Synthetic oligonucleotide
ccacgctttggggacgctattactatccctttcaa

SEQ ID NO: 965 - DNA, 35 bp, Artificial Sequence
  Synthetic oligonucleotide
aatgtactgataatcccttttacactggttactat

SEQ ID NO: 966 - DNA, 35 bp, Artificial Sequence
  Synthetic oligonucleotide
ttagtcgtacttttatctatattgggcctaataaa

SEQ ID NO: 967 - DNA, 36 bp, Artificial Sequence
  Synthetic oligonucleotide
ttcgccacgttcctaaatattttacttattactaaa

SEQ ID NO: 968 - DNA, 36 bp, Artificial Sequence
  Synthetic oligonucleotide
ttccatgactctgcctatacttattatatctcataa

SEQ ID NO: 969 - DNA, 36 bp, Artificial Sequence
  Synthetic oligonucleotide
ttggagctacaatcaaacttcatatctctttctaaa

SEQ ID NO: 970 - DNA, 36 bp, Artificial Sequence
  Synthetic oligonucleotide
tgcccaaaactgcctttagaaacttattacattcaa

SEQ ID NO: 971 - DNA, 36 bp, Artificial Sequence
  Synthetic oligonucleotide
tctgcgatcgccatttatctcgaccctttacctaaa

SEQ ID NO: 972 - DNA, 35 bp, Artificial Sequence
  Synthetic oligonucleotide
aacttttttgcactaacctggacctcatatataat

SEQ ID NO: 973 - DNA, 34 bp, Artificial Sequence
  Synthetic oligonucleotide
aaccgcttttcacactaccactcacgctctcata

SEQ ID NO: 974 - DNA, 36 bp, Artificial Sequence
  Synthetic oligonucleotide
ccgccgtacccacgctccaattattctcatcctaca

SEQ ID NO: 975 - DNA, 36 bp, Artificial Sequence
  Synthetic oligonucleotide
tatctccgtccaacacatctctggtcaccacctcca

SEQ ID NO: 976 - DNA, 35 bp, Artificial Sequence
  Synthetic oligonucleotide
tttctccgctcatcataactgacgccatccactca

SEQ ID NO: 977 - DNA, 35 bp, Artificial Sequence
  Synthetic oligonucleotide
acttcgctcattcacttgccaactcctgcacaatc

SEQ ID NO: 978 - DNA, 37 bp, Artificial Sequence
  Synthetic oligonucleotide
tccctcaccgttgcccttattccgtactcacttatga

SEQ ID NO: 979 - DNA, 36 bp, Artificial Sequence
  Synthetic oligonucleotide
gtgcttctccttttgactcgcctcactcttggtcca

SEQ ID NO: 980 - DNA, 36 bp, Artificial Sequence
  Synthetic oligonucleotide
ttttctcctcactccgctccgtgccttgacatcaaa

SEQ ID NO: 981 - DNA, 37 bp, Artificial Sequence
  Synthetic oligonucleotide
taccttcttcaatatccgtccgcttaacctggattca

SEQ ID NO: 982 - DNA, 36 bp, Artificial Sequence
  Synthetic oligonucleotide
cctcctctgcctaaatacgttttctccaccatcata

SEQ ID NO: 983 - DNA, 36 bp, Artificial Sequence
  Synthetic oligonucleotide
acttttttaaattttgttcccacgtatccttaatta

SEQ ID NO: 984 - DNA, 38 bp, Artificial Sequence
  Synthetic oligonucleotide
ttttccgggtttcttctccagtaggttgacttttatga

SEQ ID NO: 985 - DNA, 35 bp, Artificial Sequence
  Synthetic oligonucleotide
tgttttggcctccacggtttagtacttattttttt

SEQ ID NO: 986 - DNA, 35 bp, Artificial Sequence
  Synthetic oligonucleotide
gacttttttgctcatattttcaccaatcaattcca

SEQ ID NO: 987 - DNA, 36 bp, Artificial Sequence
  Synthetic oligonucleotide
tgagttctcttttatattggtcgccactttttccaa

SEQ ID NO: 988 - DNA, 36 bp, Artificial Sequence
  Synthetic oligonucleotide
ttccttcacttgggctttcaaatcatttataaacaa

SEQ ID NO: 989 - DNA, 38 bp, Artificial Sequence
  Synthetic oligonucleotide
ttcttgacttcagttcgattttgttattcttagtttga

SEQ ID NO: 990 - DNA, 38 bp, Artificial Sequence
  Synthetic oligonucleotide
gttaattccttgctcgagtttttccgcttattccttga

SEQ ID NO: 991 - DNA, 37 bp, Artificial Sequence
  Synthetic oligonucleotide
ggtacatttcgtccctaccattggtttattcttttga

SEQ ID NO: 992 - DNA, 37 bp, Artificial Sequence
  Synthetic oligonucleotide
attatttttcgttctctcacttgttttcgatcattga

SEQ ID NO: 993 - DNA, 35 bp, Artificial Sequence
  Synthetic oligonucleotide
taattgagcttttgctcctaacggcgagagccgtt

SEQ ID NO: 994 - DNA, 36 bp, Artificial Sequence
  Synthetic oligonucleotide
tgatatacgcgcgagtagaacatcaaccagtgagaa

SEQ ID NO: 995 - DNA, 38 bp, Artificial Sequence
  Synthetic oligonucleotide
taagccgagcgcatgtaggttcgttttcacgagagtga

SEQ ID NO: 996 - DNA, 35 bp, Artificial Sequence
  Synthetic oligonucleotide
atgaacgcgagtgaggacgctttagttaattatgt

SEQ ID NO: 997 - DNA, 37 bp, Artificial Sequence
  Synthetic oligonucleotide
actcggatagcggggccgggggaggcctacacattga

SEQ ID NO: 998 - DNA, 38 bp, Artificial Sequence
  Synthetic oligonucleotide
acgcagtccgtaaattgataaccgggaggttcgagtga

SEQ ID NO: 999 - DNA, 35 bp, Artificial Sequence
  Synthetic oligonucleotide
agtcccacgagagtggttctctctagataagagga

SEQ ID NO: 1000 - DNA, 37 bp, Artificial Sequence
  Synthetic oligonucleotide
gagtaccataacaaggcctgaagaaccttgcaggtga

SEQ ID NO: 1001 - DNA, 38 bp, Artificial Sequence
  Synthetic oligonucleotide
gcggggtgtgaacccgctcgtatgtaacaacggattga

SEQ ID NO: 1002 - DNA, 37 bp, Artificial Sequence
  Synthetic oligonucleotide
gagtacggttacggtgagtaaccatttagacgtaaga

SEQ ID NO: 1003 - DNA, 38 bp, Artificial Sequence
  Synthetic oligonucleotide
tgggatccgcgaggatctgatggggttcttatgtttga

SEQ ID NO: 1004 - DNA, 36 bp, Artificial Sequence
  Synthetic oligonucleotide
gagtacccgggcagggagccagttattatgttttga

SEQ ID NO: 1005 - DNA, 36 bp, Artificial Sequence
  Synthetic oligonucleotide
gagtacctagatatctcaaaagatatttatcgttaa

SEQ ID NO: 1006 - DNA, 35 bp, Artificial Sequence
  Synthetic oligonucleotide
gagtactctgcgcaagtgttgaactttgtagaaat

SEQ ID NO: 1007 - DNA, 36 bp, Artificial Sequence
  Synthetic oligonucleotide
gagtacttcccgcggggttatggaatgaattggata

SEQ ID NO: 1008 - DNA, 38 bp, Artificial Sequence
  Synthetic oligonucleotide
taatgtctcttccgccgtagtacgagcggttccgctga

SEQ ID NO: 1009 - DNA, 38 bp, Artificial Sequence
  Synthetic oligonucleotide
gagtacagccgcccttgtaccgaggccttattaagtga

SEQ ID NO: 1010 - DNA, 38 bp, Artificial Sequence
  Synthetic oligonucleotide
ttagtttaccgtcaaaggcctcataatgttacaactga

SEQ ID NO: 1011 - DNA, 38 bp, Artificial Sequence
  Synthetic oligonucleotide
cgtagtattgcgggctcgtctcattgcattcctattga

SEQ ID NO: 1012 - DNA, 38 bp, Artificial Sequence
  Synthetic oligonucleotide
cgtgagacgtggttgcccaccacagtgaataaatttga

SEQ ID NO: 1013 - DNA, 37 bp, Artificial Sequence
  Synthetic oligonucleotide
gctccactatttaaccgtgagttgttaaccgggggga

SEQ ID NO: 1014 - DNA, 37 bp, Artificial Sequence
  Synthetic oligonucleotide
gctccagtaccgctgtacgaattatttaagaaaacga

SEQ ID NO: 1015 - DNA, 36 bp, Artificial Sequence
  Synthetic oligonucleotide
gcccacatttttttcgagtgtgtaaggggtgagaaa

SEQ ID NO: 1016 - DNA, 37 bp, Artificial Sequence
  Synthetic oligonucleotide
gcttattccggatgttgcctgcaattaggggactcga

SEQ ID NO: 1017 - DNA, 37 bp, Artificial Sequence
  Synthetic oligonucleotide
gcttgtctcgcggttttgaaagtaatctttaacgaga

SEQ ID NO: 1018 - DNA, 35 bp, Artificial Sequence
  Synthetic oligonucleotide
gcgcgaaagctcaaataaaactaaagtacaacaaa

SEQ ID NO: 1019 - DNA, 36 bp, Artificial Sequence
  Synthetic oligonucleotide
gctaagctgggagaaaatcacaccctcgatcgtaaa

SEQ ID NO: 1020 - DNA, 37 bp, Artificial Sequence
  Synthetic oligonucleotide
ctcacattagggctcggtaaatataacgatctgacga

SEQ ID NO: 1021 - DNA, 35 bp, Artificial Sequence
  Synthetic oligonucleotide
actgtagctattatgaaagtctgggttattggcct

SEQ ID NO: 1022 - DNA, 35 bp, Artificial Sequence
  Synthetic oligonucleotide
aatcgtatggagcgttgaacaaatgaacccgtagt

SEQ ID NO: 1023 - DNA, 38 bp, Artificial Sequence
  Synthetic oligonucleotide
agatatacttgaaaggtggtattatgaatgttgggtga

SEQ ID NO: 1024 - DNA, 38 bp, Artificial Sequence
  Synthetic oligonucleotide
atggtgactcaattaaaatgtgaggtgggggagctaga

SEQ ID NO: 1025 - DNA, 37 bp, Artificial Sequence
  Synthetic oligonucleotide
tcgtggagggtattgaccttctaatgatgggggggga

SEQ ID NO: 1026 - DNA, 38 bp, Artificial Sequence
  Synthetic oligonucleotide
ggttcctatgaaggacacggggggggaggtatcaatga

SEQ ID NO: 1027 - DNA, 37 bp, Artificial Sequence
  Synthetic oligonucleotide
aaggggcggtagactttaggggctgaatggggtggga

SEQ ID NO: 1028 - DNA, 37 bp, Artificial Sequence
  Synthetic oligonucleotide
gagtgcactggatgaattttgaggggggaaggaccga

SEQ ID NO: 1029 - DNA, 37 bp, Artificial Sequence
  Synthetic oligonucleotide
tgcggtgggtggtgggtgggaaataattatgtgggga

SEQ ID NO: 1030 - DNA, 37 bp, Artificial Sequence
  Synthetic oligonucleotide
taccagactggaagtcaatgatcatggttgtctccga

SEQ ID NO: 1031 - DNA, 36 bp, Artificial Sequence
  Synthetic oligonucleotide
aacggtacaacatctgctagagaactgcaacttcta

SEQ ID NO: 1032 - DNA, 36 bp, Artificial Sequence
  Synthetic oligonucleotide
actatatccaatgctatgcgcgcattcagggtagaa

SEQ ID NO: 1033 - DNA, 35 bp, Artificial Sequence
  Synthetic oligonucleotide
agcatcggccgatcgcctcaatcacgttttcgatt

SEQ ID NO: 1034 - DNA, 38 bp, Artificial Sequence
  Synthetic oligonucleotide
aggcttacaatacgttaccccttcttcgtagacggtga

SEQ ID NO: 1035 - DNA, 36 bp, Artificial Sequence
  Synthetic oligonucleotide
cttgacgtcacatttgcctaacactgtaggtcacaa

SEQ ID NO: 1036 - DNA, 35 bp, Artificial Sequence
  Synthetic oligonucleotide
tctggtagcacatgagtttggcattcctctctgca

SEQ ID NO: 1037 - DNA, 35 bp, Artificial Sequence
  Synthetic oligonucleotide
tgttgtccgtatatattccttgtgtgttaattccg

SEQ ID NO: 1038 - DNA, 35 bp, Artificial Sequence
  Synthetic oligonucleotide
gagcactataagtgtgtatctatttgtaactttct

SEQ ID NO: 1039 - DNA, 35 bp, Artificial Sequence
  Synthetic oligonucleotide
tgtggaggcactcttgtatgattgatttcgtatct

SEQ ID NO: 1040 - DNA, 36 bp, Artificial Sequence
  Synthetic oligonucleotide
aatctaacgcatcaaatacgtttgggtagtcattaa

SEQ ID NO: 1041 - DNA, 35 bp, Artificial Sequence
  Synthetic oligonucleotide
tggtcaacgttatcgtatcctactgatcactaact

SEQ ID NO: 1042 - DNA, 36 bp, Artificial Sequence
  Synthetic oligonucleotide
ttgtcgcaccacatcataggtgccacgatgtcccaa

SEQ ID NO: 1043 - DNA, 36 bp, Artificial Sequence
  Synthetic oligonucleotide
actgttacaacagaagggttagatcacatactacaa

SEQ ID NO: 1044 - DNA, 35 bp, Artificial Sequence
  Synthetic oligonucleotide
actcgagggaactaggaactactacaacagtgtgt

SEQ ID NO: 1045 - DNA, 38 bp, Artificial Sequence
  Synthetic oligonucleotide
ccatgaaactacaacatatcaagtcgagtgtggtgtga

SEQ ID NO: 1046 - DNA, 37 bp, Artificial Sequence
  Synthetic oligonucleotide
cggccgacgtagctcaaattctacactatggttgtga

SEQ ID NO: 1047 - DNA, 38 bp, Artificial Sequence
  Synthetic oligonucleotide
ggcagtactatcaacttacatgccaatattcgatgtga

SEQ ID NO: 1048 - DNA, 36 bp, Artificial Sequence
  Synthetic oligonucleotide
gctaccagcgttgcagtctgcggattctgtcaaata

SEQ ID NO: 1049 - DNA, 35 bp, Artificial Sequence
  Synthetic oligonucleotide
cttactcaaagtggcgtgtaggtcattaggttgta

SEQ ID NO: 1050 - DNA, 36 bp, Artificial Sequence
  Synthetic oligonucleotide
cgtagtactagcaacattagggtcgtaacataacta

SEQ ID NO: 1051 - DNA, 36 bp, Artificial Sequence
  Synthetic oligonucleotide
acgaccgtggggttagggcgcatattctttggctta

SEQ ID NO: 1052 - DNA, 37 bp, Artificial Sequence
  Synthetic oligonucleotide
tactctcatgggtatctttctgaatcgaacgttgtga

SEQ ID NO: 1053 - DNA, 35 bp, Artificial Sequence
  Synthetic oligonucleotide
gcggtttaacctcgaaagtaagggcgattaggcga

SEQ ID NO: 1054 - DNA, 35 bp, Artificial Sequence
  Synthetic oligonucleotide
gcgggttcaaattgaggaggaaagacgaaagctct

SEQ ID NO: 1055 - DNA, 38 bp, Artificial Sequence
  Synthetic oligonucleotide
gatcgaatcgatactgcagcggagtgacacgggtctaa

SEQ ID NO: 1056 - DNA, 35 bp, Artificial Sequence
  Synthetic oligonucleotide
tagtccgggtcgttttaaattcagtttggcatttt

SEQ ID NO: 1057 - DNA, 35 bp, Artificial Sequence
  Synthetic oligonucleotide
aaccaggcatagttggccgcaggcaaccccatttt

SEQ ID NO: 1058 - DNA, 35 bp, Artificial Sequence
  Synthetic oligonucleotide
agtccaaacacgaggttccgtcgcgagaactttaa

SEQ ID NO: 1059 - DNA, 37 bp, Artificial Sequence
  Synthetic oligonucleotide
agtccggcaaggggcgcaacttatcatagtcctctga

SEQ ID NO: 1060 - DNA, 35 bp, Artificial Sequence
  Synthetic oligonucleotide
taggctcccgcctttagcttagtttcagatagcaa

SEQ ID NO: 1061 - DNA, 35 bp, Artificial Sequence
  Synthetic oligonucleotide
cgcggtattttgcctcaaactagtcgttaatctat

SEQ ID NO: 1062 - DNA, 37 bp, Artificial Sequence
  Synthetic oligonucleotide
ttacttcgggagctaggctcacccctacattagtgga

SEQ ID NO: 1063 - DNA, 37 bp, Artificial Sequence
  Synthetic oligonucleotide
agtgcaattggatatatcagtgaggagtttcaattga

SEQ ID NO: 1064 - DNA, 37 bp, Artificial Sequence
  Synthetic oligonucleotide
ccgaaatcggggtagattatggggtcctggaaatcga

SEQ ID NO: 1065 - DNA, 38 bp, Artificial Sequence
  Synthetic oligonucleotide
taagtttgtagaatttaacgtatggaacggggacgtga

SEQ ID NO: 1066 - DNA, 35 bp, Artificial Sequence
  Synthetic oligonucleotide
tgagcgagcgcctgatattcggtactgcatatctc

SEQ ID NO: 1067 - DNA, 36 bp, Artificial Sequence
  Synthetic oligonucleotide
gatcgaattaggggaattcgttggaatcgacccata

SEQ ID NO: 1068 - DNA, 38 bp, Artificial Sequence
  Synthetic oligonucleotide
tctgtgcgaagggtttagtctcgggcgaaacttaatga

SEQ ID NO: 1069 - DNA, 38 bp, Artificial Sequence
  Synthetic oligonucleotide
agggaagtcctagttggagtgattttccgtgattctga

SEQ ID NO: 1070 - DNA, 38 bp, Artificial Sequence
  Synthetic oligonucleotide
aggaatggctagtctaagacaaactcctctgtttatga

SEQ ID NO: 1071 - DNA, 37 bp, Artificial Sequence
  Synthetic oligonucleotide
gattgtcacggatgattctggatttatataggtacga

SEQ ID NO: 1072 - DNA, 38 bp, Artificial Sequence
  Synthetic oligonucleotide
attcatgggagcttgaccggagttattgtttgttgtga

SEQ ID NO: 1073 - DNA, 35 bp, Artificial Sequence
  Synthetic oligonucleotide
tatcgaacttagatgtgacactgttttttagtcta

SEQ ID NO: 1074 - DNA, 37 bp, Artificial Sequence
  Synthetic oligonucleotide
agctacggcttatcgttggggtccaagttcatgaaga

SEQ ID NO: 1075 - DNA, 37 bp, Artificial Sequence
  Synthetic oligonucleotide
agtctaccccccaaattgttggtattccgagcataga

SEQ ID NO: 1076 - DNA, 35 bp, Artificial Sequence
  Synthetic oligonucleotide
tcgtcccaagctctggactggtaagttcttatgta

SEQ ID NO: 1077 - DNA, 36 bp, Artificial Sequence
  Synthetic oligonucleotide
tgctacagttcaacctcacgtttttgaactgcgtga

SEQ ID NO: 1078 - DNA, 37 bp, Artificial Sequence
  Synthetic oligonucleotide
cgtttggacgggggtgtccttttttttgatattacga

SEQ ID NO: 1079 - DNA, 37 bp, Artificial Sequence
  Synthetic oligonucleotide
ttcctcgtgttacaggcactttattagcctgtgggga

SEQ ID NO: 1080 - DNA, 36 bp, Artificial Sequence
  Synthetic oligonucleotide
cttggcccgttgaccacgacataatggtcttatata

SEQ ID NO: 1081 - DNA, 36 bp, Artificial Sequence
  Synthetic oligonucleotide
aggatatttaccctgcatcttttcgttacggtatga

SEQ ID NO: 1082 - DNA, 36 bp, Artificial Sequence
  Synthetic oligonucleotide
actgtctggaagtcggaactttcaccattatgatga

SEQ ID NO: 1083 - DNA, 38 bp, Artificial Sequence
  Synthetic oligonucleotide
gaatggaggaactttctcgtattcacgttttgttgtga

SEQ ID NO: 1084 - DNA, 38 bp, Artificial Sequence
  Synthetic oligonucleotide
aaccgttagtgcaaaggggagtacggcctttgttttga

SEQ ID NO: 1085 - DNA, 38 bp, Artificial Sequence
  Synthetic oligonucleotide
ctcgtacgcaaacgctttgaatagaacgtttgtcttga

SEQ ID NO: 1086 - DNA, 37 bp, Artificial Sequence
  Synthetic oligonucleotide
agatacccggtggttatcttaagggtgtgacttttga

SEQ ID NO: 1087 - DNA, 38 bp, Artificial Sequence
  Synthetic oligonucleotide
tagggttcagtatctggcgattctgttgatgttcctga

SEQ ID NO: 1088 - DNA, 38 bp, Artificial Sequence
  Synthetic oligonucleotide
cgagctcccttaagggtgcatcgggattcattgtttga

SEQ ID NO: 1089 - DNA, 38 bp, Artificial Sequence
  Synthetic oligonucleotide
cacatccggagaaggtgcgtttatacatgaatttctga

SEQ ID NO: 1090 - DNA, 38 bp, Artificial Sequence
  Synthetic oligonucleotide
aaggacgacgcggaacaatctgtagctatgactcttga

SEQ ID NO: 1091 - DNA, 37 bp, Artificial Sequence
  Synthetic oligonucleotide
acttgttcctgaagtgggtttgacttgcaaacgttga

SEQ ID NO: 1092 - DNA, 37 bp, Artificial Sequence
  Synthetic oligonucleotide
agtacacgcccgttggtttcgttcggaaattacttga

SEQ ID NO: 1093 - DNA, 37 bp, Artificial Sequence
  Synthetic oligonucleotide
tgaacatctttgttattcaacgggatcacgcaacgga

SEQ ID NO: 1094 - DNA, 36 bp, Artificial Sequence
  Synthetic oligonucleotide
taatccgatgcaatttgtatttactgacaatgcgta

SEQ ID NO: 1095 - DNA, 36 bp, Artificial Sequence
  Synthetic oligonucleotide
aactggaggatcccggaatttatcctcccatacgaa

SEQ ID NO: 1096 - DNA, 37 bp, Artificial Sequence
  Synthetic oligonucleotide
gaattgcggactgacagatagatgcggtgacattgga

SEQ ID NO: 1097 - DNA, 35 bp, Artificial Sequence
  Synthetic oligonucleotide
tcgcactagttctatgagggaaactacaggaacga

SEQ ID NO: 1098 - DNA, 37 bp, Artificial Sequence
  Synthetic oligonucleotide
gattgacctggaaggcaatagctggtcaacgactgga

SEQ ID NO: 1099 - DNA, 37 bp, Artificial Sequence
  Synthetic oligonucleotide
gcagtacggcacgagggatactctgccctatatatga

SEQ ID NO: 1100 - DNA, 37 bp, Artificial Sequence
  Synthetic oligonucleotide
gccatcatggatatatgcacgtatggtgcttttagga

SEQ ID NO: 1101 - DNA, 38 bp, Artificial Sequence
  Synthetic oligonucleotide
tgcgaaactctagatgattatgattaaacttgtactga

SEQ ID NO: 1102 - DNA, 37 bp, Artificial Sequence
  Synthetic oligonucleotide
aactgaccccattgggtcacccgtgatagttatcgga

SEQ ID NO: 1103 - DNA, 38 bp, Artificial Sequence
  Synthetic oligonucleotide
gtactgctctaggagaaaataaccgtatgaaacgatga

SEQ ID NO: 1104 - DNA, 38 bp, Artificial Sequence
  Synthetic oligonucleotide
ttgcgtatttgccttagaacgcaataaagcatttgtga

SEQ ID NO: 1105 - DNA, 38 bp, Artificial Sequence
  Synthetic oligonucleotide
atctacactggaactgacagggggtagtagtatcctga

SEQ ID NO: 1106 - DNA, 38 bp, Artificial Sequence
  Synthetic oligonucleotide
tagggattgaatctcctctaacattcgacaacaggtga

SEQ ID NO: 1107 - DNA, 38 bp, Artificial Sequence
  Synthetic oligonucleotide
agcgttcaacgcggttgagtgggtgccgaactatatga

SEQ ID NO: 1108 - DNA, 38 bp, Artificial Sequence
  Synthetic oligonucleotide
ggacctgatgccatttagtgtggataatgttattgtga

SEQ ID NO: 1109 - DNA, 35 bp, Artificial Sequence
  Synthetic oligonucleotide
tgatatctaggaaccatgcggtaatggtccgagta

SEQ ID NO: 1110 - DNA, 37 bp, Artificial Sequence
  Synthetic oligonucleotide
tgaaagccgtgactggtattaacggcaaataacggga

SEQ ID NO: 1111 - DNA, 36 bp, Artificial Sequence
  Synthetic oligonucleotide
tgcatgatacgggcttcaaggagcttcttattcgta

SEQ ID NO: 1112 - DNA, 37 bp, Artificial Sequence
  Synthetic oligonucleotide
agacacattgtgtgcaacatggaagtggtctttagga

SEQ ID NO: 1113 - DNA, 38 bp, Artificial Sequence
  Synthetic oligonucleotide
gagttgctctatgtacttcctgagggggtatgtgatga

SEQ ID NO: 1114 - DNA, 37 bp, Artificial Sequence
  Synthetic oligonucleotide
cctgttatctatacttgcgtgagcaaattactttaga

SEQ ID NO: 1115 - DNA, 38 bp, Artificial Sequence
  Synthetic oligonucleotide
tggagtacgcgtgcgttacagtccgaataaggctttga

SEQ ID NO: 1116 - DNA, 38 bp, Artificial Sequence
  Synthetic oligonucleotide
cacagtcaggcgtaatgagaatgagcactttggtttga

SEQ ID NO: 1117 - DNA, 36 bp, Artificial Sequence
  Synthetic oligonucleotide
tcatttacgtgagtaacctggcttagtatcggagta

SEQ ID NO: 1118 - DNA, 38 bp, Artificial Sequence
  Synthetic oligonucleotide
gatggaacgtagcgaaaccgggtttacgcgtgatctga

SEQ ID NO: 1119 - DNA, 37 bp, Artificial Sequence
  Synthetic oligonucleotide
taattatcgtcgtgagatcgatactacggttgtgcga

SEQ ID NO: 1120 - DNA, 35 bp, Artificial Sequence
  Synthetic oligonucleotide
gaggactggcattaccgtggtcagctaaactagac

SEQ ID NO: 1121 - DNA, 37 bp, Artificial Sequence
  Synthetic oligonucleotide
tgcagcatacctaattgttcaccgttgggaaaggtga

SEQ ID NO: 1122 - DNA, 36 bp, Artificial Sequence
  Synthetic oligonucleotide
agctttgtaatacgtgagtttgggtaggtcatcgta

SEQ ID NO: 1123 - DNA, 35 bp, Artificial Sequence
  Synthetic oligonucleotide
cctgcgtcctaaacggataacgaaaacgaatactc

SEQ ID NO: 1124 - DNA, 35 bp, Artificial Sequence
  Synthetic oligonucleotide
ccctgcacgaacgaaccggaataaatcgatggtga

SEQ ID NO: 1125 - DNA, 36 bp, Artificial Sequence
  Synthetic oligonucleotide
gcgcttttctcaaccgacgaccatcgaatagaagaa

SEQ ID NO: 1126 - DNA, 36 bp, Artificial Sequence
  Synthetic oligonucleotide
ttaggctaaggaacgggacccattcgatgaaaatca

SEQ ID NO: 1127 - DNA, 36 bp, Artificial Sequence
  Synthetic oligonucleotide
tcggagtttgcaatccggcaattattagattacaca

SEQ ID NO: 1128 - DNA, 35 bp, Artificial Sequence
  Synthetic oligonucleotide
accggaaatgaaccgtcgcttattccacgaattag

SEQ ID NO: 1129 - DNA, 35 bp, Artificial Sequence
  Synthetic oligonucleotide
gagaattgcggtaaatttcggggcaatatcctctc

SEQ ID NO: 1130 - DNA, 36 bp, Artificial Sequence
  Synthetic oligonucleotide
acgccccgaatgatcggtgggctgtattttacaata

SEQ ID NO: 1131 - DNA, 37 bp, Artificial Sequence
  Synthetic oligonucleotide
gagtagtgggctcacgggggcagtatatcggatacga

SEQ ID NO: 1132 - DNA, 36 bp, Artificial Sequence
  Synthetic oligonucleotide
gagtgcgatggcgtccacggggatttttcggaataa

SEQ ID NO: 1133 - DNA, 36 bp, Artificial Sequence
  Synthetic oligonucleotide
accacgtacaaggaagttaggattcggggaccgtga

SEQ ID NO: 1134 - DNA, 35 bp, Artificial Sequence
  Synthetic oligonucleotide
gaaagctcaagctaatgagaatacgatcatacacc

SEQ ID NO: 1135 - DNA, 36 bp, Artificial Sequence
  Synthetic oligonucleotide
aggacgacgaatttactctaggggtgggctggttaa

SEQ ID NO: 1136 - DNA, 37 bp, Artificial Sequence
  Synthetic oligonucleotide
gtacactggtgtgattgttgtggtggagttggtaaga

SEQ ID NO: 1137 - DNA, 36 bp, Artificial Sequence
  Synthetic oligonucleotide
gggtagtacggggagcactgggctagattgtgacta

SEQ ID NO: 1138 - DNA, 35 bp, Artificial Sequence
  Synthetic oligonucleotide
ggtggaacgggggttgggattgtaagggagtatgt

SEQ ID NO: 1139 - DNA, 37 bp, Artificial Sequence
  Synthetic oligonucleotide
acggtaaaaagggcaatgcttggcgtctatcagacga

SEQ ID NO: 1140 - DNA, 35 bp, Artificial Sequence
  Synthetic oligonucleotide
gtgtggaccggctagtaaaggctgttggggtaatt

SEQ ID NO: 1141 - DNA, 35 bp, Artificial Sequence
  Synthetic oligonucleotide
gcctatcggtggatagtttggtcattcattggagc

SEQ ID NO: 1142 - DNA, 37 bp, Artificial Sequence
  Synthetic oligonucleotide
actctccatgggtggggctcccgaaagaatttctaga

SEQ ID NO: 1143 - DNA, 37 bp, Artificial Sequence
  Synthetic oligonucleotide
ttaaagccatcaaaatctatctaaagttgtagaagga

SEQ ID NO: 1144 - DNA, 37 bp, Artificial Sequence
  Synthetic oligonucleotide
gtctacataatttgtatacggtttaaaatctcgagga

SEQ ID NO: 1145 - DNA, 38 bp, Artificial Sequence
  Synthetic oligonucleotide
tctcggagtagaatccaccagaatcacaggaattctga

SEQ ID NO: 1146 - DNA, 35 bp, Artificial Sequence
  Synthetic oligonucleotide
gaaaggtgccaatcgccggtacacaatttaggaaa

SEQ ID NO: 1147 - DNA, 35 bp, Artificial Sequence
  Synthetic oligonucleotide
cataaacaccttatgaatttatgtagaaatcgaaa

SEQ ID NO: 1148 - DNA, 34 bp, Artificial Sequence
  Synthetic oligonucleotide
gaaccgaagtagtagatttaattatacataatgt

SEQ ID NO: 1149 - DNA, 36 bp, Artificial Sequence
  Synthetic oligonucleotide
gccgcaatacaaacgagaggcttctcccgattaata

SEQ ID NO: 1150 - DNA, 35 bp, Artificial Sequence
  Synthetic oligonucleotide
acctgcggaatatcgtgagaattgaaaaaagcaaa

SEQ ID NO: 1151 - DNA, 38 bp, Artificial Sequence
  Synthetic oligonucleotide
taggcgaatcgaaaaaaagtaatcattatgggttgtga

SEQ ID NO: 1152 - DNA, 37 bp, Artificial Sequence
  Synthetic oligonucleotide
ataccggaccaaggacgccggggtactaaggactcga

SEQ ID NO: 1153 - DNA, 37 bp, Artificial Sequence
  Synthetic oligonucleotide
cgcataatagtcgacgtttttttttgtcggattcgga

SEQ ID NO: 1154 - DNA, 38 bp, Artificial Sequence
  Synthetic oligonucleotide
acaggaaggccaaagtttttccaaggtcgattgcctga

SEQ ID NO: 1155 - DNA, 36 bp, Artificial Sequence
  Synthetic oligonucleotide
gaaatcgtttggtaatttagttcggaacccagggta

SEQ ID NO: 1156 - DNA, 35 bp, Artificial Sequence
  Synthetic oligonucleotide
aaaacgtctcatgcggcctttcgagggcatatctc

SEQ ID NO: 1157 - DNA, 38 bp, Artificial Sequence
  Synthetic oligonucleotide
aaggttcgagaattctcactgcagatcatccgtcatga

SEQ ID NO: 1158 - DNA, 35 bp, Artificial Sequence
  Synthetic oligonucleotide
agtgctctctcttgggggtagtcatccagaatagt

SEQ ID NO: 1159 - DNA, 35 bp, Artificial Sequence
  Synthetic oligonucleotide
taagtcccaatttatttgaagacgttgtaatcgtc

SEQ ID NO: 1160 - DNA, 36 bp, Artificial Sequence
  Synthetic oligonucleotide
aaaacaggctaaaaaggtacatccccattttgctta

SEQ ID NO: 1161 - DNA, 37 bp, Artificial Sequence
  Synthetic oligonucleotide
gtgcgcaaggtttagcgcatacgtagttgaataccga

SEQ ID NO: 1162 - DNA, 37 bp, Artificial Sequence
  Synthetic oligonucleotide
ttccaagtacccaggtttagacctgggacgatagcga

SEQ ID NO: 1163 - DNA, 35 bp, Artificial Sequence
  Synthetic oligonucleotide
tttccaccaaccctgatttgaaaaagacacgcaaa

SEQ ID NO: 1164 - DNA, 35 bp, Artificial Sequence
  Synthetic oligonucleotide
ctccgcccaacgagagttctacgtaaagatcaaac

SEQ ID NO: 1165 - DNA, 37 bp, Artificial Sequence
  Synthetic oligonucleotide
tgtcccgcgcttgacatcatcctaagattaaagaaga

SEQ ID NO: 1166 - DNA, 35 bp, Artificial Sequence
  Synthetic oligonucleotide
attaccgttaatttaaagtacccacgggttgttgg

SEQ ID NO: 1167 - DNA, 37 bp, Artificial Sequence
  Synthetic oligonucleotide
gcatcgtggaaagattctcttataatcaattggggga

SEQ ID NO: 1168 - DNA, 35 bp, Artificial Sequence
  Synthetic oligonucleotide
acacacacggggtagatcacataggcaaacgcttg

SEQ ID NO: 1169 - DNA, 36 bp, Artificial Sequence
  Synthetic oligonucleotide
acaaacgtactaagggcgaagccttttactcgcgca

SEQ ID NO: 1170 - DNA, 38 bp, Artificial Sequence
  Synthetic oligonucleotide
cgtgcaaaccgctgtaagcattcaaaccaactggatga

SEQ ID NO: 1171 - DNA, 35 bp, Artificial Sequence
  Synthetic oligonucleotide
acacaaacacaatctaggagttaaatacagttgga

SEQ ID NO: 1172 - DNA, 35 bp, Artificial Sequence
  Synthetic oligonucleotide
actttcacgatgttgggggggcccaattacagatg

SEQ ID NO: 1173 - DNA, 35 bp, Artificial Sequence
  Synthetic oligonucleotide
acgtttagattaagttcgcttatgaatgtgggatt

SEQ ID NO: 1174 - DNA, 37 bp, Artificial Sequence
  Synthetic oligonucleotide
attgccgttgatgttcgtgattttattaagtggggga

SEQ ID NO: 1175 - DNA, 37 bp, Artificial Sequence
  Synthetic oligonucleotide
gttcttaggcctgttgttaccaggattttcgtgtaga

SEQ ID NO: 1176 - DNA, 36 bp, Artificial Sequence
  Synthetic oligonucleotide
agtccggatacctgtttgtatgcgaaagggaattta

SEQ ID NO: 1177 - DNA, 35 bp, Artificial Sequence
  Synthetic oligonucleotide
gttaatgtcaatctgaaccgacgtgagtattcggc

SEQ ID NO: 1178 - DNA, 37 bp, Artificial Sequence
  Synthetic oligonucleotide
accacggttgggttgcggctaacgtatagccgatgga

SEQ ID NO: 1179 - DNA, 36 bp, Artificial Sequence
  Synthetic oligonucleotide
gtgccttggttgtaattggactttatggctacctaa

SEQ ID NO: 1180 - DNA, 38 bp, Artificial Sequence
  Synthetic oligonucleotide
gatttgcgagtgtgaaacgaattatagcacacgtctga

SEQ ID NO: 1181 - DNA, 35 bp, Artificial Sequence
  Synthetic oligonucleotide
atgctggtgaaccaaactcaagcatgacatttaag

SEQ ID NO: 1182 - DNA, 36 bp, Artificial Sequence
  Synthetic oligonucleotide
cctgcccacgaattgtatatgtaattgcactatcga

SEQ ID NO: 1183 - DNA, 35 bp, Artificial Sequence
  Synthetic oligonucleotide
tctgcaggacttttgattcgtgggttcaacctcat

SEQ ID NO: 1184 - DNA, 37 bp, Artificial Sequence
  Synthetic oligonucleotide
gcacattatgtcacgtagaggcacagtcggtaatcga

SEQ ID NO: 1185 - DNA, 36 bp, Artificial Sequence
  Synthetic oligonucleotide
gggctacgttatcccattcaattcgaattaaatgta

SEQ ID NO: 1186 - DNA, 36 bp, Artificial Sequence
  Synthetic oligonucleotide
acattgccgaattaattcgttgtcgaggaaagacaa

SEQ ID NO: 1187 - DNA, 35 bp, Artificial Sequence
  Synthetic oligonucleotide
cccacgtgttacgggttttatcatgacatcactat

SEQ ID NO: 1188 - DNA, 35 bp, Artificial Sequence
  Synthetic oligonucleotide
catgcacgttttattgtggaaatgtaagcttgggc

SEQ ID NO: 1189 - DNA, 37 bp, Artificial Sequence
  Synthetic oligonucleotide
tgcaagggaaatacgttcctgtgttgtttcgatgaga

SEQ ID NO: 1190 - DNA, 35 bp, Artificial Sequence
  Synthetic oligonucleotide
tgggcagtctctatttgtcattacggttttatgtc

SEQ ID NO: 1191 - DNA, 38 bp, Artificial Sequence
  Synthetic oligonucleotide
agcaggcaacagtatcagccctatttgtcgtaaaatga

SEQ ID NO: 1192 - DNA, 38 bp, Artificial Sequence
  Synthetic oligonucleotide
ggctacgggaaagatgtcacgtctgtttcatttgatga

SEQ ID NO: 1193 - DNA, 35 bp, Artificial Sequence
  Synthetic oligonucleotide
actacgttttaatttcagtaacccatccgatgctc

SEQ ID NO: 1194 - DNA, 36 bp, Artificial Sequence
  Synthetic oligonucleotide
aacaaacgccaaccatatggtaggattcctctttta

SEQ ID NO: 1195 - DNA, 36 bp, Artificial Sequence
  Synthetic oligonucleotide
tgataaccatcggtacctcaccgctcccaactctta

SEQ ID NO: 1196 - DNA, 36 bp, Artificial Sequence
  Synthetic oligonucleotide
cgaaccgacgaaatttccacaccgctttgtatgtta

SEQ ID NO: 1197 - DNA, 35 bp, Artificial Sequence
  Synthetic oligonucleotide
tacctcatgtttgtcactatggaaatcatcccgac

SEQ ID NO: 1198 - DNA, 36 bp, Artificial Sequence
  Synthetic oligonucleotide
agttatttctcgccacataacactctatggaaacta

SEQ ID NO: 1199 - DNA, 36 bp, Artificial Sequence
  Synthetic oligonucleotide
atctcggatttcccgtaggtcactggcacatttcta

SEQ ID NO: 1200 - DNA, 37 bp, Artificial Sequence
  Synthetic oligonucleotide
aattttccgctgggacgaatttctaaccctatttgga

SEQ ID NO: 1201 - DNA, 35 bp, Artificial Sequence
  Synthetic oligonucleotide
gaagcaccgaatcacctggcatggccctttatcta

SEQ ID NO: 1202 - DNA, 35 bp, Artificial Sequence
  Synthetic oligonucleotide
actgccgacgcacaacttgggtggggctctaattt

SEQ ID NO: 1203 - DNA, 35 bp, Artificial Sequence
  Synthetic oligonucleotide
ttcgctgacctcaccggacatatcatttaaagcta

SEQ ID NO: 1204 - DNA, 35 bp, Artificial Sequence
  Synthetic oligonucleotide
tcccttattatgcgaaacaaatatgtagttcttac

SEQ ID NO: 1205 - DNA, 35 bp, Artificial Sequence
  Synthetic oligonucleotide
tctaaaactcacgctaggtggtacaaccgattcta

SEQ ID NO: 1206 - DNA, 36 bp, Artificial Sequence
  Synthetic oligonucleotide
gtagccaacgaagctcgcgtattctatttgccctta

SEQ ID NO: 1207 - DNA, 36 bp, Artificial Sequence
  Synthetic oligonucleotide
acctcaccaagtccttaaggattctgtattcataaa

SEQ ID NO: 1208 - DNA, 35 bp, Artificial Sequence
  Synthetic oligonucleotide
agaatctggctattgatccccacacattgcgaaaa

SEQ ID NO: 1209 - DNA, 35 bp, Artificial Sequence
  Synthetic oligonucleotide
acctaccaatctagatccgcttttatggattgctc

SEQ ID NO: 1210 - DNA, 35 bp, Artificial Sequence
  Synthetic oligonucleotide
gacttctaaacacatggggtgcccgcaacatattt

SEQ ID NO: 1211 - DNA, 38 bp, Artificial Sequence
  Synthetic oligonucleotide
tccagaacgtcagctctccatacgcaattaattcatga

SEQ ID NO: 1212 - DNA, 35 bp, Artificial Sequence
  Synthetic oligonucleotide
gacggccttataaggcactcctcattcatttaata

SEQ ID NO: 1213 - DNA, 38 bp, Artificial Sequence
  Synthetic oligonucleotide
gggacctgcaagcctatcaacgggttatacatttgtga

SEQ ID NO: 1214 - DNA, 36 bp, Artificial Sequence
  Synthetic oligonucleotide
tacacttccatttgatgcgctcaccttgaatctgta

SEQ ID NO: 1215 - DNA, 36 bp, Artificial Sequence
  Synthetic oligonucleotide
aatcgaactcattactttccaatggacctgggagaa

SEQ ID NO: 1216 - DNA, 36 bp, Artificial Sequence
  Synthetic oligonucleotide
agtttacgagttacactacaacggacgaatctttta

SEQ ID NO: 1217 - DNA, 35 bp, Artificial Sequence
  Synthetic oligonucleotide
aacttttctggctttatacacatacggttgccatt

SEQ ID NO: 1218 - DNA, 36 bp, Artificial Sequence
  Synthetic oligonucleotide
agaactgggccttggaatcacacacctaactagtta

SEQ ID NO: 1219 - DNA, 36 bp, Artificial Sequence
  Synthetic oligonucleotide
attcgcactaataacatgttgctccattcaacctaa

SEQ ID NO: 1220 - DNA, 35 bp, Artificial Sequence
  Synthetic oligonucleotide
tatctgctgttttctctggtgccaataactacatc

SEQ ID NO: 1221 - DNA, 37 bp, Artificial Sequence
  Synthetic oligonucleotide
ttgcacataattttctgctttaaccaagcgaacccga

SEQ ID NO: 1222 - DNA, 35 bp, Artificial Sequence
  Synthetic oligonucleotide
taaaattctgaaaatacacgtgtctttcgcattac

SEQ ID NO: 1223 - DNA, 35 bp, Artificial Sequence
  Synthetic oligonucleotide
tcccgaacacatcccccttttaagggctttgctaa

SEQ ID NO: 1224 - DNA, 38 bp, Artificial Sequence
  Synthetic oligonucleotide
aaccacacggggctctcatcgatacttctagtgattga

SEQ ID NO: 1225 - DNA, 35 bp, Artificial Sequence
  Synthetic oligonucleotide
atctagaattccgtttgcgcgagtaacttccctgt

SEQ ID NO: 1226 - DNA, 36 bp, Artificial Sequence
  Synthetic oligonucleotide
cccgcttatcgctagtacctcatttagaattggaaa

SEQ ID NO: 1227 - DNA, 36 bp, Artificial Sequence
  Synthetic oligonucleotide
acctgtaaatttggctcacttttcctttacactgga

SEQ ID NO: 1228 - DNA, 35 bp, Artificial Sequence
  Synthetic oligonucleotide
aatagtatcacacctatctggcttcctgtacccgt

SEQ ID NO: 1229 - DNA, 38 bp, Artificial Sequence
  Synthetic oligonucleotide
acccacccttgagcaccattaaatagtgatttcgctga

SEQ ID NO: 1230 - DNA, 37 bp, Artificial Sequence
  Synthetic oligonucleotide
tcacgaaccctttagctctattttgtttgacgcatga

SEQ ID NO: 1231 - DNA, 37 bp, Artificial Sequence
  Synthetic oligonucleotide
gaggaacgtttctcccctcaacatttaaataaacaga

SEQ ID NO: 1232 - DNA, 35 bp, Artificial Sequence
  Synthetic oligonucleotide
atcctacgcataattctcgaggatctatttcgaaa

SEQ ID NO: 1233 - DNA, 36 bp, Artificial Sequence
  Synthetic oligonucleotide
tgcccgcaattacccctagatccacagcttggttta

SEQ ID NO: 1234 - DNA, 38 bp, Artificial Sequence
  Synthetic oligonucleotide
ggctcttatacaaaacattgggttctcgacctccctga

SEQ ID NO: 1235 - DNA, 36 bp, Artificial Sequence
  Synthetic oligonucleotide
gtgagctgctaatatttatcctgaacttgcttacga

SEQ ID NO: 1236 - DNA, 35 bp, Artificial Sequence
  Synthetic oligonucleotide
agttaccttacaacgaggtttcttgaatggattct

SEQ ID NO: 1237 - DNA, 35 bp, Artificial Sequence
  Synthetic oligonucleotide
ttacaccatccctacgcggtaatagcaactctgtt

SEQ ID NO: 1238 - DNA, 36 bp, Artificial Sequence
  Synthetic oligonucleotide
gcaccacgcacctgtggggattccctaatgtcttta

SEQ ID NO: 1239 - DNA, 35 bp, Artificial Sequence
  Synthetic oligonucleotide
ctatcggactaatacacgtaaaaataactctggtt

SEQ ID NO: 1240 - DNA, 35 bp, Artificial Sequence
  Synthetic oligonucleotide
ggcgtacttatcacaaacggtggaaccacacttct

SEQ ID NO: 1241 - DNA, 37 bp, Artificial Sequence
  Synthetic oligonucleotide
tattcttatccaacccacgaaatcaattgtattttga

SEQ ID NO: 1242 - DNA, 35 bp, Artificial Sequence
  Synthetic oligonucleotide
agatccgaatccgtaactccaaaatatttatgcac

SEQ ID NO: 1243 - DNA, 38 bp, Artificial Sequence
  Synthetic oligonucleotide
actatagaacaatccaccgctttaaatcaactatctta

SEQ ID NO: 1244 - DNA, 35 bp, Artificial Sequence
  Synthetic oligonucleotide
gccgttcttctgcgacgaacacatcctcccttaat

SEQ ID NO: 1245 - DNA, 35 bp, Artificial Sequence
  Synthetic oligonucleotide
gcgcgaggcccgcgggctcatcacttttgttatct

SEQ ID NO: 1246 - DNA, 38 bp, Artificial Sequence
  Synthetic oligonucleotide
tacccctgacaatcctcgcgccgaggcctccatcctga

SEQ ID NO: 1247 - DNA, 36 bp, Artificial Sequence
  Synthetic oligonucleotide
ttcggtctaatttttagcggccaaattttcttatca

SEQ ID NO: 1248 - DNA, 36 bp, Artificial Sequence
  Synthetic oligonucleotide
gattttaaaacccttgcacctgattgtgccaatcca

SEQ ID NO: 1249 - DNA, 35 bp, Artificial Sequence
  Synthetic oligonucleotide
gcgcgaggcccgcgggctcatcacttttgttatat

SEQ ID NO: 1250 - DNA, 35 bp, Artificial Sequence
  Synthetic oligonucleotide
gccgttcttctgcgacgaacacatcctcccttact

SEQ ID NO: 1251 - DNA, 36 bp, Artificial Sequence
  Synthetic oligonucleotide
tgctcggccctattaacacgtgccgtgtcttgttca

SEQ ID NO: 1252 - DNA, 38 bp, Artificial Sequence
  Synthetic oligonucleotide
tcgcgccgaccgtattacaccaactctatggactctaa

SEQ ID NO: 1253 - DNA, 36 bp, Artificial Sequence
  Synthetic oligonucleotide
aacccaattcacatacactctcacccccactaaaca

SEQ ID NO: 1254 - DNA, 35 bp, Artificial Sequence
  Synthetic oligonucleotide
gccgttcttctgcgacgaacacatcctcccttatt

SEQ ID NO: 1255 - DNA, 35 bp, Artificial Sequence
  Synthetic oligonucleotide
gcgcgaggcccgcgggctcatcacttttgttatgt

SEQ ID NO: 1256 - DNA, 38 bp, Artificial Sequence
  Synthetic oligonucleotide
tacccctgacaatcctcgcgccgaggcctccatcctca

SEQ ID NO: 1257 - DNA, 36 bp, Artificial Sequence
  Synthetic oligonucleotide
ttccgcgcaaacgaatgactctttgttgaaaaacga

SEQ ID NO: 1258 - DNA, 36 bp, Artificial Sequence
  Synthetic oligonucleotide
gcgtagtggctgcttggcgtttccgcatactaggca

SEQ ID NO: 1259 - DNA, 37 bp, Artificial Sequence
  Synthetic oligonucleotide
aaacctcggctaaccgccaagggtagtgtcccccgca

SEQ ID NO: 1260 - DNA, 38 bp, Artificial Sequence
  Synthetic oligonucleotide
atgagacgtagcaacactcgagacccttggagcactca

SEQ ID NO: 1261 - DNA, 36 bp, Artificial Sequence
  Synthetic oligonucleotide
agctgccagggttcgggaccttaacggatgtcccaa

SEQ ID NO: 1262 - DNA, 37 bp, Artificial Sequence
  Synthetic oligonucleotide
tcacgagcttccactacgtctatccgcgtagacggaa

SEQ ID NO: 1263 - DNA, 37 bp, Artificial Sequence
  Synthetic oligonucleotide
gatcgacgattcgatcatccaacgtatttacaccaga

SEQ ID NO: 1264 - DNA, 36 bp, Artificial Sequence
  Synthetic oligonucleotide
gcagccggcgaccgggatgtcgtcgggacttgctta

SEQ ID NO: 1265 - DNA, 38 bp, Artificial Sequence
  Synthetic oligonucleotide
atgaaccatggttacacctctaatgtagcctcatgtca

SEQ ID NO: 1266 - DNA, 37 bp, Artificial Sequence
  Synthetic oligonucleotide
ccaccggtacttattattcgccatccacacccagtta

SEQ ID NO: 1267 - DNA, 35 bp, Artificial Sequence
  Synthetic oligonucleotide
tagttacgccactactctgtgggagaaacccgaga

SEQ ID NO: 1268 - DNA, 38 bp, Artificial Sequence
  Synthetic oligonucleotide
atccacccaaaatcgatataagtgcgcccccaatctaa

SEQ ID NO: 1269 - DNA, 35 bp, Artificial Sequence
  Synthetic oligonucleotide
aggggggaaagtcatcgggtggctgtactacttca

SEQ ID NO: 1270 - DNA, 37 bp, Artificial Sequence
  Synthetic oligonucleotide
gggggtcgtactcccgagatttgcgttacggtgaaca

SEQ ID NO: 1271 - DNA, 37 bp, Artificial Sequence
  Synthetic oligonucleotide
gagtatcctctggtcgttcggtacagaaacggtgtaa

SEQ ID NO: 1272 - DNA, 37 bp, Artificial Sequence
  Synthetic oligonucleotide
acatggcctttaaatctacggagtactgttgggggga

SEQ ID NO: 1273 - DNA, 36 bp, Artificial Sequence
  Synthetic oligonucleotide
gcgtagtggctgcttggcgtttccgcatactaggaa

SEQ ID NO: 1274 - DNA, 36 bp, Artificial Sequence
  Synthetic oligonucleotide
tccgataccgaacttcactccgtgggcggggttgaa

SEQ ID NO: 1275 - DNA, 38 bp, Artificial Sequence
  Synthetic oligonucleotide
gcagtgttatttctcttggtttctttgatttcacttaa

SEQ ID NO: 1276 - DNA, 38 bp, Artificial Sequence
  Synthetic oligonucleotide
acatccagatacccttgacttaagattgtgaccactaa

SEQ ID NO: 1277 - DNA, 37 bp, Artificial Sequence
  Synthetic oligonucleotide
acaggttctgcgaccagaaagttaggactaacctaga

SEQ ID NO: 1278 - DNA, 38 bp, Artificial Sequence
  Synthetic oligonucleotide
gcagtgttatttctcttggtttctttgatttcacttca

SEQ ID NO: 1279 - DNA, 37 bp, Artificial Sequence
  Synthetic oligonucleotide
ccgcagttttgttcccgggggaatccggactgaacga

SEQ ID NO: 1280 - DNA, 37 bp, Artificial Sequence
  Synthetic oligonucleotide
aggtccggttcctatggactgcctgaccccgcgaaga

SEQ ID NO: 1281 - DNA, 35 bp, Artificial Sequence
  Synthetic oligonucleotide
ttgtaacgatttgggagtccagagactcgctgttt

SEQ ID NO: 1282 - DNA, 37 bp, Artificial Sequence
  Synthetic oligonucleotide
tttgatttaagtactcccgcgttcctccgaataccca

SEQ ID NO: 1283 - DNA, 38 bp, Artificial Sequence
  Synthetic oligonucleotide
gcagagcgcacgtgtactcaatgggttgttaattttaa

SEQ ID NO: 1284 - DNA, 36 bp, Artificial Sequence
  Synthetic oligonucleotide
gaactctgtattattcctgtcattagccgttggtaa

SEQ ID NO: 1285 - DNA, 38 bp, Artificial Sequence
  Synthetic oligonucleotide
gaggccctaccgtgtattttgataatggatttgtttaa

SEQ ID NO: 1286 - DNA, 38 bp, Artificial Sequence
  Synthetic oligonucleotide
tgtaatcacgggtgcgaactcgagagaatttgtgctaa

SEQ ID NO: 1287 - DNA, 38 bp, Artificial Sequence
  Synthetic oligonucleotide
ggccggtagtccacgctttcgcgagatagtgactgtga

SEQ ID NO: 1288 - DNA, 36 bp, Artificial Sequence
  Synthetic oligonucleotide
aggtcctcagaacttgtgcgtgagcaaagaatgaag

SEQ ID NO: 1289 - DNA, 38 bp, Artificial Sequence
  Synthetic oligonucleotide
gagtatctgggttcgagagcgcatttgcccgctgttga

SEQ ID NO: 1290 - DNA, 35 bp, Artificial Sequence
  Synthetic oligonucleotide
gtattaatcttcgctgtgggagagcgattacgcca

SEQ ID NO: 1291 - DNA, 36 bp, Artificial Sequence
  Synthetic oligonucleotide
tatccttggatcaccgatcgatgcgagaggtagtaa

SEQ ID NO: 1292 - DNA, 38 bp, Artificial Sequence
  Synthetic oligonucleotide
ttttctacgtgacggagagtccagatcgaagacaaaga

SEQ ID NO: 1293 - DNA, 36 bp, Artificial Sequence
  Synthetic oligonucleotide
acaatgcatcgtagcgggtctcggagctcgccttaa

SEQ ID NO: 1294 - DNA, 37 bp, Artificial Sequence
  Synthetic oligonucleotide
tacaaagaacggaagctattcaaaaacacacggagga

SEQ ID NO: 1295 - DNA, 35 bp, Artificial Sequence
  Synthetic oligonucleotide
ggacgaccggatatagtaaagtccccggcttctgt

SEQ ID NO: 1296 - DNA, 37 bp, Artificial Sequence
  Synthetic oligonucleotide
agccatcatgttggcacggtcctttgataccattgga

SEQ ID NO: 1297 - DNA, 36 bp, Artificial Sequence
  Synthetic oligonucleotide
attaccgtcaacgggtcctgggctccatacgaggca

SEQ ID NO: 1298 - DNA, 35 bp, Artificial Sequence
  Synthetic oligonucleotide
ctgctttaggtgtggtcgcactcaaatgtgaatgg

SEQ ID NO: 1299 - DNA, 36 bp, Artificial Sequence
  Synthetic oligonucleotide
gcggggtaagaactcgatgaggtgagtggatttgta

SEQ ID NO: 1300 - DNA, 35 bp, Artificial Sequence
  Synthetic oligonucleotide
aagggattggaacttggatgttttcagttggcgca

SEQ ID NO: 1301 - DNA, 38 bp, Artificial Sequence
  Synthetic oligonucleotide
tgcctcggctagcatcacaatagatggtttgcacttga

SEQ ID NO: 1302 - DNA, 38 bp, Artificial Sequence
  Synthetic oligonucleotide
gagacgaaggcaccttttcgacgcgataagctcgttga

SEQ ID NO: 1303 - DNA, 36 bp, Artificial Sequence
  Synthetic oligonucleotide
accgcgaggtcttttggaacagggcatatgaatcca

SEQ ID NO: 1304 - DNA, 37 bp, Artificial Sequence
  Synthetic oligonucleotide
acgtgaaactaccgagcggtgcttttcgctgtagcga

SEQ ID NO: 1305 - DNA, 37 bp, Artificial Sequence
  Synthetic oligonucleotide
caacgcctgactactgtagagtgaacgctggtggtga

SEQ ID NO: 1306 - DNA, 38 bp, Artificial Sequence
  Synthetic oligonucleotide
gcgaaggtttgggtaaaaggaaatagactttgttgtga

SEQ ID NO: 1307 - DNA, 36 bp, Artificial Sequence
  Synthetic oligonucleotide
acaagtcgctgctcagcttcctagggcagtactcaa

SEQ ID NO: 1308 - DNA, 36 bp, Artificial Sequence
  Synthetic oligonucleotide
aaacgggatctgtcgcgagtacagtgttgcccagta

SEQ ID NO: 1309 - DNA, 36 bp, Artificial Sequence
  Synthetic oligonucleotide
taaaggaacagcgattcgggctgttattttaggtga

SEQ ID NO: 1310 - DNA, 36 bp, Artificial Sequence
  Synthetic oligonucleotide
tgtgggattattgtagttgtagtaaggtgaccggca

SEQ ID NO: 1311 - DNA, 36 bp, Artificial Sequence
  Synthetic oligonucleotide
cgctaaccggaactaggttgcaaagctatggtggta

SEQ ID NO: 1312 - DNA, 36 bp, Artificial Sequence
  Synthetic oligonucleotide
cccttaggttccagtgaagttatgcaacttcatgta

SEQ ID NO: 1313 - DNA, 37 bp, Artificial Sequence
  Synthetic oligonucleotide
ctattccagcttttttgatcccgcttttgagagttga

SEQ ID NO: 1314 - DNA, 38 bp, Artificial Sequence
  Synthetic oligonucleotide
acaggacgtgcgcgctaacgttctattagttgtgctga

SEQ ID NO: 1315 - DNA, 36 bp, Artificial Sequence
  Synthetic oligonucleotide
gagtttcgttttatgtgttggctttatttccctcga

SEQ ID NO: 1316 - DNA, 36 bp, Artificial Sequence
  Synthetic oligonucleotide
tggcgttgtagccacgtccctccgctagtagagaaa

SEQ ID NO: 1317 - DNA, 35 bp, Artificial Sequence
  Synthetic oligonucleotide
tcgtagtactggtcttaatttgttgtagtcctaag

SEQ ID NO: 1318 - DNA, 36 bp, Artificial Sequence
  Synthetic oligonucleotide
tccacacgcggcgagctacgcgactaaaatcacgta

SEQ ID NO: 1319 - DNA, 38 bp, Artificial Sequence
  Synthetic oligonucleotide
tatcaaattcggtcgtagtatttgtcgccgtaacgtga

SEQ ID NO: 1320 - DNA, 36 bp, Artificial Sequence
  Synthetic oligonucleotide
gctacgaagtccaaacgtacgcacctgtttggagta

SEQ ID NO: 1321 - DNA, 35 bp, Artificial Sequence
  Synthetic oligonucleotide
tccgggcaccatatctccactgtgcgaatcactat

SEQ ID NO: 1322 - DNA, 35 bp, Artificial Sequence
  Synthetic oligonucleotide
tccgggcaccatatctccactgtgcgaatcactct

SEQ ID NO: 1323 - DNA, 38 bp, Artificial Sequence; identical to SEQ ID NO: 1314
  Synthetic oligonucleotide

SEQ ID NO: 1324 - DNA, 36 bp, Artificial Sequence
  Synthetic oligonucleotide
agcaaacgatgggccatcattcacgcttggtattaa

SEQ ID NO: 1325 - DNA, 38 bp, Artificial Sequence
  Synthetic oligonucleotide
agggacgtgatatttcaatgctgaatatacacacctga

SEQ ID NO: 1326 - DNA, 37 bp, Artificial Sequence
  Synthetic oligonucleotide
agtgattctcacttgttcccggggttcaaagatctga

SEQ ID NO: 1327 - DNA, 36 bp, Artificial Sequence
  Synthetic oligonucleotide
atcaagggaggatttttcggtcggcctagggacaca

SEQ ID NO: 1328 - DNA, 35 bp, Artificial Sequence
  Synthetic oligonucleotide
atacgcggcctaataataagatcgtcataccccaa

SEQ ID NO: 1329 - DNA, 35 bp, Artificial Sequence
  Synthetic oligonucleotide
atctcacgataaagctaacggtgagagtatctact

SEQ ID NO: 1330 - DNA, 37 bp, Artificial Sequence
  Synthetic oligonucleotide
ccgccggcgatgggggatcgcttattttattgttcga

SEQ ID NO: 1331 - DNA, 36 bp, Artificial Sequence
  Synthetic oligonucleotide
cgggtacgttggatcgacaccgaccatcttgacgta

SEQ ID NO: 1332 - DNA, 36 bp, Artificial Sequence; identical to SEQ ID NO: 1311
  Synthetic oligonucleotide

SEQ ID NO: 1333 - DNA, 38 bp, Artificial Sequence
  Synthetic oligonucleotide
cgagtgctgcgcgggttccttggggtgctccaatttga

SEQ ID NO: 1334 - DNA, 35 bp, Artificial Sequence
  Synthetic oligonucleotide
cgtgtaacccgcccaattccatcgtcacgaaattt

SEQ ID NO: 1335 - DNA, 37 bp, Artificial Sequence; identical to SEQ ID NO: 1313
  Synthetic oligonucleotide

SEQ ID NO: 1336 - DNA, 38 bp, Artificial Sequence
  Synthetic oligonucleotide
cctcgaacctgcgcgggagaaggcgcttgctaatctga

SEQ ID NO: 1337 - DNA, 38 bp, Artificial Sequence
  Synthetic oligonucleotide
cttggtccctgctcggttgaatgacgcaatgagtgtga

SEQ ID NO: 1338 - DNA, 38 bp, Artificial Sequence
  Synthetic oligonucleotide
ctcgtaggactgaggtcgatagttatttcacaccgtga

SEQ ID NO: 1339 - DNA, 38 bp, Artificial Sequence
  Synthetic oligonucleotide
gacacgacgtatctccttattccctgctataagtttga

SEQ ID NO: 1340 - DNA, 36 bp, Artificial Sequence
  Synthetic oligonucleotide
gacgttcttgcaccgcgaggtctgcagcaattctaa

SEQ ID NO: 1341 - DNA, 35 bp, Artificial Sequence
  Synthetic oligonucleotide
gcaactattgggccgtattcgtccacggggcttgt

SEQ ID NO: 1342 - DNA, 38 bp, Artificial Sequence
  Synthetic oligonucleotide
gcgtagggttggttatgcatcaattttccgctaattga

SEQ ID NO: 1343 - DNA, 36 bp, Artificial Sequence
  Synthetic oligonucleotide
gccttcggggtttattaagttattacggatctagta

SEQ ID NO: 1344 - DNA, 37 bp, Artificial Sequence
  Synthetic oligonucleotide
gcgcgtgagctgcaccgacatcacgccgattctctga

SEQ ID NO: 1345 - DNA, 36 bp, Artificial Sequence; identical to SEQ ID NO: 1320
  Synthetic oligonucleotide

SEQ ID NO: 1346 - DNA, 36 bp, Artificial Sequence
  Synthetic oligonucleotide
ggtcactcgtaggtctcccgcatcgagaaagccgta

SEQ ID NO: 1347 - DNA, 38 bp, Artificial Sequence
  Synthetic oligonucleotide
gtggatggcactaatatccccttctcgttaaagtgtga

SEQ ID NO: 1348 - DNA, 35 bp, Artificial Sequence
  Synthetic oligonucleotide
gtccaccgggattcgtatgggtatttttacccacc

SEQ ID NO: 1349 - DNA, 38 bp, Artificial Sequence
  Synthetic oligonucleotide
gttacggtatgcgaggtctcacgttgcgatcattttga

SEQ ID NO: 1350 - DNA, 37 bp, Artificial Sequence
  Synthetic oligonucleotide
gttcatcgttcctatgtcactatttccctactgctga

SEQ ID NO: 1351 - DNA, 37 bp, Artificial Sequence
  Synthetic oligonucleotide
tactaggggccgtgagccttgtgccccaagtagccga

SEQ ID NO: 1352 - DNA, 38 bp, Artificial Sequence; identical to SEQ ID NO: 1319
  Synthetic oligonucleotide

SEQ ID NO: 1353 - DNA, 36 bp, Artificial Sequence; identical to SEQ ID NO: 1318
  Synthetic oligonucleotide

SEQ ID NO: 1354 - DNA, 35 bp, Artificial Sequence; identical to SEQ ID NO: 1317
  Synthetic oligonucleotide

SEQ ID NO: 1355 - DNA, 37 bp, Artificial Sequence
  Synthetic oligonucleotide
tcgtgcgctcggttctacgccactgtacgagacacga

SEQ ID NO: 1356 - DNA, 35 bp, Artificial Sequence
  Synthetic oligonucleotide
tgtacgaaccgggcctaggatagttgctacatgta

SEQ ID NO: 1357 - DNA, 36 bp, Artificial Sequence
  Synthetic oligonucleotide
ataatgccagatctttggtttatcttgcgcttggta

SEQ ID NO: 1358 - DNA, 37 bp, Artificial Sequence
  Synthetic oligonucleotide
ccattagctgagtttcggtggacgcatgatagtttga

SEQ ID NO: 1359 - DNA, 35 bp, Artificial Sequence
  Synthetic oligonucleotide
actccatgggccccccggtttggaccccgggttta

SEQ ID NO: 1360 - DNA, 36 bp, Artificial Sequence
  Synthetic oligonucleotide
gaaaatctggcgacttagttttcgtttgatccctta

SEQ ID NO: 1361 - DNA, 36 bp, Artificial Sequence
  Synthetic oligonucleotide
agctcatggacgcactggtggcagtgcgactactaa

SEQ ID NO: 1362 - DNA, 35 bp, Artificial Sequence
  Synthetic oligonucleotide
aggataactggtttttatctctgctaattcactcg

SEQ ID NO: 1363 - DNA, 38 bp, Artificial Sequence
  Synthetic oligonucleotide
cgtggcctgtttggagacgtactgtgtcaggcatttga

SEQ ID NO: 1364 - DNA, 36 bp, Artificial Sequence
  Synthetic oligonucleotide
accttgggatcctgtttagaccgaatcggtgcgcta

SEQ ID NO: 1365 - DNA, 35 bp, Artificial Sequence
  Synthetic oligonucleotide
atcgtagtcatagacccggctttggtttccgggta

SEQ ID NO: 1366 - DNA, 37 bp, Artificial Sequence
  Synthetic oligonucleotide
gacctgggctgtctttactttgtttcgcggggctgga

SEQ ID NO: 1367 - DNA, 38 bp, Artificial Sequence
  Synthetic oligonucleotide
ccttgagccgccgggtttcggtccttattcgtgaatga

SEQ ID NO: 1368 - DNA, 35 bp, Artificial Sequence
  Synthetic oligonucleotide
agatcttttcggttattggggggaaccgagacgta

SEQ ID NO: 1369 - DNA, 36 bp, Artificial Sequence
  Synthetic oligonucleotide
gtgcgttggttaccgatggaggggacccgtagacta

SEQ ID NO: 1370 - DNA, 35 bp, Artificial Sequence
  Synthetic oligonucleotide
ttttattggctcgtttcctataatatgttgaatcc

SEQ ID NO: 1371 - DNA, 35 bp, Artificial Sequence
  Synthetic oligonucleotide
gcctcgacgacagtgacctacatcgctcgtttcgt

SEQ ID NO: 1372 - DNA, 38 bp, Artificial Sequence
  Synthetic oligonucleotide
ggtctggggggattcctacggttccaacagcataatga

SEQ ID NO: 1373 - DNA, 36 bp, Artificial Sequence
  Synthetic oligonucleotide
gttgccttgtaccccatagctggtaaggtcctagta

SEQ ID NO: 1374 - DNA, 36 bp, Artificial Sequence
  Synthetic oligonucleotide
gttgttcgggcgtcgcaacacggtcccattgtctta

SEQ ID NO: 1375 - DNA, 36 bp, Artificial Sequence
  Synthetic oligonucleotide
tcgttatagcctatatacacgcggttgactcgctga

SEQ ID NO: 1376 - DNA, 35 bp, Artificial Sequence
  Synthetic oligonucleotide
ttgtagctgctattgttttctcgattgagaactta

SEQ ID NO: 1377 - DNA, 35 bp, Artificial Sequence
  Synthetic oligonucleotide
ggctcttggtttagcccttattgtttatcattcat

SEQ ID NO: 1378 - DNA, 35 bp, Artificial Sequence
  Synthetic oligonucleotide
taattggcccgtttccaaatttatagattcctaca

SEQ ID NO: 1379 - DNA, 38 bp, Artificial Sequence
  Synthetic oligonucleotide
tccgacccatatcgacgatactggcgtggcgctactga

SEQ ID NO: 1380 - DNA, 38 bp, Artificial Sequence
  Synthetic oligonucleotide
tgcgtgagtaacgcacaggggaacactccgttttgtga

SEQ ID NO: 1381 - DNA, 36 bp, Artificial Sequence
  Synthetic oligonucleotide
gctggtatagctgggtttctatcgtttattctcgta

SEQ ID NO: 1382 - DNA, 36 bp, Artificial Sequence
  Synthetic oligonucleotide
tttgcttcatttgcacttcccccgttattccgctca

SEQ ID NO: 1383 - DNA, 38 bp, Artificial Sequence
  Synthetic oligonucleotide
aatttttactgcgtggaaaggattcgggaatttgttga

SEQ ID NO: 1384 - DNA, 36 bp, Artificial Sequence; identical to SEQ ID NO: 1364
  Synthetic oligonucleotide

SEQ ID NO: 1385 - DNA, 35 bp, Artificial Sequence; identical to SEQ ID NO: 1362
  Synthetic oligonucleotide

SEQ ID NO: 1386 - DNA, 36 bp, Artificial Sequence; identical to SEQ ID NO: 1361
  Synthetic oligonucleotide

SEQ ID NO: 1387 - DNA, 36 bp, Artificial Sequence
  Synthetic oligonucleotide
aggagtacgcgttcatccagacacggaatactttga

SEQ ID NO: 1388 - DNA, 36 bp, Artificial Sequence
  Synthetic oligonucleotide
agccttacgccatgccgagagagcgctttgtttcga

SEQ ID NO: 1389 - DNA, 35 bp, Artificial Sequence
  Synthetic oligonucleotide
agggcttagtttcctgattttactacagctcgctc

SEQ ID NO: 1390 - DNA, 36 bp, Artificial Sequence; identical to SEQ ID NO: 1357
  Synthetic oligonucleotide

SEQ ID NO: 1391 - DNA, 35 bp, Artificial Sequence
  Synthetic oligonucleotide
agtcctgatgctcaatgcgcgagtttcattgagct

SEQ ID NO: 1392 - DNA, 35 bp, Artificial Sequence; identical to SEQ ID NO: 1365
  Synthetic oligonucleotide

SEQ ID NO: 1393 - DNA, 37 bp, Artificial Sequence; identical to SEQ ID NO: 1358
  Synthetic oligonucleotide

SEQ ID NO: 1394 - DNA, 35 bp, Artificial Sequence
  Synthetic oligonucleotide
cgtaagccggtttcagcccacctggagattcttca

SEQ ID NO: 1395 - DNA, 38 bp, Artificial Sequence; identical to SEQ ID NO: 1367
  Synthetic oligonucleotide

SEQ ID NO: 1396 - DNA, 36 bp, Artificial Sequence
  Synthetic oligonucleotide
cgtagttactcgtcatggggtctttgttatgtggta

SEQ ID NO: 1397 - DNA, 36 bp, Artificial Sequence; identical to SEQ ID NO: 1360
  Synthetic oligonucleotide

SEQ ID NO: 1398 - DNA, 37 bp, Artificial Sequence; identical to SEQ ID NO: 1366
  Synthetic oligonucleotide

SEQ ID NO: 1399 - DNA, 37 bp, Artificial Sequence
  Synthetic oligonucleotide
gagtccccttctttgatgctggggtgagctcctccga

SEQ ID NO: 1400 - DNA, 37 bp, Artificial Sequence
  Synthetic oligonucleotide
gatgatcgcgcctttcgtttgtgacggttaccaggga

SEQ ID NO: 1401 - DNA, 35 bp, Artificial Sequence; identical to SEQ ID NO: 1371
  Synthetic oligonucleotide

SEQ ID NO: 1402 - DNA, 38 bp, Artificial Sequence
  Synthetic oligonucleotide
ggcccccgctccctagtttgagcgccctccacgattga

SEQ ID NO: 1403 - DNA, 35 bp, Artificial Sequence; identical to SEQ ID NO: 1377
  Synthetic oligonucleotide

SEQ ID NO: 1404 - DNA, 38 bp, Artificial Sequence; identical to SEQ ID NO: 1372
  Synthetic oligonucleotide

SEQ ID NO: 1405 - DNA, 36 bp, Artificial Sequence; identical to SEQ ID NO: 1373
  Synthetic oligonucleotide

SEQ ID NO: 1406 - DNA, 36 bp, Artificial Sequence; identical to SEQ ID NO: 1374
  Synthetic oligonucleotide

SEQ ID NO: 1407 - DNA, 38 bp, Artificial Sequence
  Synthetic oligonucleotide
tactggggaagctccgggcgcttggtttcgccacctga

SEQ ID NO: 1408 - DNA, 35 bp, Artificial Sequence
  Synthetic oligonucleotide
tcatttcggactgttctaacgcgagttatgaaggg

SEQ ID NO: 1409 - DNA, 36 bp, Artificial Sequence
  Synthetic oligonucleotide
tcacccgacggcaacaagggcatttgcttcatagta

SEQ ID NO: 1410 - DNA, 37 bp, Artificial Sequence
  Synthetic oligonucleotide
tcgaggggaattgtccacatgcatggtttcataagga

SEQ ID NO: 1411 - DNA, 38 bp, Artificial Sequence; identical to SEQ ID NO: 1379
  Synthetic oligonucleotide

SEQ ID NO: 1412 - DNA, 38 bp, Artificial Sequence; identical to SEQ ID NO: 1380
  Synthetic oligonucleotide

SEQ ID NO: 1413 - DNA, 38 bp, Artificial Sequence
  Synthetic oligonucleotide
tgttcttactaggcttagcagcctgttcccgttattga

SEQ ID NO: 1414 - DNA, 37 bp, Artificial Sequence
  Synthetic oligonucleotide
tgttttcagaccagagtaggaattccgagggcggtta

SEQ ID NO: 1415 - DNA, 35 bp, Artificial Sequence
  Synthetic oligonucleotide
tgttttgctgcttagagcgtaatcgtattggctct

SEQ ID NO: 1416 - DNA, 37 bp, Artificial Sequence
  Synthetic oligonucleotide
ttcctaggatgaaacagaaacaccgattggtccagga

SEQ ID NO: 1417 - DNA, 37 bp, Artificial Sequence
  Synthetic oligonucleotide
ttccggttttgggcgactccgtttgcgcccacgctga

SEQ ID NO: 1418 - DNA, 35 bp, Artificial Sequence
  Synthetic oligonucleotide
tttgcaagttcgctacgtatatccactgtgaagcc

SEQ ID NO: 1419 - DNA, 35 bp, Artificial Sequence; identical to SEQ ID NO: 1376
  Synthetic oligonucleotide

SEQ ID NO: 1420 - DNA, 37 bp, Artificial Sequence
  Synthetic oligonucleotide
ttttgttaaacaacgccggcaagggtcgttgttacga

SEQ ID NO: 1421 - DNA, 37 bp, Artificial Sequence
  Synthetic oligonucleotide
ttttcgcattaaaaacgggtgtccaccggttggtgga

SEQ ID NO: 1422 - DNA, 36 bp, Artificial Sequence
  Synthetic oligonucleotide
cgcgcgagcaactacactaacggaaaacccgttcaa

SEQ ID NO: 1423 - DNA, 36 bp, Artificial Sequence
  Synthetic oligonucleotide
ctactcgccgcaacccaacactcagtcaaacgatca

SEQ ID NO: 1424 - DNA, 38 bp, Artificial Sequence
  Synthetic oligonucleotide
ataacgcacgtttccataactcataccactggccttga

SEQ ID NO: 1425 - DNA, 35 bp, Artificial Sequence
  Synthetic oligonucleotide
gagagaagtatttgttaagccacatagttttcttg

SEQ ID NO: 1426 - DNA, 36 bp, Artificial Sequence
  Synthetic oligonucleotide
ccttactgcatggtttggtaccgctattgtccccca

SEQ ID NO: 1427 - DNA, 37 bp, Artificial Sequence
  Synthetic oligonucleotide
aaaattatgcgccttagggaagacatacggcctgtga

SEQ ID NO: 1428 - DNA, 37 bp, Artificial Sequence
  Synthetic oligonucleotide
aatgatcggacttgcaggctcaaccctactgatggga

SEQ ID NO: 1429 - DNA, 35 bp, Artificial Sequence
  Synthetic oligonucleotide
aaggcacgtacacactatcacctggggtgtgcctc

SEQ ID NO: 1430 - DNA, 35 bp, Artificial Sequence
  Synthetic oligonucleotide
aatagattaaagtgaacgtgagtgtttccatatta

SEQ ID NO: 1431 - DNA, 38 bp, Artificial Sequence
  Synthetic oligonucleotide
aattcgtcactcgttgtgtgtagccggtgcccaattga

SEQ ID NO: 1432 - DNA, 36 bp, Artificial Sequence
  Synthetic oligonucleotide
acgggagatcctttaagtacgtcgaagccagcaata

SEQ ID NO: 1433 - DNA, 37 bp, Artificial Sequence
  Synthetic oligonucleotide
actccgttacgtgttggcgctttcagttcagcacgga

SEQ ID NO: 1434 - DNA, 35 bp, Artificial Sequence
  Synthetic oligonucleotide
agacagtggacttctcgtcgaaaatgcatctctat

SEQ ID NO: 1435 - DNA, 37 bp, Artificial Sequence
  Synthetic oligonucleotide
agagaacgttgcccttgagtgtttcttgagccttgga

SEQ ID NO: 1436 - DNA, 36 bp, Artificial Sequence
  Synthetic oligonucleotide
agcgtgtatcatcactgatttagttatcccgagcta

SEQ ID NO: 1437 - DNA, 36 bp, Artificial Sequence
  Synthetic oligonucleotide
agaggccagcttagtgtggccaccgtgagtttacta

SEQ ID NO: 1438 - DNA, 35 bp, Artificial Sequence
  Synthetic oligonucleotide
atatgtatacgaaccctcctaatcgcactatcagt

SEQ ID NO: 1439 - DNA, 38 bp, Artificial Sequence; identical to SEQ ID NO: 1424
  Synthetic oligonucleotide

SEQ ID NO: 1440 - DNA, 36 bp, Artificial Sequence
  Synthetic oligonucleotide
agtacctatcaaggattttgccgaatccgtgccgca

SEQ ID NO: 1441 - DNA, 35 bp, Artificial Sequence
  Synthetic oligonucleotide
agttcactctaacttccgtgccgaaggcgttatcc

SEQ ID NO: 1442 - DNA, 35 bp, Artificial Sequence
  Synthetic oligonucleotide
cacatcgactgcgcgatcaatattagggtggacat

SEQ ID NO: 1443 - DNA, 35 bp, Artificial Sequence
  Synthetic oligonucleotide
attgcattcttcaggacgcttcgcccgggattctt

SEQ ID NO: 1444 - DNA, 35 bp, Artificial Sequence
  Synthetic oligonucleotide
catccctgacgcgagttggaacatgagtacgtact

SEQ ID NO: 1445 - DNA, 36 bp, Artificial Sequence
  Synthetic oligonucleotide
caccgcttagtcttatttagggtcgctaatctggta

SEQ ID NO: 1446 - DNA, 36 bp, Artificial Sequence
  Synthetic oligonucleotide
caaaccgctgcaaaaggatccccgttatggctacat

SEQ ID NO: 1447 - DNA, 38 bp, Artificial Sequence
  Synthetic oligonucleotide
ccggaccattaggtcttcttgttcaaatactttgatga

SEQ ID NO: 1448 - DNA, 36 bp, Artificial Sequence
  Synthetic oligonucleotide
ccgagcttcgtttgggttcatttcgtccgattcgca

SEQ ID NO: 1449 - DNA, 38 bp, Artificial Sequence
  Synthetic oligonucleotide
cctcctattacagttccccgggaatgaatagcaactga

SEQ ID NO: 1450 - DNA, 38 bp, Artificial Sequence
  Synthetic oligonucleotide
cgcctataccgcactcgcttggaacgacacaaagctga

SEQ ID NO: 1451 - DNA, 38 bp, Artificial Sequence
  Synthetic oligonucleotide
cgtggattcgcccacatgatgatggccggtatgtttga

SEQ ID NO: 1452 - DNA, 37 bp, Artificial Sequence
  Synthetic oligonucleotide
ccttttgtaggacgccctttctgcgcatccggtagga

SEQ ID NO: 1453 - DNA, 37 bp, Artificial Sequence
  Synthetic oligonucleotide
ccttaactacacgagagcatgtcaaggggtaaatgga

SEQ ID NO: 1454 - DNA, 36 bp, Artificial Sequence; identical to SEQ ID NO: 1423
  Synthetic oligonucleotide

SEQ ID NO: 1455 - DNA, 38 bp, Artificial Sequence; identical to SEQ ID NO: 1333
  Synthetic oligonucleotide

SEQ ID NO: 1456 - DNA, 36 bp, Artificial Sequence
  Synthetic oligonucleotide
cggagtacgaagccgcttagattacctagcccgtta

SEQ ID NO: 1457 - DNA, 37 bp, Artificial Sequence
  Synthetic oligonucleotide
cgagcgacgtttgtttcaaaaatcactgggaatatga

SEQ ID NO: 1458 - DNA, 35 bp, Artificial Sequence
  Synthetic oligonucleotide
ctacatcgctctccgtaatcgggcgattcatttca

SEQ ID NO: 1459 - DNA, 38 bp, Artificial Sequence
  Synthetic oligonucleotide
gaaaacgttggaagtttttacgccgctctcagccgtga

SEQ ID NO: 1460 - DNA, 35 bp, Artificial Sequence
  Synthetic oligonucleotide
gaatttatgcaatccattaggaaaatgggtgtgcg

SEQ ID NO: 1461 - DNA, 36 bp, Artificial Sequence
  Synthetic oligonucleotide
ctgacagtcttccctggtctattgtccgcagatcga

SEQ ID NO: 1462 - DNA, 38 bp, Artificial Sequence; identical to SEQ ID NO: 1337
  Synthetic oligonucleotide

SEQ ID NO: 1463 - DNA, 36 bp, Artificial Sequence
  Synthetic oligonucleotide
gagggactgcacagcggtgatattctaaatgtacga

SEQ ID NO: 1464 - DNA, 38 bp, Artificial Sequence
  Synthetic oligonucleotide
gaccgggtaggcttctaggcgcccccctccttacttga

SEQ ID NO: 1465 - DNA, 35 bp, Artificial Sequence
  Synthetic oligonucleotide
gaccaaagtatgtgtggtattgatatgccgtgaac

SEQ ID NO: 1466 - DNA, 36 bp, Artificial Sequence
  Synthetic oligonucleotide
gagaaccgtgctcaaggcagaattgtcaccgctcga

SEQ ID NO: 1467 - DNA, 38 bp, Artificial Sequence
  Synthetic oligonucleotide
gacgagtgacttgcactacgaaggccctcgtcgcctga

SEQ ID NO: 1468 - DNA, 37 bp, Artificial Sequence
  Synthetic oligonucleotide
gagtttgtcttgccccgggtcgggacgttgtatccta

SEQ ID NO: 1469 - DNA, 35 bp, Artificial Sequence
  Synthetic oligonucleotide
gagtggcttactttcattggatccgtgagccttgc

SEQ ID NO: 1470 - DNA, 37 bp, Artificial Sequence
  Synthetic oligonucleotide
gcaatacgctagataggcttagaaacggaatacacga

SEQ ID NO: 1471 - DNA, 35 bp, Artificial Sequence
  Synthetic oligonucleotide
gatgtcgtcacggaagtacatatggcgctgtagcc

SEQ ID NO: 1472 - DNA, 35 bp, Artificial Sequence
  Synthetic oligonucleotide
gccactggatttaactgcatcccgtctctgaggct

SEQ ID NO: 1473 - DNA, 35 bp, Artificial Sequence; identical to SEQ ID NO: 1341
  Synthetic oligonucleotide

SEQ ID NO: 1474 - DNA, 37 bp, Artificial Sequence
  Synthetic oligonucleotide
gcaatatgggatatgtgtaactcagtgagacaggaga

SEQ ID NO: 1475 - DNA, 37 bp, Artificial Sequence
  Synthetic oligonucleotide
gattacataactcgtacgtcgcttgttttaagtttga

SEQ ID NO: 1476 - DNA, 37 bp, Artificial Sequence
  Synthetic oligonucleotide
gcgtgctgctttgtactacggtctcatcgttgtagga

SEQ ID NO: 1477 - DNA, 35 bp, Artificial Sequence
  Synthetic oligonucleotide
gccctggcaccaaagtcgcacaatcaatcgtgtgc

SEQ ID NO: 1478 - DNA, 36 bp, Artificial Sequence
  Synthetic oligonucleotide
gccgttggtattctgtcgtcttcctttgttctatca

SEQ ID NO: 1479 - DNA, 37 bp, Artificial Sequence
  Synthetic oligonucleotide
ggcactgtgctgcgatcaggaaaagtcacataccgga

SEQ ID NO: 1480 - DNA, 38 bp, Artificial Sequence
  Synthetic oligonucleotide
ggcccttgaattaacatgatgaatatcacaacgggtga

SEQ ID NO: 1481 - DNA, 36 bp, Artificial Sequence
  Synthetic oligonucleotide
gggtgtttcctgcttatgactacttttctttacgca

SEQ ID NO: 1482 - DNA, 35 bp, Artificial Sequence
  Synthetic oligonucleotide
ggctcgtattttcccagtatcgtttccggtacgtc

SEQ ID NO: 1483 - DNA, 35 bp, Artificial Sequence
  Synthetic oligonucleotide
ggggatctcgggcgatgaagcctagctattgtact

SEQ ID NO: 1484 - DNA, 35 bp, Artificial Sequence
  Synthetic oligonucleotide
ggtcccgtattccagatatactaacggttaccacc

SEQ ID NO: 1485 - DNA, 37 bp, Artificial Sequence
  Synthetic oligonucleotide
gtactgtccgtgtgaacgggtctctgcagaaattcga

SEQ ID NO: 1486 - DNA, 38 bp, Artificial Sequence
  Synthetic oligonucleotide
gtgatcggtactgttgaacttgttgcaccgcccgctga

SEQ ID NO: 1487 - DNA, 38 bp, Artificial Sequence
  Synthetic oligonucleotide
gtgtcacatggggtgaccggattgaggagaggatatga

SEQ ID NO: 1488 - DNA, 37 bp, Artificial Sequence
  Synthetic oligonucleotide
gtgtcctttctgggttgatgcatttacggtttggtga

SEQ ID NO: 1489 - DNA, 37 bp, Artificial Sequence
  Synthetic oligonucleotide
gttcggttggttcccgcgctgaacaatattacctgga

SEQ ID NO: 1490 - DNA, 36 bp, Artificial Sequence
  Synthetic oligonucleotide
gttgggacccgattaacccaacagaattcggaataa

SEQ ID NO: 1491 - DNA, 36 bp, Artificial Sequence
  Synthetic oligonucleotide
tacctgagcgctggagctcgttagtcggaataggaa

SEQ ID NO: 1492 - DNA, 35 bp, Artificial Sequence
  Synthetic oligonucleotide
tacccgttcaccggataggatgttcgtccttaatt

SEQ ID NO: 1493 - DNA, 38 bp, Artificial Sequence
  Synthetic oligonucleotide
taccgatcaacccagcaaggcttgggtggattgaatga

SEQ ID NO: 1494 - DNA, 36 bp, Artificial Sequence
  Synthetic oligonucleotide
tccccccgtcgcttacggtgttggacgggctcatta

SEQ ID NO: 1495 - DNA, 36 bp, Artificial Sequence
  Synthetic oligonucleotide
tcttcataaatgactaacgcttcttagtgatgttga

SEQ ID NO: 1496 - DNA, 36 bp, Artificial Sequence
  Synthetic oligonucleotide
tgccatacctacccagagtgagacttctagcctgga

SEQ ID NO: 1497 - DNA, 38 bp, Artificial Sequence
  Synthetic oligonucleotide
tgaggtcccttttgtcggggtatatccatgaggtttga

SEQ ID NO: 1498 - DNA, 37 bp, Artificial Sequence
  Synthetic oligonucleotide
tggcttggcccgttcgttcgtgatcaagattttttga

SEQ ID NO: 1499 - DNA, 38 bp, Artificial Sequence
  Synthetic oligonucleotide
tggtctgaaattcccgtgaggagatagatcatttctga

SEQ ID NO: 1500 - DNA, 35 bp, Artificial Sequence
  Synthetic oligonucleotide
tgtccaaatcactcattctcgtaaggttaccgtcc

SEQ ID NO: 1501 - DNA, 36 bp, Artificial Sequence
  Synthetic oligonucleotide
tgttctgtcttatgccatgaagttcttataagtaga

SEQ ID NO: 1502 - DNA, 38 bp, Artificial Sequence
  Synthetic oligonucleotide
ttacccctgtaatgccctacatgatgttcggttcatga

SEQ ID NO: 1503 - DNA, 35 bp, Artificial Sequence
  Synthetic oligonucleotide
ttgtaccagtgcgtatgttgtctcatcaatgtttt

SEQ ID NO: 1504 - DNA, 37 bp, Artificial Sequence
  Synthetic oligonucleotide
ttttagcaacgggagttgcagcggggttgttaaacga

SEQ ID NO: 1505 - DNA, 35 bp, Artificial Sequence; identical to SEQ ID NO: 1362
  Synthetic oligonucleotide

SEQ ID NO: 1506 - DNA, 36 bp, Artificial Sequence; identical to SEQ ID NO: 1357
  Synthetic oligonucleotide

SEQ ID NO: 1507 - DNA, 36 bp, Artificial Sequence; identical to SEQ ID NO: 1360
  Synthetic oligonucleotide

SEQ ID NO: 1508 - DNA, 38 bp, Artificial Sequence; identical to SEQ ID NO: 1383
  Synthetic oligonucleotide

SEQ ID NO: 1509 - DNA, 35 bp, Artificial Sequence; identical to SEQ ID NO: 1365
  Synthetic oligonucleotide

SEQ ID NO: 1510 - DNA, 37 bp, Artificial Sequence; identical to SEQ ID NO: 1366
  Synthetic oligonucleotide

SEQ ID NO: 1511 - DNA, 35 bp, Artificial Sequence
  Synthetic oligonucleotide
attccgtgaggtacgtaaggcaaccagttttattt

SEQ ID NO: 1512 - DNA, 36 bp, Artificial Sequence; identical to SEQ ID NO: 1364
  Synthetic oligonucleotide

SEQ ID NO: 1513 - DNA, 37 bp, Artificial Sequence; identical to SEQ ID NO: 1358
  Synthetic oligonucleotide

SEQ ID NO: 1514 - DNA, 38 bp, Artificial Sequence; identical to SEQ ID NO: 1367
  Synthetic oligonucleotide

SEQ ID NO: 1515 - DNA, 35 bp, Artificial Sequence; identical to SEQ ID NO: 1371
  Synthetic oligonucleotide

SEQ ID NO: 1516 - DNA, 35 bp, Artificial Sequence; identical to SEQ ID NO: 1377
  Synthetic oligonucleotide

SEQ ID NO: 1517 - DNA, 38 bp, Artificial Sequence; identical to SEQ ID NO: 1379
  Synthetic oligonucleotide

SEQ ID NO: 1518 - DNA, 38 bp, Artificial Sequence; identical to SEQ ID NO: 1372
  Synthetic oligonucleotide

SEQ ID NO: 1519 - DNA, 35 bp, Artificial Sequence; identical to SEQ ID NO: 1376
  Synthetic oligonucleotide

SEQ ID NO: 1520 - DNA, 36 bp, Artificial Sequence; identical to SEQ ID NO: 1382
  Synthetic oligonucleotide

SEQ ID NO: 1521 - DNA, 36 bp, Artificial Sequence
  Synthetic oligonucleotide
tcttgtcgggattttgctcctttcatactcatggta

SEQ ID NO: 1522 - DNA, 36 bp, Artificial Sequence; identical to SEQ ID NO: 1369
  Synthetic oligonucleotide

SEQ ID NO: 1523 - DNA, 35 bp, Artificial Sequence; identical to SEQ ID NO: 1370
  Synthetic oligonucleotide

SEQ ID NO: 1524 - DNA, 36 bp, Artificial Sequence; identical to SEQ ID NO: 1374
  Synthetic oligonucleotide

SEQ ID NO: 1525 - DNA, 38 bp, Artificial Sequence; identical to SEQ ID NO: 1380
  Synthetic oligonucleotide

SEQ ID NO: 1526 - DNA, 36 bp, Artificial Sequence; identical to SEQ ID NO: 1364
  Synthetic oligonucleotide

SEQ ID NO: 1527 - DNA, 35 bp, Artificial Sequence; identical to SEQ ID NO: 1362
  Synthetic oligonucleotide

SEQ ID NO: 1528 - DNA, 36 bp, Artificial Sequence; identical to SEQ ID NO: 1361
  Synthetic oligonucleotide

SEQ ID NO: 1529 - DNA, 36 bp, Artificial Sequence; identical to SEQ ID NO: 1388
  Synthetic oligonucleotide

SEQ ID NO: 1530 - DNA, 36 bp, Artificial Sequence; identical to SEQ ID NO: 1387
  Synthetic oligonucleotide

SEQ ID NO: 1531 - DNA, 36 bp, Artificial Sequence; identical to SEQ ID NO: 1357
  Synthetic oligonucleotide

SEQ ID NO: 1532 - DNA, 35 bp, Artificial Sequence; identical to SEQ ID NO: 1391
  Synthetic oligonucleotide

SEQ ID NO: 1533 - DNA, 35 bp, Artificial Sequence; identical to SEQ ID NO: 1365
  Synthetic oligonucleotide

SEQ ID NO: 1534 - DNA, 37 bp, Artificial Sequence; identical to SEQ ID NO: 1358
  Synthetic oligonucleotide

SEQ ID NO: 1535 - DNA, 38 bp, Artificial Sequence; identical to SEQ ID NO: 1367
  Synthetic oligonucleotide

SEQ ID NO: 1536 - DNA, 36 bp, Artificial Sequence; identical to SEQ ID NO: 1360
  Synthetic oligonucleotide

SEQ ID NO: 1537 - DNA, 37 bp, Artificial Sequence; identical to SEQ ID NO: 1366
  Synthetic oligonucleotide

SEQ ID NO: 1538 - DNA, 37 bp, Artificial Sequence
  Synthetic oligonucleotide
gagcgactcatcccggggtttggatcagcgctccgga

SEQ ID NO: 1539 - DNA, 37 bp, Artificial Sequence; identical to SEQ ID NO: 1399
  Synthetic oligonucleotide

SEQ ID NO: 1540 - DNA, 36 bp, Artificial Sequence
  Synthetic oligonucleotide
ggtctcttggtttagatcccgtcttttctgtggaaa

SEQ ID NO: 1541 - DNA, 38 bp, Artificial Sequence; identical to SEQ ID NO: 1372
  Synthetic oligonucleotide

SEQ ID NO: 1542 - DNA, 35 bp, Artificial Sequence; identical to SEQ ID NO: 1377
  Synthetic oligonucleotide

SEQ ID NO: 1543 - DNA, 38 bp, Artificial Sequence
  Synthetic oligonucleotide
gtccaggctctatgcttagtacccgttcatttgcttga

SEQ ID NO: 1544 - DNA, 36 bp, Artificial Sequence; identical to SEQ ID NO: 1374
  Synthetic oligonucleotide

SEQ ID NO: 1545 - DNA, 38 bp, Artificial Sequence; identical to SEQ ID NO: 1407
  Synthetic oligonucleotide

SEQ ID NO: 1546 - DNA, 35 bp, Artificial Sequence; identical to SEQ ID NO: 1408
  Synthetic oligonucleotide

SEQ ID NO: 1547 - DNA, 36 bp, Artificial Sequence; identical to SEQ ID NO: 1409
  Synthetic oligonucleotide

SEQ ID NO: 1548 - DNA, 35 bp, Artificial Sequence
  Synthetic oligonucleotide
tcctagaaatctgtattgtttctcaaggccacctg

SEQ ID NO: 1549 - DNA, 37 bp, Artificial Sequence; identical to SEQ ID NO: 1410
  Synthetic oligonucleotide

SEQ ID NO: 1550 - DNA, 36 bp, Artificial Sequence; identical to SEQ ID NO: 1521
  Synthetic oligonucleotide

SEQ ID NO: 1551 - DNA, 38 bp, Artificial Sequence; identical to SEQ ID NO: 1380
  Synthetic oligonucleotide

SEQ ID NO: 1552 - DNA, 35 bp, Artificial Sequence
  Synthetic oligonucleotide
tgttttatctggatcacactagctattgtacggtt

SEQ ID NO: 1553 - DNA, 37 bp, Artificial Sequence; identical to SEQ ID NO: 1414
  Synthetic oligonucleotide

SEQ ID NO: 1554 - DNA, 37 bp, Artificial Sequence; identical to SEQ ID NO: 1416
  Synthetic oligonucleotide

SEQ ID NO: 1555 - DNA, 37 bp, Artificial Sequence; identical to SEQ ID NO: 1417
  Synthetic oligonucleotide

SEQ ID NO: 1556 - DNA, 35 bp, Artificial Sequence; identical to SEQ ID NO: 1418
  Synthetic oligonucleotide

SEQ ID NO: 1557 - DNA, 35 bp, Artificial Sequence; identical to SEQ ID NO: 1376
  Synthetic oligonucleotide

SEQ ID NO: 1558 - DNA, 37 bp, Artificial Sequence
  Synthetic oligonucleotide
tttgagcgcctcagtttgcgcgacttccagcccgtga

SEQ ID NO: 1559 - DNA, 37 bp, Artificial Sequence; identical to SEQ ID NO: 1420
  Synthetic oligonucleotide

SEQ ID NO: 1560 - DNA, 37 bp, Artificial Sequence; identical to SEQ ID NO: 1421
  Synthetic oligonucleotide

SEQ ID NO: 1561 - DNA, 36 bp, Artificial Sequence; identical to SEQ ID NO: 1423
  Synthetic oligonucleotide

SEQ ID NO: 1562 - DNA, 38 bp, Artificial Sequence; identical to SEQ ID NO: 1424
  Synthetic oligonucleotide

SEQ ID NO: 1563 - DNA, 38 bp, Artificial Sequence
  Synthetic oligonucleotide
atgctatcccgtgaaacgagaacatacggtttttttga

SEQ ID NO: 1564 - DNA, 35 bp, Artificial Sequence; identical to SEQ ID NO: 1425
  Synthetic oligonucleotide

SEQ ID NO: 1565 - DNA, 36 bp, Artificial Sequence; identical to SEQ ID NO: 1311
  Synthetic oligonucleotide

SEQ ID NO: 1566 - DNA, 36 bp, Artificial Sequence
  Synthetic oligonucleotide
agggcaatctgtcccgccctcagcttttttatttaa

SEQ ID NO: 1567 - DNA, 37 bp, Artificial Sequence; identical to SEQ ID NO: 1326
  Synthetic oligonucleotide

SEQ ID NO: 1568 - DNA, 38 bp, Artificial Sequence; identical to SEQ ID NO: 1314
  Synthetic oligonucleotide

SEQ ID NO: 1569 - DNA, 38 bp, Artificial Sequence
  Synthetic oligonucleotide
accgaaaacccgttcccgccgtactgcttctatattga

SEQ ID NO: 1570 - DNA, 36 bp, Artificial Sequence; identical to SEQ ID NO: 1320
  Synthetic oligonucleotide

SEQ ID NO: 1571 - DNA, 36 bp, Artificial Sequence; identical to SEQ ID NO: 1318
  Synthetic oligonucleotide

SEQ ID NO: 1572 - DNA, 35 bp, Artificial Sequence; identical to SEQ ID NO: 1321
  Synthetic oligonucleotide

SEQ ID NO: 1573 - DNA, 35 bp, Artificial Sequence; identical to SEQ ID NO: 1322
  Synthetic oligonucleotide

SEQ ID NO: 1574 - DNA, 35 bp, Artificial Sequence; identical to SEQ ID NO: 1317
  Synthetic oligonucleotide

SEQ ID NO: 1575 - DNA, 38 bp, Artificial Sequence
  Synthetic oligonucleotide
tttccgattattatgaccgcttttattattggaggtga

SEQ ID NO: 1576 - DNA, 38 bp, Artificial Sequence
  Synthetic oligonucleotide
tcttggacgtgcgtgatccccattttatatatgattga

SEQ ID NO: 1577 - DNA, 38 bp, Artificial Sequence; identical to SEQ ID NO: 1314
  Synthetic oligonucleotide

SEQ ID NO: 1578 - DNA, 36 bp, Artificial Sequence; identical to SEQ ID NO: 1324
  Synthetic oligonucleotide

SEQ ID NO: 1579 - DNA, 36 bp, Artificial Sequence; identical to SEQ ID NO: 1311
  Synthetic oligonucleotide

SEQ ID NO: 1580 - DNA, 37 bp, Artificial Sequence; identical to SEQ ID NO: 1313
  Synthetic oligonucleotide

SEQ ID NO: 1581 - DNA, 36 bp, Artificial Sequence; identical to SEQ ID NO: 1320
  Synthetic oligonucleotide

SEQ ID NO: 1582 - DNA, 35 bp, Artificial Sequence; identical to SEQ ID NO: 1322
  Synthetic oligonucleotide

SEQ ID NO: 1583 - DNA, 38 bp, Artificial Sequence; identical to SEQ ID NO: 1576
  Synthetic oligonucleotide

SEQ ID NO: 1584 - DNA, 35 bp, Artificial Sequence; identical to SEQ ID NO: 1317
  Synthetic oligonucleotide

SEQ ID NO: 1585 - DNA, 38 bp, Artificial Sequence
  Synthetic oligonucleotide
tgcccttagtttccgtatgaccactttgattcttttga

SEQ ID NO: 1586 - DNA, 38 bp, Artificial Sequence; identical to SEQ ID NO: 1575
  Synthetic oligonucleotide

SEQ ID NO: 1587 - DNA, 38 bp, Artificial Sequence
  Synthetic oligonucleotide
attcgcatagcctatgggaagggaattgtgaggggtga

SEQ ID NO: 1588 - DNA, 38 bp, Artificial Sequence
  Synthetic oligonucleotide
gaggttccctgtgggtcatgtcgcacgatttttagtga

SEQ ID NO: 1589 - DNA, 38 bp, Artificial Sequence; identical to SEQ ID NO: 1314
  Synthetic oligonucleotide

SEQ ID NO: 1590 - DNA, 38 bp, Artificial Sequence; identical to SEQ ID NO: 1319
  Synthetic oligonucleotide

SEQ ID NO: 1591 - DNA, 37 bp, Artificial Sequence
  Synthetic oligonucleotide
tgcccgcttttggtttatatggcttcttatctttcga

SEQ ID NO: 1592 - DNA, 38 bp, Artificial Sequence; identical to SEQ ID NO: 1575
  Synthetic oligonucleotide

SEQ ID NO: 1593 - DNA, 35 bp, Artificial Sequence; identical to SEQ ID NO: 1321
  Synthetic oligonucleotide

SEQ ID NO: 1594 - DNA, 38 bp, Artificial Sequence
  Synthetic oligonucleotide
aaacgtgggggcgtcccagccccatgtgttatctctga

SEQ ID NO: 1595 - DNA, 38 bp, Artificial Sequence
  Synthetic oligonucleotide
aaccctctcccatcctctcgaaacactagattacctga

SEQ ID NO: 1596 - DNA, 35 bp, Artificial Sequence
  Synthetic oligonucleotide
aacatacgtcccaagcgcatctcgattctatcttc

SEQ ID NO: 1597 - DNA, 37 bp, Artificial Sequence
  Synthetic oligonucleotide
aaccacgcctaaatggattcacttcctcaaaaattga

SEQ ID NO: 1598 - DNA, 37 bp, Artificial Sequence
  Synthetic oligonucleotide
aacgccgcacttcgttaaaagtctataaaactctaga

SEQ ID NO: 1599 - DNA, 37 bp, Artificial Sequence
  Synthetic oligonucleotide
aacgaagtattataacccttgtgtatcccgaccatga

SEQ ID NO: 1600 - DNA, 35 bp, Artificial Sequence
  Synthetic oligonucleotide
aacaaagttcacccataccacaaccccaattcgac

SEQ ID NO: 1601 - DNA, 38 bp, Artificial Sequence
  Synthetic oligonucleotide
aacggctgggaggggtagcattttaactatatttctga

SEQ ID NO: 1602 - DNA, 38 bp, Artificial Sequence
  Synthetic oligonucleotide
aagtggtccgtttcggcaataagtacaacgggatctga

SEQ ID NO: 1603 - DNA, 38 bp, Artificial Sequence
  Synthetic oligonucleotide
aactctgcataactaaccgacgccaactattatcctga

SEQ ID NO: 1604 - DNA, 36 bp, Artificial Sequence
  Synthetic oligonucleotide
aatcaggcttgtttgctagacaaaataagcacgaaa

SEQ ID NO: 1605 - DNA, 38 bp, Artificial Sequence
  Synthetic oligonucleotide
aattgcgttttccggttgactaaaaacacggaatctga

SEQ ID NO: 1606 - DNA, 36 bp, Artificial Sequence
  Synthetic oligonucleotide
aataaacacttcgaccaaactaaggccttatctcca

SEQ ID NO: 1607 - DNA, 38 bp, Artificial Sequence
  Synthetic oligonucleotide
aagtttcctggtcgcccgcttctgaaaagttagtttga

SEQ ID NO: 1608 - DNA, 38 bp, Artificial Sequence
  Synthetic oligonucleotide
aagagggctatgatttagccggtgcctccttgctttga

SEQ ID NO: 1609 - DNA, 37 bp, Artificial Sequence
  Synthetic oligonucleotide
aagccggtatcgcccgtaacattcccttcctctagga

SEQ ID NO: 1610 - DNA, 38 bp, Artificial Sequence
  Synthetic oligonucleotide
aacttcaccgatacggttcttttctctaacccgcttga

SEQ ID NO: 1611 - DNA, 37 bp, Artificial Sequence
  Synthetic oligonucleotide
aaggatagccataggctgatggggactcaacaggtga

SEQ ID NO: 1612 - DNA, 36 bp, Artificial Sequence
  Synthetic oligonucleotide
aatcgtcttacgtgcccttgataaatcccatactaa

SEQ ID NO: 1613 - DNA, 38 bp, Artificial Sequence
  Synthetic oligonucleotide
aattcgcgcgaattgaagaggcccatggcccgctctga

SEQ ID NO: 1614 - DNA, 37 bp, Artificial Sequence
  Synthetic oligonucleotide
accatgaatcaccgcgcctgctactgcaacttttgga

SEQ ID NO: 1615 - DNA, 36 bp, Artificial Sequence
  Synthetic oligonucleotide
acactggcatttttcgaaacatagaatgaatgggaa

SEQ ID NO: 1616 - DNA, 37 bp, Artificial Sequence
  Synthetic oligonucleotide
acacccacaagctttaacttatcataactcgccccga

SEQ ID NO: 1617 - DNA, 35 bp, Artificial Sequence
  Synthetic oligonucleotide
acccaacgttgagcgcaataccccttcataatacc

SEQ ID NO: 1618 - DNA, 35 bp, Artificial Sequence
  Synthetic oligonucleotide
acctctctctgaaatttaactctattctcccattc

SEQ ID NO: 1619 - DNA, 35 bp, Artificial Sequence
  Synthetic oligonucleotide
accggactagatatttaccacattgcatttccata

SEQ ID NO: 1620 - DNA, 35 bp, Artificial Sequence
  Synthetic oligonucleotide
acgctgaatctggttcacaacggggaacgtgttag

SEQ ID NO: 1621 - DNA, 38 bp, Artificial Sequence
  Synthetic oligonucleotide
acccgctgtgtgaaccaccgtgccttcggacgtcatga

SEQ ID NO: 1622 - DNA, 35 bp, Artificial Sequence
  Synthetic oligonucleotide
accgctctctgaaatttatctctattctcccattc

SEQ ID NO: 1623 - DNA, 36 bp, Artificial Sequence
  Synthetic oligonucleotide
acggtacactcactttcctaaatccctctttatcta

SEQ ID NO: 1624 - DNA, 38 bp, Artificial Sequence
  Synthetic oligonucleotide
acgccccagcctatttaccttggagtttctttgactga

SEQ ID NO: 1625 - DNA, 35 bp, Artificial Sequence
  Synthetic oligonucleotide
acccggcgaagacgttagctctggcgctccgttca

SEQ ID NO: 1626 - DNA, 38 bp, Artificial Sequence
  Synthetic oligonucleotide
actatcccaggtttacattagtgtgccccgcattctga

SEQ ID NO: 1627 - DNA, 38 bp, Artificial Sequence
  Synthetic oligonucleotide
actgctttttttgcccaatatctcgagtaaccccctga

SEQ ID NO: 1628 - DNA, 35 bp, Artificial Sequence
  Synthetic oligonucleotide
actgaacactctacatgaccataaacacctctctt

SEQ ID NO: 1629 - DNA, 37 bp, Artificial Sequence
  Synthetic oligonucleotide
actcgggcttccatcaagcttctgattggtgaggtga

SEQ ID NO: 1630 - DNA, 35 bp, Artificial Sequence
  Synthetic oligonucleotide
actgaacactctacatgactgtaaacacctctctt

SEQ ID NO: 1631 - DNA, 38 bp, Artificial Sequence
  Synthetic oligonucleotide
acgtttttctcgctcgtaattttatcgttaatttctga

SEQ ID NO: 1632 - DNA, 37 bp, Artificial Sequence
  Synthetic oligonucleotide
actactcatccccccgtcttaacaacgatcccactga

SEQ ID NO: 1633 - DNA, 37 bp, Artificial Sequence
  Synthetic oligonucleotide
actacgcgctcatcggccagagttccggtcaaccgga

SEQ ID NO: 1634 - DNA, 36 bp, Artificial Sequence
  Synthetic oligonucleotide
acttcacccacacaatacccttatcgataactcaaa

SEQ ID NO: 1635 - DNA, 36 bp, Artificial Sequence
  Synthetic oligonucleotide
acgttacgccgggggactataagcagttcagtagca

SEQ ID NO: 1636 - DNA, 36 bp, Artificial Sequence
  Synthetic oligonucleotide
agacctattccccaatcctgaattacaacatctcta

SEQ ID NO: 1637 - DNA, 35 bp, Artificial Sequence
  Synthetic oligonucleotide
agcacccgcccgcttctattcctcgatcctacact

SEQ ID NO: 1638 - DNA, 35 bp, Artificial Sequence
  Synthetic oligonucleotide
agccccagagtttatccggcttggccggcaattcc

SEQ ID NO: 1639 - DNA, 35 bp, Artificial Sequence
  Synthetic oligonucleotide
aggaatcgatcctggtggttttagctttgaccctt

SEQ ID NO: 1640 - DNA, 37 bp, Artificial Sequence
  Synthetic oligonucleotide
agacttagactcaataactggaccctttacacaccgt

SEQ ID NO: 1641 - DNA, 37 bp, Artificial Sequence; identical to SEQ ID NO: 1326
  Synthetic oligonucleotide

SEQ ID NO: 1642 - DNA, 38 bp, Artificial Sequence
  Synthetic oligonucleotide
atacacgctgcccatttccactcgtcaaaccactatga

SEQ ID NO: 1643 - DNA, 35 bp, Artificial Sequence
  Synthetic oligonucleotide
agttcgcgcaaccccttctcgcttgtgtggcttaa

SEQ ID NO: 1644 - DNA, 35 bp, Artificial Sequence
  Synthetic oligonucleotide
atcaagccggtgtaggcgctccaggcctttcagcc

SEQ ID NO: 1645 - DNA, 35 bp, Artificial Sequence
  Synthetic oligonucleotide
agtcatccattacctcaatgttcatctattttcac

SEQ ID NO: 1646 - DNA, 38 bp, Artificial Sequence
  Synthetic oligonucleotide
atcctctacgttccaaccacttacttttatgccattga

SEQ ID NO: 1647 - DNA, 38 bp, Artificial Sequence
  Synthetic oligonucleotide
atcacactctaactgtaatcaatcatttcgaaccctga

SEQ ID NO: 1648 - DNA, 38 bp, Artificial Sequence
  Synthetic oligonucleotide
atcccttccaattccctataattactactctaatgtga

SEQ ID NO: 1649 - DNA, 37 bp, Artificial Sequence
  Synthetic oligonucleotide
atcccacttgccatcttcggtcctatcaaatggtaga

SEQ ID NO: 1650 - DNA, 34 bp, Artificial Sequence
  Synthetic oligonucleotide
atcttaatgccttgatccgactcctacctcttga

SEQ ID NO: 1651 - DNA, 38 bp, Artificial Sequence
  Synthetic oligonucleotide
atgccccccgcgcttttaactcacacctgctctgctga

SEQ ID NO: 1652 - DNA, 35 bp, Artificial Sequence
  Synthetic oligonucleotide
atgcagtcgttaacgtccatcgcgtgtgtcttccg

SEQ ID NO: 1653 - DNA, 38 bp, Artificial Sequence
  Synthetic oligonucleotide
atcccttttattgttaaacttcatagaaatcatactga

SEQ ID NO: 1654 - DNA, 37 bp, Artificial Sequence
  Synthetic oligonucleotide
atcttcccgccacttgtgccttatcattaccccccga

SEQ ID NO: 1655 - DNA, 36 bp, Artificial Sequence
  Synthetic oligonucleotide
atcccaattcacatacactctcaccctcactaaaca

SEQ ID NO: 1656 - DNA, 36 bp, Artificial Sequence
  Synthetic oligonucleotide
atctacaccctatcgaaacttcccatgaaactacaa

SEQ ID NO: 1657 - DNA, 35 bp, Artificial Sequence
  Synthetic oligonucleotide
attggtgcccgttgtgaggatcaagcaacatgcta

SEQ ID NO: 1658 - DNA, 38 bp, Artificial Sequence
  Synthetic oligonucleotide
caaacgtaccttactgcatacaccttccctgttattga

SEQ ID NO: 1659 - DNA, 35 bp, Artificial Sequence
  Synthetic oligonucleotide
attgaacgagcgagaaatctaagcgccggcatctg

SEQ ID NO: 1660 - DNA, 35 bp, Artificial Sequence
  Synthetic oligonucleotide
atttcctaacattgctctcttaactgttcctatcc

SEQ ID NO: 1661 - DNA, 37 bp, Artificial Sequence
  Synthetic oligonucleotide
cacctggccattacactttccttttgagttctctcga

SEQ ID NO: 1662 - DNA, 38 bp, Artificial Sequence
  Synthetic oligonucleotide
attttagcatacggctccttggtttcatcagctgttga

SEQ ID NO: 1663 - DNA, 35 bp, Artificial Sequence
  Synthetic oligonucleotide
attcgaattctccacctgataaccgccacattaaa

SEQ ID NO: 1664 - DNA, 36 bp, Artificial Sequence
  Synthetic oligonucleotide
atgtttgtcggcctttgtgggtcctttcgcttccca

SEQ ID NO: 1665 - DNA, 38 bp, Artificial Sequence
  Synthetic oligonucleotide
ccgcaacccaactcgtattctaatctactacacattga

SEQ ID NO: 1666 - DNA, 36 bp, Artificial Sequence; identical to SEQ ID NO: 1312
  Synthetic oligonucleotide

SEQ ID NO: 1667 - DNA, 35 bp, Artificial Sequence
  Synthetic oligonucleotide
ccccaaggacgcacgggggtacccgcatactgtta

SEQ ID NO: 1668 - DNA, 36 bp, Artificial Sequence
  Synthetic oligonucleotide
ccagccggtccaggtggctgacccgcgaaggagcta

SEQ ID NO: 1669 - DNA, 37 bp, Artificial Sequence
  Synthetic oligonucleotide
cccgtcatgaaccgggacccaatcttaccttttatga

SEQ ID NO: 1670 - DNA, 37 bp, Artificial Sequence
  Synthetic oligonucleotide
ccgcgcgttagctacggatggcattaacccagttgga

SEQ ID NO: 1671 - DNA, 38 bp, Artificial Sequence
  Synthetic oligonucleotide
catggctctcatccgaagacgcgccttcttctatttga

SEQ ID NO: 1672 - DNA, 38 bp, Artificial Sequence
  Synthetic oligonucleotide
ccgctggcgctattttttttctatgctgttggagctga

SEQ ID NO: 1673 - DNA, 36 bp, Artificial Sequence
  Synthetic oligonucleotide
catggatttagtcgtccctagccgaacttctgttaa

SEQ ID NO: 1674 - DNA, 38 bp, Artificial Sequence
  Synthetic oligonucleotide
ccgcttaacggggcacccaactaattcgatatctctga

SEQ ID NO: 1675 - DNA, 36 bp, Artificial Sequence
  Synthetic oligonucleotide
cggtccgtcgacccatgttttttggctctattgcta

SEQ ID NO: 1676 - DNA, 36 bp, Artificial Sequence; identical to SEQ ID NO: 1311
  Synthetic oligonucleotide

SEQ ID NO: 1677 - DNA, 38 bp, Artificial Sequence
  Synthetic oligonucleotide
cgctattattactctccccgggtaatatcctatattga

SEQ ID NO: 1678 - DNA, 36 bp, Artificial Sequence
  Synthetic oligonucleotide
ccttgaaaggtgtaacgcacgttggatcgtcgtgaa

SEQ ID NO: 1679 - DNA, 36 bp, Artificial Sequence
  Synthetic oligonucleotide
cgacgaaaccggacaccatacccttacgacttttaa

SEQ ID NO: 1680 - DNA, 35 bp, Artificial Sequence
  Synthetic oligonucleotide
ccttaccccgagcgtgcccccttcttaagtattcg

SEQ ID NO: 1681 - DNA, 36 bp, Artificial Sequence
  Synthetic oligonucleotide
cgttttatagtttcgatctaaggttcattatatata

SEQ ID NO: 1682 - DNA, 38 bp, Artificial Sequence
  Synthetic oligonucleotide
cgcttaattcttggttatattatctaactacgcaatga

SEQ ID NO: 1683 - DNA, 37 bp, Artificial Sequence
  Synthetic oligonucleotide
ctctaccgagtcccttacatatgtacccacttccaga

SEQ ID NO: 1684 - DNA, 37 bp, Artificial Sequence
  Synthetic oligonucleotide
gaacccgagggagggattctcaatgtgcaatgtatga

SEQ ID NO: 1685 - DNA, 38 bp, Artificial Sequence
  Synthetic oligonucleotide
cttcggggcactaccttcgtttttttgttctactatga

SEQ ID NO: 1686 - DNA, 37 bp, Artificial Sequence
  Synthetic oligonucleotide
gaagccccataaaagacgccgaaatattgcatctgga

SEQ ID NO: 1687 - DNA, 37 bp, Artificial Sequence
  Synthetic oligonucleotide
gaaactaaaccgactgggttaaattttatcatgcgga

SEQ ID NO: 1688 - DNA, 37 bp, Artificial Sequence
  Synthetic oligonucleotide
gagcttaaacctctccgagcgcttatggctcgattga

SEQ ID NO: 1689 - DNA, 35 bp, Artificial Sequence
  Synthetic oligonucleotide
gaggaaacgcggcagccttataggccgatctttca

SEQ ID NO: 1690 - DNA, 38 bp, Artificial Sequence
  Synthetic oligonucleotide
gaggtttaataaataggccatgcttattggtccgctga

SEQ ID NO: 1691 - DNA, 37 bp, Artificial Sequence
  Synthetic oligonucleotide
gatcacgtcgcggattcccccgtttcgcgagaggaga

SEQ ID NO: 1692 - DNA, 37 bp, Artificial Sequence
  Synthetic oligonucleotide
gagttcctttatttgcatttttatcagatcaagttta

SEQ ID NO: 1693 - DNA, 36 bp, Artificial Sequence
  Synthetic oligonucleotide
gagtcctctacttcatataatctccagaggggggga

SEQ ID NO: 1694 - DNA, 35 bp, Artificial Sequence
  Synthetic oligonucleotide
gagtttcgatattcgtcttaaatccacccctgtaa

SEQ ID NO: 1695 - DNA, 36 bp, Artificial Sequence
  Synthetic oligonucleotide
gagtacgatttgaccactatcttcgtagattccata

SEQ ID NO: 1696 - DNA, 37 bp, Artificial Sequence
  Synthetic oligonucleotide
gataacgggaaccaaatcgcgctgtagaggcctggga

SEQ ID NO: 1697 - DNA, 36 bp, Artificial Sequence
  Synthetic oligonucleotide
gatctacccgaccctattaaccttagtacttgacaa

SEQ ID NO: 1698 - DNA, 38 bp, Artificial Sequence
  Synthetic oligonucleotide
gatccctaattgttttcctattaatcgttttcccatga

SEQ ID NO: 1699 - DNA, 36 bp, Artificial Sequence
  Synthetic oligonucleotide
gatcgctcgccaggcacactgccgtttcgagtatta

SEQ ID NO: 1700 - DNA, 36 bp, Artificial Sequence
  Synthetic oligonucleotide
gcacgacgaacgagtccgggaggaccggcttcccca

SEQ ID NO: 1701 - DNA, 35 bp, Artificial Sequence
  Synthetic oligonucleotide
gatcttatccggcccacatctttaaccccaacact

SEQ ID NO: 1702 - DNA, 35 bp, Artificial Sequence
  Synthetic oligonucleotide
gccgtctcggggtaatcggcctaatacgtagacat

SEQ ID NO: 1703 - DNA, 37 bp, Artificial Sequence
  Synthetic oligonucleotide
gccgcggggggccggggaggtcccatcgaggttatga

SEQ ID NO: 1704 - DNA, 38 bp, Artificial Sequence
  Synthetic oligonucleotide
gctaacctttgttatactaggactttctccacaggtga

SEQ ID NO: 1705 - DNA, 35 bp, Artificial Sequence
  Synthetic oligonucleotide
ggggtttcttggagcgcaatacggtttgtttctga

SEQ ID NO: 1706 - DNA, 35 bp, Artificial Sequence
  Synthetic oligonucleotide
ggcgaaactagcctggattggagttagacctttca

SEQ ID NO: 1707 - DNA, 38 bp, Artificial Sequence
  Synthetic oligonucleotide
gggggagttgcatggttgcaactctggaggccctttga

SEQ ID NO: 1708 - DNA, 37 bp, Artificial Sequence
  Synthetic oligonucleotide
gggtttaacgtgcccacccgtcagggtagtcctacga

SEQ ID NO: 1709 - DNA, 35 bp, Artificial Sequence
  Synthetic oligonucleotide
gggtatgccgttctgtccgggccttatgcgcatat

SEQ ID NO: 1710 - DNA, 37 bp, Artificial Sequence
  Synthetic oligonucleotide
gggacaatagaattaaactcgggcttaggtcctcgga

SEQ ID NO: 1711 - DNA, 37 bp, Artificial Sequence
  Synthetic oligonucleotide
ggggagatggctgggtcttgataccggaaacttgcga

SEQ ID NO: 1712 - DNA, 38 bp, Artificial Sequence
  Synthetic oligonucleotide
ggcttgtatacctattatgttaggcaggtgccctttga

SEQ ID NO: 1713 - DNA, 36 bp, Artificial Sequence
  Synthetic oligonucleotide
gtggcccggttgtgttgtcacggacgtgcggtccca

SEQ ID NO: 1714 - DNA, 36 bp, Artificial Sequence
  Synthetic oligonucleotide
gtgttgtatgtcttcgcaatcctagccgaccgccaa

SEQ ID NO: 1715 - DNA, 38 bp, Artificial Sequence
  Synthetic oligonucleotide
gtgcgcgttggtgggccgcttgtaactataccctttga

SEQ ID NO: 1716 - DNA, 35 bp, Artificial Sequence
  Synthetic oligonucleotide
gttttggtggttcaaaccggtcgcccactggcatt

SEQ ID NO: 1717 - DNA, 36 bp, Artificial Sequence
  Synthetic oligonucleotide
tacatcccggctagatccgtgaggactggcggtgtc

SEQ ID NO: 1718 - DNA, 38 bp, Artificial Sequence
  Synthetic oligonucleotide
taaaagaactcttttcgtcaaccatacctcaggcctga

SEQ ID NO: 1719 - DNA, 37 bp, Artificial Sequence
  Synthetic oligonucleotide
tagtccatatatagcttaaactgatgcgggggttcga

SEQ ID NO: 1720 - DNA, 35 bp, Artificial Sequence
  Synthetic oligonucleotide
tacccttatcggcacccccacacttatggtaattc

SEQ ID NO: 1721 - DNA, 36 bp, Artificial Sequence
  Synthetic oligonucleotide
tacgggaatgggtttggccctaaaagccagacacga

SEQ ID NO: 1722 - DNA, 36 bp, Artificial Sequence
  Synthetic oligonucleotide
tagctaacggtcccaacaagcatgttgggattggca

SEQ ID NO: 1723 - DNA, 38 bp, Artificial Sequence
  Synthetic oligonucleotide
tacgccatgatacttacatctagccaccttttttttga

SEQ ID NO: 1724 - DNA, 36 bp, Artificial Sequence
  Synthetic oligonucleotide
tatatctggccaccggcgggggggctggtgatctta

SEQ ID NO: 1725 - DNA, 36 bp, Artificial Sequence; identical to SEQ ID NO: 1491
  Synthetic oligonucleotide

SEQ ID NO: 1726 - DNA, 38 bp, Artificial Sequence
  Synthetic oligonucleotide
tatcaaattcggtcgtagtatttgtcgccgtaacgtta

SEQ ID NO: 1727 - DNA, 38 bp, Artificial Sequence
  Synthetic oligonucleotide
tactagcgatcatttgttcgctttgggttggttattga

SEQ ID NO: 1728 - DNA, 35 bp, Artificial Sequence
  Synthetic oligonucleotide
taggtggtcgtgcctacattgactgtttccatcca

SEQ ID NO: 1729 - DNA, 35 bp, Artificial Sequence
  Synthetic oligonucleotide
tactccggcccaactatatacttctccacacctcc

SEQ ID NO: 1730 - DNA, 37 bp, Artificial Sequence
  Synthetic oligonucleotide
tatcacgacttcccaccttcttccgcctttgtcccaa

SEQ ID NO: 1731 - DNA, 37 bp, Artificial Sequence
  Synthetic oligonucleotide
tcacagggcctgaaggtagtagatattaaacgctgga

SEQ ID NO: 1732 - DNA, 35 bp, Artificial Sequence
  Synthetic oligonucleotide
tcattatacggatcccgcgccgaacctggccgact

SEQ ID NO: 1733 - DNA, 38 bp, Artificial Sequence
  Synthetic oligonucleotide
tcactttggtaaactattcccccgtttctctcctatga

SEQ ID NO: 1734 - DNA, 37 bp, Artificial Sequence
  Synthetic oligonucleotide
tcaatacgcgtccggaaatccccctgtgcaagctgga

SEQ ID NO: 1735 - DNA, 37 bp, Artificial Sequence
  Synthetic oligonucleotide
tcaatgcttgctgctcgtagctttcaaccgtggtgga

SEQ ID NO: 1736 - DNA, 35 bp, Artificial Sequence
  Synthetic oligonucleotide
tatcgtttgccatattccgccagagaaaagtctcc

SEQ ID NO: 1737 - DNA, 38 bp, Artificial Sequence
  Synthetic oligonucleotide
tcctcgtggcttaccggtatactcccccaactcattga

SEQ ID NO: 1738 - DNA, 37 bp, Artificial Sequence
  Synthetic oligonucleotide
tccctccccgttgcccttattccgtactcacttatga

SEQ ID NO: 1739 - DNA, 38 bp, Artificial Sequence
  Synthetic oligonucleotide
tcctgtctccgctaggtaacatccgaatactctcttga

SEQ ID NO: 1740 - DNA, 36 bp, Artificial Sequence
  Synthetic oligonucleotide
tcctcgaccatctacaaactttgaagccacacccca

SEQ ID NO: 1741 - DNA, 35 bp, Artificial Sequence; identical to SEQ ID NO: 1322
  Synthetic oligonucleotide

SEQ ID NO: 1742 - DNA, 38 bp, Artificial Sequence
  Synthetic oligonucleotide
tccactcaatccccggttcgtatgctctgtaccattga

SEQ ID NO: 1743 - DNA, 38 bp, Artificial Sequence
  Synthetic oligonucleotide
tcccgtcccacctttactttgctacttcaccatcttga

SEQ ID NO: 1744 - DNA, 38 bp, Artificial Sequence
  Synthetic oligonucleotide
tccttgcatacctcggctctcctttctctcacatttga

SEQ ID NO: 1745 - DNA, 37 bp, Artificial Sequence
  Synthetic oligonucleotide
tctcgtgcgcgatttctgttctagggtaggagaggga

SEQ ID NO: 1746 - DNA, 38 bp, Artificial Sequence
  Synthetic oligonucleotide
tcggctcatccaaaattacttgcgggtttcataaatga

SEQ ID NO: 1747 - DNA, 36 bp, Artificial Sequence
  Synthetic oligonucleotide
tctcgcacctttattttctccgctcttttgtttcca

SEQ ID NO: 1748 - DNA, 38 bp, Artificial Sequence
  Synthetic oligonucleotide
tcgctacaattggccttttctgtatttgggttctatga

SEQ ID NO: 1749 - DNA, 37 bp, Artificial Sequence
  Synthetic oligonucleotide
tgcacgccgagcaaggcggtactctaggacccacgga

SEQ ID NO: 1750 - DNA, 38 bp, Artificial Sequence
  Synthetic oligonucleotide
tgccgcttttaccacttgacttacgataagaaaactga

SEQ ID NO: 1751 - DNA, 37 bp, Artificial Sequence
  Synthetic oligonucleotide
tgagtttttctaaataccgcagcctcagccacgcgga

SEQ ID NO: 1752 - DNA, 34 bp, Artificial Sequence
  Synthetic oligonucleotide
tgccttttttttcaccggtttgattccgctttcg

SEQ ID NO: 1753 - DNA, 35 bp, Artificial Sequence
  Synthetic oligonucleotide
tgaaagccaggtattttggggctcctttttcctcc

SEQ ID NO: 1754 - DNA, 38 bp, Artificial Sequence
  Synthetic oligonucleotide
tgacctacaaagggtttgaaataaatcgctcgacgtga

SEQ ID NO: 1755 - DNA, 35 bp, Artificial Sequence
  Synthetic oligonucleotide
tggaaagttagatttcctggggtctcgctttgagt

SEQ ID NO: 1756 - DNA, 35 bp, Artificial Sequence
  Synthetic oligonucleotide
tgtacttacttttactcgatcaccttataatttcc

SEQ ID NO: 1757 - DNA, 38 bp, Artificial Sequence
  Synthetic oligonucleotide
tggcctattctcgtacaatttacttcttatcatcctga

SEQ ID NO: 1758 - DNA, 38 bp, Artificial Sequence
  Synthetic oligonucleotide
ttagtacgtgccgagccccgagccctagagacctgtga

SEQ ID NO: 1759 - DNA, 36 bp, Artificial Sequence; identical to SEQ ID NO: 1501
  Synthetic oligonucleotide

SEQ ID NO: 1760 - DNA, 35 bp, Artificial Sequence
  Synthetic oligonucleotide
tgttagttccactttccgataatccgtcttcctta

SEQ ID NO: 1761 - DNA, 36 bp, Artificial Sequence
  Synthetic oligonucleotide
tgttaggcctttatttaccttatcttaattgtttta

SEQ ID NO: 1762 - DNA, 38 bp, Artificial Sequence
  Synthetic oligonucleotide
tgtttttacacgcctactttttatctatctccacatga

SEQ ID NO: 1763 - DNA, 38 bp, Artificial Sequence
  Synthetic oligonucleotide
ttccccttttatttgcccgtaataatcgcttgacatga

SEQ ID NO: 1764 - DNA, 38 bp, Artificial Sequence
  Synthetic oligonucleotide
ttgaacctcggtagagccgtaaggcctatccggtttga

SEQ ID NO: 1765 - DNA, 37 bp, Artificial Sequence
  Synthetic oligonucleotide
ttcgacccttttccatacttcttctcacgcaaattga

SEQ ID NO: 1766 - DNA, 35 bp, Artificial Sequence
  Synthetic oligonucleotide
ttcttaatgtaaacttttgttgatactgtgccacc

SEQ ID NO: 1767 - DNA, 36 bp, Artificial Sequence
  Synthetic oligonucleotide
ttcccctctactcgcctattttcctcataaaattta

SEQ ID NO: 1768 - DNA, 35 bp, Artificial Sequence
  Synthetic oligonucleotide
ttcctcccccccgtgcaattttagaggtcccgtgg

SEQ ID NO: 1769 - DNA, 35 bp, Artificial Sequence
  Synthetic oligonucleotide
ttctcaccgtacatcccttacctatccccttttat

SEQ ID NO: 1770 - DNA, 38 bp, Artificial Sequence; identical to SEQ ID NO: 1575
  Synthetic oligonucleotide

SEQ ID NO: 1771 - DNA, 36 bp, Artificial Sequence
  Synthetic oligonucleotide
tttgcgaatctagctttcctgtatacatgacaataa

SEQ ID NO: 1772 - DNA, 35 bp, Artificial Sequence
  Synthetic oligonucleotide
ttggtctattatgctctatatgtgaagtgcgaaaa

SEQ ID NO: 1773 - DNA, 35 bp, Artificial Sequence
  Synthetic oligonucleotide
ttttagttccactttccgataatccgccttcctta

SEQ ID NO: 1774 - DNA, 35 bp, Artificial Sequence
  Synthetic oligonucleotide
ttttagtatacccaccgcgatactctcagtcttgc

SEQ ID NO: 1775 - DNA, 38 bp, Artificial Sequence
  Synthetic oligonucleotide
ttttggcgtgagctccaggtagtggttgaaacccatga

SEQ ID NO: 1776 - DNA, 37 bp, Artificial Sequence
  Synthetic oligonucleotide
agttcgccgttggaggctctttcgacatcatgctaga

SEQ ID NO: 1777 - DNA, 36 bp, Artificial Sequence; identical to SEQ ID NO: 1357
  Synthetic oligonucleotide

SEQ ID NO: 1778 - DNA, 35 bp, Artificial Sequence
  Synthetic oligonucleotide
aaagcgatcacgtttctttgggctgctgtctagca

SEQ ID NO: 1779 - DNA, 36 bp, Artificial Sequence
  Synthetic oligonucleotide
ccattaacggtaagacttaattccgtttggcgtgta

SEQ ID NO: 1780 - DNA, 37 bp, Artificial Sequence; identical to SEQ ID NO: 1358
  Synthetic oligonucleotide

SEQ ID NO: 1781 - DNA, 36 bp, Artificial Sequence
  Synthetic oligonucleotide
aatcgtactcacggtgacatccttggtttgatggta

SEQ ID NO: 1782 - DNA, 36 bp, Artificial Sequence; identical to SEQ ID NO: 1361
  Synthetic oligonucleotide

SEQ ID NO: 1783 - DNA, 38 bp, Artificial Sequence
  Synthetic oligonucleotide
gagttttactgccgtgtcaattatcggtcctgtgttga

SEQ ID NO: 1784 - DNA, 38 bp, Artificial Sequence
  Synthetic oligonucleotide
cgggacgaatcttagtttattccattcgcaagtgctga

SEQ ID NO: 1785 - DNA, 35 bp, Artificial Sequence
  Synthetic oligonucleotide
gatcataccgcgatatagacattgcaccgtttcta

SEQ ID NO: 1786 - DNA, 35 bp, Artificial Sequence; identical to SEQ ID NO: 1362
  Synthetic oligonucleotide

SEQ ID NO: 1787 - DNA, 38 bp, Artificial Sequence
  Synthetic oligonucleotide
agggacgaatcttagtttattccattcgcaagtgctga

SEQ ID NO: 1788 - DNA, 38 bp, Artificial Sequence
  Synthetic oligonucleotide
atcgcttaagttccgtaagggttaaggttcgttattga

SEQ ID NO: 1789 - DNA, 35 bp, Artificial Sequence
  Synthetic oligonucleotide
gagtacgcgcaatgacaatcgacttgttttcggtc

SEQ ID NO: 1790 - DNA, 37 bp, Artificial Sequence; identical to SEQ ID NO: 1366
  Synthetic oligonucleotide

SEQ ID NO: 1791 - DNA, 36 bp, Artificial Sequence
  Synthetic oligonucleotide
cctcagtttacgtactcatcttgaatgggggaaata

SEQ ID NO: 1792 - DNA, 38 bp, Artificial Sequence; identical to SEQ ID NO: 1367
  Synthetic oligonucleotide

SEQ ID NO: 1793 - DNA, 35 bp, Artificial Sequence; identical to SEQ ID NO: 1368
  Synthetic oligonucleotide

SEQ ID NO: 1794 - DNA, 38 bp, Artificial Sequence
  Synthetic oligonucleotide
agattaggttgctctgtcccgtgcttaagtatcgctga

SEQ ID NO: 1795 - DNA, 38 bp, Artificial Sequence
  Synthetic oligonucleotide
acattttccgcatgggacggaatgttcttcttcattga

SEQ ID NO: 1796 - DNA, 36 bp, Artificial Sequence; identical to SEQ ID NO: 1521
  Synthetic oligonucleotide

SEQ ID NO: 1797 - DNA, 36 bp, Artificial Sequence; identical to SEQ ID NO: 1369
  Synthetic oligonucleotide

SEQ ID NO: 1798 - DNA, 35 bp, Artificial Sequence; identical to SEQ ID NO: 1197
  Synthetic oligonucleotide

SEQ ID NO: 1799 - DNA, 35 bp, Artificial Sequence
  Synthetic oligonucleotide
tacctcatgtttgtcactatggaaatcatcccgcc

SEQ ID NO: 1800 - DNA, 35 bp, Artificial Sequence
  Synthetic oligonucleotide
tgcttctgcatgcaacgtgctctggactagctgtc

SEQ ID NO: 1801 - DNA, 35 bp, Artificial Sequence; identical to SEQ ID NO: 1370
  Synthetic oligonucleotide

SEQ ID NO: 1802 - DNA, 37 bp, Artificial Sequence; identical to SEQ ID NO: 1421
  Synthetic oligonucleotide

SEQ ID NO: 1803 - DNA, 36 bp, Artificial Sequence; identical to SEQ ID NO: 1409
  Synthetic oligonucleotide

SEQ ID NO: 1804 - DNA, 37 bp, Artificial Sequence; identical to SEQ ID NO: 1420
  Synthetic oligonucleotide

SEQ ID NO: 1805 - DNA, 38 bp, Artificial Sequence; identical to SEQ ID NO: 1372
  Synthetic oligonucleotide

SEQ ID NO: 1806 - DNA, 36 bp, Artificial Sequence; identical to SEQ ID NO: 1373
  Synthetic oligonucleotide

SEQ ID NO: 1807 - DNA, 36 bp, Artificial Sequence; identical to SEQ ID NO: 1374
  Synthetic oligonucleotide

SEQ ID NO: 1808 - DNA, 36 bp, Artificial Sequence
  Synthetic oligonucleotide
ttggcctttgagttagtgcctagatagcctgagtta

SEQ ID NO: 1809 - DNA, 36 bp, Artificial Sequence
  Synthetic oligonucleotide
tcattggttccgatccggggctctggacctgacata

SEQ ID NO: 1810 - DNA, 36 bp, Artificial Sequence; identical to SEQ ID NO: 1375
  Synthetic oligonucleotide

SEQ ID NO: 1811 - DNA, 35 bp, Artificial Sequence; identical to SEQ ID NO: 1376
  Synthetic oligonucleotide

SEQ ID NO: 1812 - DNA, 36 bp, Artificial Sequence
  Synthetic oligonucleotide
gcggagcgcttatataatggtgttgtaggtccatta

SEQ ID NO: 1813 - DNA, 35 bp, Artificial Sequence
  Synthetic oligonucleotide
gtacgccgctgccaataatgtctgttgttacattc

SEQ ID NO: 1814 - DNA, 36 bp, Artificial Sequence
  Synthetic oligonucleotide
tttaatggggagctacgtctcgaatcgattttggta

SEQ ID NO: 1815 - DNA, 35 bp, Artificial Sequence; identical to SEQ ID NO: 1377
  Synthetic oligonucleotide

SEQ ID NO: 1816 - DNA, 35 bp, Artificial Sequence
  Synthetic oligonucleotide
ttcccttgttcgagtttcccagcctggacgccctg

SEQ ID NO: 1817 - DNA, 36 bp, Artificial Sequence
  Synthetic oligonucleotide
tccctgtcggtccaaacgtaagggcgggctaaaaca

SEQ ID NO: 1818 - DNA, 36 bp, Artificial Sequence
  Synthetic oligonucleotide
gtctggctggaaaatcagggttgcctatgtttcaaa

SEQ ID NO: 1819 - DNA, 36 bp, Artificial Sequence
  Synthetic oligonucleotide
tacattccgggctgttcagcaatgtcgctccagtta

SEQ ID NO: 1820 - DNA, 38 bp, Artificial Sequence; identical to SEQ ID NO: 1380
  Synthetic oligonucleotide

SEQ ID NO: 1821 - DNA, 35 bp, Artificial Sequence
  Synthetic oligonucleotide
tttgcaagttcgctccgtatatccactgtgaagac

SEQ ID NO: 1822 - DNA, 35 bp, Artificial Sequence
  Synthetic oligonucleotide
tttgcaagttcgctccgtatatccactgtgaagcc

SEQ ID NO: 1823 - DNA, 36 bp, Artificial Sequence
  Synthetic oligonucleotide
tcctctccgtctgtgaagacgtgtgtggcggaatta

SEQ ID NO: 1824 - DNA, 35 bp, Artificial Sequence; identical to SEQ ID NO: 1415
  Synthetic oligonucleotide

SEQ ID NO: 1825 - DNA, 36 bp, Artificial Sequence; identical to SEQ ID NO: 1382
  Synthetic oligonucleotide

SEQ ID NO: 1826 - DNA, 37 bp, Artificial Sequence
  Synthetic oligonucleotide
aaccaaacctgtacccgaataaatcatccattaacga

SEQ ID NO: 1827 - DNA, 36 bp, Artificial Sequence
  Synthetic oligonucleotide
aacccaattcacatactctctcaccctcactaaaca

SEQ ID NO: 1828 - DNA, 37 bp, Artificial Sequence
  Synthetic oligonucleotide
aacaacctcgaatttgtataggttcgcatcactctga

SEQ ID NO: 1829 - DNA, 35 bp, Artificial Sequence
  Synthetic oligonucleotide
aactgtcatccgctgactaactcaatctaactcca

SEQ ID NO: 1830 - DNA, 38 bp, Artificial Sequence
  Synthetic oligonucleotide
acattaaggatttatcttcacccatttttgcctcttga

SEQ ID NO: 1831 - DNA, 38 bp, Artificial Sequence
  Synthetic oligonucleotide
acaaagtaacgtacctcagttccggtacttacgggtga

SEQ ID NO: 1832 - DNA, 35 bp, Artificial Sequence
  Synthetic oligonucleotide
accccacctgcacaccttcatctcatctattacat

SEQ ID NO: 1833 - DNA, 38 bp, Artificial Sequence; identical to SEQ ID NO: 1795
  Synthetic oligonucleotide

SEQ ID NO: 1834 - DNA, 37 bp, Artificial Sequence
  Synthetic oligonucleotide
acaattaatataaattccttacatcaatcctagacga

SEQ ID NO: 1835 - DNA, 38 bp, Artificial Sequence
  Synthetic oligonucleotide
acattcccgtggtggtccttacgggtgggccagcctga

SEQ ID NO: 1836 - DNA, 38 bp, Artificial Sequence; identical to SEQ ID NO: 1383
  Synthetic oligonucleotide

SEQ ID NO: 1837 - DNA, 35 bp, Artificial Sequence
  Synthetic oligonucleotide
accggactgcacagggatcccgataggagggtgac

SEQ ID NO: 1838 - DNA, 37 bp, Artificial Sequence
  Synthetic oligonucleotide
acccttgcaatcaatccccccttttacctgtacatga

SEQ ID NO: 1839 - DNA, 36 bp, Artificial Sequence
  Synthetic oligonucleotide
actcgcccttcacgactttatccaaatttactttca

SEQ ID NO: 1840 - DNA, 35 bp, Artificial Sequence
  Synthetic oligonucleotide
acgtctgccaaatctactcgcattcgatacacaca

SEQ ID NO: 1841 - DNA, 35 bp, Artificial Sequence
  Synthetic oligonucleotide
actactgggcgcactagcgcgaggctccactgaat

SEQ ID NO: 1842 - DNA, 38 bp, Artificial Sequence
  Synthetic oligonucleotide
actcacattcccaccccctattgcctttaaatacctga

SEQ ID NO: 1843 - DNA, 37 bp, Artificial Sequence
  Synthetic oligonucleotide
actgcagcatcaagccactaattggggcttgtatcga

SEQ ID NO: 1844 - DNA, 37 bp, Artificial Sequence
  Synthetic oligonucleotide
acggttggagcttgtgggaaactaggttgggttcgga

SEQ ID NO: 1845 - DNA, 35 bp, Artificial Sequence; identical to SEQ ID NO: 1368
  Synthetic oligonucleotide

SEQ ID NO: 1846 - DNA, 35 bp, Artificial Sequence
  Synthetic oligonucleotide
agcacccacccgcttctattcctcgatcatacact

SEQ ID NO: 1847 - DNA, 35 bp, Artificial Sequence; identical to SEQ ID NO: 1362
  Synthetic oligonucleotide

SEQ ID NO: 1848 - DNA, 36 bp, Artificial Sequence; identical to SEQ ID NO: 1361
  Synthetic oligonucleotide

SEQ ID NO: 1849 - DNA, 35 bp, Artificial Sequence
  Synthetic oligonucleotide
agattgctccgcagtacggtgtagggcgataaaaa

SEQ ID NO: 1850 - DNA, 35 bp, Artificial Sequence
  Synthetic oligonucleotide
agccgcccctttagacagaggttacgacttgcgta

SEQ ID NO: 1851 - DNA, 38 bp, Artificial Sequence
  Synthetic oligonucleotide
actttggggctttctcggtcttcgcactatggtactga

SEQ ID NO: 1852 - DNA, 36 bp, Artificial Sequence; identical to SEQ ID NO: 1388
  Synthetic oligonucleotide

SEQ ID NO: 1853 - DNA, 36 bp, Artificial Sequence
  Synthetic oligonucleotide
agaaccccattctcattccaccagttactacgctta

SEQ ID NO: 1854 - DNA, 36 bp, Artificial Sequence
  Synthetic oligonucleotide
aggtatacaaatgtgtagtctagtcctgccgatcga

SEQ ID NO: 1855 - DNA, 36 bp, Artificial Sequence; identical to SEQ ID NO: 1357
  Synthetic oligonucleotide

SEQ ID NO: 1856 - DNA, 36 bp, Artificial Sequence
  Synthetic oligonucleotide
agggattcgccctgtgtcacgctcaaactgtagtaa

SEQ ID NO: 1857 - DNA, 38 bp, Artificial Sequence
  Synthetic oligonucleotide
agtaatccccggcgtataatttcagtcctgtggtttga

SEQ ID NO: 1858 - DNA, 35 bp, Artificial Sequence
  Synthetic oligonucleotide
agttgatgcagtgggacctgagattaggcttatga

SEQ ID NO: 1859 - DNA, 36 bp, Artificial Sequence
  Synthetic oligonucleotide
agtattcctctggtagtatttttccttaattccgta

SEQ ID NO: 1860 - DNA, 35 bp, Artificial Sequence; identical to SEQ ID NO: 1391
  Synthetic oligonucleotide

SEQ ID NO: 1861 - DNA, 35 bp, Artificial Sequence
  Synthetic oligonucleotide
agtacctcttgtgggtcttggggctgccactgcct

SEQ ID NO: 1862 - DNA, 36 bp, Artificial Sequence
  Synthetic oligonucleotide
atcaccgtccttatcataaccagttcgttttttata

SEQ ID NO: 1863 - DNA, 36 bp, Artificial Sequence
  Synthetic oligonucleotide
atgcttccatctctgttttttaaccccttaccgtta

SEQ ID NO: 1864 - DNA, 35 bp, Artificial Sequence; identical to SEQ ID NO: 1365
  Synthetic oligonucleotide

SEQ ID NO: 1865 - DNA, 37 bp, Artificial Sequence
  Synthetic oligonucleotide
caccctaatcaccgctaaccttaccataacaatttga

SEQ ID NO: 1866 - DNA, 37 bp, Artificial Sequence
  Synthetic oligonucleotide
cagccgctctagttacaggtttactgcggctaaacga

SEQ ID NO: 1867 - DNA, 35 bp, Artificial Sequence
  Synthetic oligonucleotide
cacagtatccttgtacagattttgatggttgttgg

SEQ ID NO: 1868 - DNA, 35 bp, Artificial Sequence
  Synthetic oligonucleotide
catcggggtacgcttcctttaaaagatcctgtgcc

SEQ ID NO: 1869 - DNA, 36 bp, Artificial Sequence
  Synthetic oligonucleotide
attcatggtgccgtgagaaaataaccatgtacgcaa

SEQ ID NO: 1870 - DNA, 35 bp, Artificial Sequence
  Synthetic oligonucleotide
atttccataccattgtaggccttctcgtatcgtaa

SEQ ID NO: 1871 - DNA, 38 bp, Artificial Sequence
  Synthetic oligonucleotide
cccatagggcactttttacacccctcgcatactattga

SEQ ID NO: 1872 - DNA, 37 bp, Artificial Sequence
  Synthetic oligonucleotide
ccgtgatgcagatgaatgtacggacgtctgccggtga

SEQ ID NO: 1873 - DNA, 38 bp, Artificial Sequence
  Synthetic oligonucleotide
cccaccgagggcaggtggtgacgtttccccagccttga

SEQ ID NO: 1874 - DNA, 38 bp, Artificial Sequence
  Synthetic oligonucleotide
cccagacaactaccgcggagtagcggaagccgtactga

SEQ ID NO: 1875 - DNA, 36 bp, Artificial Sequence
  Synthetic oligonucleotide
ccgcgcatcacattgggctctgggatgcccgctgca

SEQ ID NO: 1876 - DNA, 35 bp, Artificial Sequence
  Synthetic oligonucleotide
cctagaccacgtgtgtgtcccgggtagggaagtct

SEQ ID NO: 1877 - DNA, 37 bp, Artificial Sequence; identical to SEQ ID NO: 1358
  Synthetic oligonucleotide

SEQ ID NO: 1878 - DNA, 36 bp, Artificial Sequence; identical to SEQ ID NO: 1779
  Synthetic oligonucleotide

SEQ ID NO: 1879 - DNA, 37 bp, Artificial Sequence
  Synthetic oligonucleotide
ccccaccgcgcacaccccgaactttacatatgcatga

SEQ ID NO: 1880 - DNA, 38 bp, Artificial Sequence
  Synthetic oligonucleotide
ccacacccattttgactgaacagcctatccggtactga

SEQ ID NO: 1881 - DNA, 36 bp, Artificial Sequence
  Synthetic oligonucleotide
cctgttcaattcatcctccaggttcgtgttacccta

SEQ ID NO: 1882 - DNA, 36 bp, Artificial Sequence
  Synthetic oligonucleotide
cctttcggactagcttctggcccatttggcgccata

SEQ ID NO: 1883 - DNA, 35 bp, Artificial Sequence
  Synthetic oligonucleotide
ctacaattagaagctcggtttcttctgcggtgacg

SEQ ID NO: 1884 - DNA, 38 bp, Artificial Sequence; identical to SEQ ID NO: 1367
  Synthetic oligonucleotide

SEQ ID NO: 1885 - DNA, 35 bp, Artificial Sequence
  Synthetic oligonucleotide
cgcgggggcctatatgctgtttccaccgctagtta

SEQ ID NO: 1886 - DNA, 35 bp, Artificial Sequence
  Synthetic oligonucleotide
cgctggctgcacgcacgcctgggcgcactgcccta

SEQ ID NO: 1887 - DNA, 35 bp, Artificial Sequence
  Synthetic oligonucleotide
cgtataggttaatacgtactggagcccggagggga

SEQ ID NO: 1888 - DNA, 37 bp, Artificial Sequence
  Synthetic oligonucleotide
cctgaatgggcggtccgcacttcgttagtatcccaga

SEQ ID NO: 1889 - DNA, 35 bp, Artificial Sequence
  Synthetic oligonucleotide
ctcaacgtagtctgcggagttactccagaatgacg

SEQ ID NO: 1890 - DNA, 38 bp, Artificial Sequence
  Synthetic oligonucleotide
gaacttcgcggtgactcgtgcccttcgttgtcctttga

SEQ ID NO: 1891 - DNA, 35 bp, Artificial Sequence
  Synthetic oligonucleotide
gaaccatcattggcttcatttagctattctacacc

SEQ ID NO: 1892 - DNA, 38 bp, Artificial Sequence
  Synthetic oligonucleotide
ctgtccttaaatggaaggtcattttggctcaggtctga

SEQ ID NO: 1893 - DNA, 37 bp, Artificial Sequence
  Synthetic oligonucleotide
gacacgggggcaaaggtggtttgtgtaccccgtacga

SEQ ID NO: 1894 - DNA, 37 bp, Artificial Sequence
  Synthetic oligonucleotide
gaaggtcatcggactgttctgtcaatccccctttgga

SEQ ID NO: 1895 - DNA, 35 bp, Artificial Sequence
  Synthetic oligonucleotide
gagctcaaatcggggactactgcattgtctactcg

SEQ ID NO: 1896 - DNA, 37 bp, Artificial Sequence; identical to SEQ ID NO: 1366
  Synthetic oligonucleotide

SEQ ID NO: 1897 - DNA, 38 bp, Artificial Sequence
  Synthetic oligonucleotide
gacgccttgaaagcgacgcctgatactcgggggcctga

SEQ ID NO: 1898 - DNA, 37 bp, Artificial Sequence
  Synthetic oligonucleotide
gagggccccaagtcaccgctgtagttctaggcccaga

SEQ ID NO: 1899 - DNA, 35 bp, Artificial Sequence
  Synthetic oligonucleotide
gacggtcgtactggagcatcctgagactgttcgag

SEQ ID NO: 1900 - DNA, 37 bp, Artificial Sequence; identical to SEQ ID NO: 1538
  Synthetic oligonucleotide

SEQ ID NO: 1901 - DNA, 35 bp, Artificial Sequence
  Synthetic oligonucleotide
gagtacaggtccggcgccctatcgagaaaggaaaa

SEQ ID NO: 1902 - DNA, 38 bp, Artificial Sequence
  Synthetic oligonucleotide
gagtactgccatgaggccagaggtaagaagccgaatga

SEQ ID NO: 1903 - DNA, 35 bp, Artificial Sequence
  Synthetic oligonucleotide
gagtacagttggattccgcccttgtatctgtacga

SEQ ID NO: 1904 - DNA, 37 bp, Artificial Sequence
  Synthetic oligonucleotide
gagtacctacccgtcgaatattgagattcgggaacga

SEQ ID NO: 1905 - DNA, 35 bp, Artificial Sequence
  Synthetic oligonucleotide
gagtctcatacccctgaatatgtttttatgctttc

SEQ ID NO: 1906 - DNA, 36 bp, Artificial Sequence
  Synthetic oligonucleotide
gagtggctcaaccagggtccagaattacaaaaaata

SEQ ID NO: 1907 - DNA, 36 bp, Artificial Sequence
  Synthetic oligonucleotide
gcaatgtcccctgttttctactaactctgatcttga

SEQ ID NO: 1908 - DNA, 36 bp, Artificial Sequence
  Synthetic oligonucleotide
gcagttctaaaggtggaagaatccaaatgacccaga

SEQ ID NO: 1909 - DNA, 35 bp, Artificial Sequence
  Synthetic oligonucleotide
gcaccttctcctttaattcccagccaataaccatc

SEQ ID NO: 1910 - DNA, 36 bp, Artificial Sequence
  Synthetic oligonucleotide
gatgtaacgggtctgcggggagtttgtcatgcggga

SEQ ID NO: 1911 - DNA, 35 bp, Artificial Sequence
  Synthetic oligonucleotide
gccatcatattcattattccatgcctccccatccc

SEQ ID NO: 1912 - DNA, 35 bp, Artificial Sequence; identical to SEQ ID NO: 1785
  Synthetic oligonucleotide

SEQ ID NO: 1913 - DNA, 36 bp, Artificial Sequence
  Synthetic oligonucleotide
gcaatgaacacctacacatacctgccttcacgatta

SEQ ID NO: 1914 - DNA, 36 bp, Artificial Sequence
  Synthetic oligonucleotide
gccctcacttcaacgtttcataactctacattaata

SEQ ID NO: 1915 - DNA, 38 bp, Artificial Sequence
  Synthetic oligonucleotide
gcgccgatggggcatcggtcgcgacagtcccgccgtga

SEQ ID NO: 1916 - DNA, 36 bp, Artificial Sequence
  Synthetic oligonucleotide
gcgttccccttggacaatatcactttcttatcgtaa

SEQ ID NO: 1917 - DNA, 35 bp, Artificial Sequence; identical to SEQ ID NO: 1371
  Synthetic oligonucleotide

SEQ ID NO: 1918 - DNA, 36 bp, Artificial Sequence
  Synthetic oligonucleotide
gcctctgccaagcaattcatcttaacgacctctcta

SEQ ID NO: 1919 - DNA, 35 bp, Artificial Sequence
  Synthetic oligonucleotide
gccgccggagcacggctgtctttatacgcactgta

SEQ ID NO: 1920 - DNA, 36 bp, Artificial Sequence; identical to SEQ ID NO: 1812
  Synthetic oligonucleotide

SEQ ID NO: 1921 - DNA, 38 bp, Artificial Sequence
  Synthetic oligonucleotide
gcgtacatagatctaggctttccatccaggatatgtga

SEQ ID NO: 1922 - DNA, 36 bp, Artificial Sequence
  Synthetic oligonucleotide
gcgccggcatactccttatattccactatccctgta

SEQ ID NO: 1923 - DNA, 38 bp, Artificial Sequence
  Synthetic oligonucleotide
gctaacgtactctttttttcaacttcactgactattga

SEQ ID NO: 1924 - DNA, 38 bp, Artificial Sequence
  Synthetic oligonucleotide
gctcccgaattgttttcctattaatcgttttcccatga

SEQ ID NO: 1925 - DNA, 36 bp, Artificial Sequence
  Synthetic oligonucleotide
gctgaacaggtcacggtcccccccacacgttaacta

SEQ ID NO: 1926 - DNA, 37 bp, Artificial Sequence
  Synthetic oligonucleotide
gctatacgactgcaagggtctgaccgcagggaattga

SEQ ID NO: 1927 - DNA, 36 bp, Artificial Sequence
  Synthetic oligonucleotide
gcttccgtatcaagagtggctcgcacccacagagta

SEQ ID NO: 1928 - DNA, 35 bp, Artificial Sequence
  Synthetic oligonucleotide
ggattacgtacccgactttttttctggttttcttt

SEQ ID NO: 1929 - DNA, 36 bp, Artificial Sequence
  Synthetic oligonucleotide
gggaccggaccctgtccttggtcgtttgatccacga

SEQ ID NO: 1930 - DNA, 38 bp, Artificial Sequence
  Synthetic oligonucleotide
ggtatttttttgtgctaatctcgccgaatcgtacctga

SEQ ID NO: 1931 - DNA, 36 bp, Artificial Sequence
  Synthetic oligonucleotide
ggctcaccgactccttactttgctggtactacctta

SEQ ID NO: 1932 - DNA, 37 bp, Artificial Sequence
  Synthetic oligonucleotide
gggaacgtaaggttttggtgaacagagggtagtaaga

SEQ ID NO: 1933 - DNA, 38 bp, Artificial Sequence
  Synthetic oligonucleotide
ggtgcttgtccctgtctctacgtaacttttgaagttga

SEQ ID NO: 1934 - DNA, 38 bp, Artificial Sequence; identical to SEQ ID NO: 1372
  Synthetic oligonucleotide

SEQ ID NO: 1935 - DNA, 35 bp, Artificial Sequence
  Synthetic oligonucleotide
ggggtccttttccatcacacatgtccagttccgta

SEQ ID NO: 1936 - DNA, 35 bp, Artificial Sequence
  Synthetic oligonucleotide
ggccttcttaccgactggggcttcgggttttacgt

SEQ ID NO: 1937 - DNA, 37 bp, Artificial Sequence
  Synthetic oligonucleotide
gtgggcccgcattgaaaccgcattcgtagagcctgga

SEQ ID NO: 1938 - DNA, 35 bp, Artificial Sequence; identical to SEQ ID NO: 1813
  Synthetic oligonucleotide

SEQ ID NO: 1939 - DNA, 37 bp, Artificial Sequence
  Synthetic oligonucleotide
gtacttgccgggttacgcagcgcgtccctcttcgcga

SEQ ID NO: 1940 - DNA, 37 bp, Artificial Sequence
  Synthetic oligonucleotide
gtgagctttacgtaatgcggtagttcgtactaacgga

SEQ ID NO: 1941 - DNA, 36 bp, Artificial Sequence; identical to SEQ ID NO: 1369
  Synthetic oligonucleotide

SEQ ID NO: 1942 - DNA, 38 bp, Artificial Sequence
  Synthetic oligonucleotide
gtcgcctatcccagtgcttcgaggggcgacgtgtctga

SEQ ID NO: 1943 - DNA, 37 bp, Artificial Sequence
  Synthetic oligonucleotide
gtgtacatttccgcgcaagctactcagttttttttga

SEQ ID NO: 1944 - DNA, 35 bp, Artificial Sequence
  Synthetic oligonucleotide
gtttactcctgtaccgtgaggtgaagggaaagcaa

SEQ ID NO: 1945 - DNA, 36 bp, Artificial Sequence; identical to SEQ ID NO: 1819
  Synthetic oligonucleotide

SEQ ID NO: 1946 - DNA, 37 bp, Artificial Sequence
  Synthetic oligonucleotide
gttttttactatggttcatctaggattccagtttaga

SEQ ID NO: 1947 - DNA, 36 bp, Artificial Sequence
  Synthetic oligonucleotide
gttctttcacggacggcctcctttccgatctattca

SEQ ID NO: 1948 - DNA, 36 bp, Artificial Sequence; identical to SEQ ID NO: 1373
  Synthetic oligonucleotide

SEQ ID NO: 1949 - DNA, 37 bp, Artificial Sequence
  Synthetic oligonucleotide
gttccgggctctttgtgtagtggtgagcacggcacga

SEQ ID NO: 1950 - DNA, 37 bp, Artificial Sequence
  Synthetic oligonucleotide
taaatgcccggttcattgaatcttcacaaagatggga

SEQ ID NO: 1951 - DNA, 36 bp, Artificial Sequence; identical to SEQ ID NO: 1374
  Synthetic oligonucleotide

SEQ ID NO: 1952 - DNA, 38 bp, Artificial Sequence
  Synthetic oligonucleotide
tacaccatgatacttacatctagcaaccttttttttga

SEQ ID NO: 1953 - DNA, 35 bp, Artificial Sequence
  Synthetic oligonucleotide
taaccgttcgctgggttccagtcccttgttaagcc

SEQ ID NO: 1954 - DNA, 36 bp, Artificial Sequence
  Synthetic oligonucleotide
tagtgttaaacgtgagtgcacttaatcaccctggta

SEQ ID NO: 1955 - DNA, 36 bp, Artificial Sequence
  Synthetic oligonucleotide
taccttgacctgcatcggttctcttcataatcctaa

SEQ ID NO: 1956 - DNA, 38 bp, Artificial Sequence
  Synthetic oligonucleotide
tagtcctgcactgttttacagttcttggtaatatttga

SEQ ID NO: 1957 - DNA, 35 bp, Artificial Sequence
  Synthetic oligonucleotide
tacttcaacacctcgctcgttacataccaatttct

SEQ ID NO: 1958 - DNA, 36 bp, Artificial Sequence; identical to SEQ ID NO: 1409
  Synthetic oligonucleotide

SEQ ID NO: 1959 - DNA, 35 bp, Artificial Sequence
  Synthetic oligonucleotide
tcatcgtcgcgtggccggtaggctgggaaatcctg

SEQ ID NO: 1960 - DNA, 37 bp, Artificial Sequence
  Synthetic oligonucleotide
tcacggatgcgaatcaaatgaactacctaagtccgga

SEQ ID NO: 1961 - DNA, 36 bp, Artificial Sequence; identical to SEQ ID NO: 1809
  Synthetic oligonucleotide

SEQ ID NO: 1962 - DNA, 35 bp, Artificial Sequence; identical to SEQ ID NO: 1548
  Synthetic oligonucleotide

SEQ ID NO: 1963 - DNA, 37 bp, Artificial Sequence
  Synthetic oligonucleotide
tccagccacatggatgaacagtgggccttttcacgga

SEQ ID NO: 1964 - DNA, 37 bp, Artificial Sequence; identical to SEQ ID NO: 1410
  Synthetic oligonucleotide

SEQ ID NO: 1965 - DNA, 38 bp, Artificial Sequence
  Synthetic oligonucleotide
tccttccgacgataacttacgtgtgacacgcgtactga

SEQ ID NO: 1966 - DNA, 38 bp, Artificial Sequence; identical to SEQ ID NO: 1379
  Synthetic oligonucleotide

SEQ ID NO: 1967 - DNA, 38 bp, Artificial Sequence
  Synthetic oligonucleotide
tcccgagtttgtcgatctcgagtggggcccttacctga

SEQ ID NO: 1968 - DNA, 36 bp, Artificial Sequence
  Synthetic oligonucleotide
tccctgtaacagggtctctctctttatatattctca

SEQ ID NO: 1969 - DNA, 37 bp, Artificial Sequence
  Synthetic oligonucleotide
tcgttcctcctttcgggtccgtgaggatccggaacga

SEQ ID NO: 1970 - DNA, 36 bp, Artificial Sequence; identical to SEQ ID NO: 1375
  Synthetic oligonucleotide

SEQ ID NO: 1971 - DNA, 37 bp, Artificial Sequence
  Synthetic oligonucleotide
tctcctttccaacgggacgctgtgttcccctcagtga

SEQ ID NO: 1972 - DNA, 35 bp, Artificial Sequence
  Synthetic oligonucleotide
tctgcactaccgtgaggtatggtgataggtggcga

SEQ ID NO: 1973 - DNA, 36 bp, Artificial Sequence
  Synthetic oligonucleotide
tcgggccagatcgcattcgtagttgctgtttccgta

SEQ ID NO: 1974 - DNA, 37 bp, Artificial Sequence
  Synthetic oligonucleotide
tgcacttaattccacttttccacccttttcactttga

SEQ ID NO: 1975 - DNA, 37 bp, Artificial Sequence
  Synthetic oligonucleotide
tgcacataattccacctttccacccttttcactttga

SEQ ID NO: 1976 - DNA, 38 bp, Artificial Sequence
  Synthetic oligonucleotide
tgagcatcttcacacgcatggctccacctcataaatga

SEQ ID NO: 1977 - DNA, 36 bp, Artificial Sequence; identical to SEQ ID NO: 1521
  Synthetic oligonucleotide

SEQ ID NO: 1978 - DNA, 37 bp, Artificial Sequence
  Synthetic oligonucleotide
tggtctgcacacgcacgtcgcctcttggggttatgga

SEQ ID NO: 1979 - DNA, 38 bp, Artificial Sequence
  Synthetic oligonucleotide
tgtagttttgcaatctatgggctaggaccatgtcatga

SEQ ID NO: 1980 - DNA, 37 bp, Artificial Sequence
  Synthetic oligonucleotide
tgctgttctcctggcgataggagattagccggacgga

SEQ ID NO: 1981 - DNA, 36 bp, Artificial Sequence
  Synthetic oligonucleotide
tgctaagagggctaaggccacacacttaataactta

SEQ ID NO: 1982 - DNA, 35 bp, Artificial Sequence; identical to SEQ ID NO: 1800
  Synthetic oligonucleotide

SEQ ID NO: 1983 - DNA, 38 bp, Artificial Sequence; identical to SEQ ID NO: 1380
  Synthetic oligonucleotide

SEQ ID NO: 1984 - DNA, 36 bp, Artificial Sequence
  Synthetic oligonucleotide
tggagtactagttccgaggacgtgagggaagactcg

SEQ ID NO: 1985 - DNA, 35 bp, Artificial Sequence
  Synthetic oligonucleotide
tggtccctggttccacttcattgagagcagagcat

SEQ ID NO: 1986 - DNA, 36 bp, Artificial Sequence
  Synthetic oligonucleotide
tgctcggatcttcgattcgtgccgcctgacaaatca

SEQ ID NO: 1987 - DNA, 35 bp, Artificial Sequence; identical to SEQ ID NO: 1415
  Synthetic oligonucleotide

SEQ ID NO: 1988 - DNA, 38 bp, Artificial Sequence
  Synthetic oligonucleotide
ttacgatgctcaagggtcccgttcgttcacagatatga

SEQ ID NO: 1989 - DNA, 38 bp, Artificial Sequence
  Synthetic oligonucleotide
ttacaaaccccggtgctctaaagttatcgatctcttga

SEQ ID NO: 1990 - DNA, 35 bp, Artificial Sequence
  Synthetic oligonucleotide
tgttggggggttagcacgggtttatgggttgcttc

SEQ ID NO: 1991 - DNA, 35 bp, Artificial Sequence
  Synthetic oligonucleotide
ttgcagtggagtaagccctgaccgaggagcgacga

SEQ ID NO: 1992 - DNA, 36 bp, Artificial Sequence
  Synthetic oligonucleotide
ttctcgcctacatctatctcaatattgtcctaccga

SEQ ID NO: 1993 - DNA, 36 bp, Artificial Sequence
  Synthetic oligonucleotide
ttgacatgcgatgtgcacagttagttaatttcaaca

SEQ ID NO: 1994 - DNA, 37 bp, Artificial Sequence
  Synthetic oligonucleotide
ttctatttactaaatacaacctttgtagcagacaaga

SEQ ID NO: 1995 - DNA, 36 bp, Artificial Sequence
  Synthetic oligonucleotide
ttccacacttcactgtacccactcttaccagccaca

SEQ ID NO: 1996 - DNA, 36 bp, Artificial Sequence
  Synthetic oligonucleotide
ttcctctagcctccgactggcgtgtgactctaaaga

SEQ ID NO: 1997 - DNA, 35 bp, Artificial Sequence
  Synthetic oligonucleotide
tttccgctatagtgcttctggtacgacgcgtacgg

SEQ ID NO: 1998 - DNA, 38 bp, Artificial Sequence
  Synthetic oligonucleotide
tttatactcatacccgaactgttccacaccgcaactga

SEQ ID NO: 1999 - DNA, 38 bp, Artificial Sequence
  Synthetic oligonucleotide
tttattcgccctttgttgacctacaccacatcacttga

SEQ ID NO: 2000 - DNA, 35 bp, Artificial Sequence; identical to SEQ ID NO: 1376
  Synthetic oligonucleotide

SEQ ID NO: 2001 - DNA, 38 bp, Artificial Sequence
  Synthetic oligonucleotide
ttgtagtttggccctttcgagggccgttgcctggttga

SEQ ID NO: 2002 - DNA, 38 bp, Artificial Sequence
  Synthetic oligonucleotide
tttttgttccataggtacggtctccggaggaatcgtga

SEQ ID NO: 2003 - DNA, 38 bp, Artificial Sequence
  Synthetic oligonucleotide
ttttgctaacgcgacggaggcgccgagagctatgctga

SEQ ID NO: 2004 - DNA, 35 bp, Artificial Sequence; identical to SEQ ID NO: 1370
  Synthetic oligonucleotide

SEQ ID NO: 2005 - DNA, 37 bp, Artificial Sequence; identical to SEQ ID NO: 1420
  Synthetic oligonucleotide

SEQ ID NO: 2006 - DNA, 36 bp, Artificial Sequence; identical to SEQ ID NO: 1422
  Synthetic oligonucleotide

SEQ ID NO: 2007 - DNA, 36 bp, Artificial Sequence; identical to SEQ ID NO: 1423
  Synthetic oligonucleotide

SEQ ID NO: 2008 - DNA, 37 bp, Artificial Sequence
  Synthetic oligonucleotide
aacgcctaactggacagaaaaatcgtacgctaccaga

SEQ ID NO: 2009 - DNA, 38 bp, Artificial Sequence; identical to SEQ ID NO: 1424
  Synthetic oligonucleotide

SEQ ID NO: 2010 - DNA, 38 bp, Artificial Sequence; identical to SEQ ID NO: 1563
  Synthetic oligonucleotide

SEQ ID NO: 2011 - DNA, 35 bp, Artificial Sequence
  Synthetic oligonucleotide
tggactggtcgtggggtgtgaacgaatccaatgtg

SEQ ID NO: 2012 - DNA, 38 bp, Artificial Sequence; identical to SEQ ID NO: 1502
  Synthetic oligonucleotide

SEQ ID NO: 2013 - DNA, 36 bp, Artificial Sequence
  Synthetic oligonucleotide
tgcaccctacccatttagatgtatcagccacgggca

SEQ ID NO: 2014 - DNA, 36 bp, Artificial Sequence
  Synthetic oligonucleotide
aacccgtagtagcacaccctgtctaacccaaatcaa

SEQ ID NO: 2015 - DNA, 35 bp, Artificial Sequence
  Synthetic oligonucleotide
aaacgcgatcttacatcattacaatccctcaaccc

SEQ ID NO: 2016 - DNA, 35 bp, Artificial Sequence
  Synthetic oligonucleotide
aaatcccatcgagcccttaacccagaccaactacg

SEQ ID NO: 2017 - DNA, 38 bp, Artificial Sequence
  Synthetic oligonucleotide
aagaacatgagactgaatatcgtacgcgagtaaaatga

SEQ ID NO: 2018 - DNA, 35 bp, Artificial Sequence
  Synthetic oligonucleotide
aagagtataggtccgagggaggacctactaattac

SEQ ID NO: 2019 - DNA, 38 bp, Artificial Sequence
  Synthetic oligonucleotide
aatttcggttacaccccgctctctatcactatacgtga

SEQ ID NO: 2020 - DNA, 37 bp, Artificial Sequence
  Synthetic oligonucleotide
accactagagtcctcaagaactcatccacccacctga

SEQ ID NO: 2021 - DNA, 35 bp, Artificial Sequence
  Synthetic oligonucleotide
acggtatttgttttttcgattgatggggaagtata

SEQ ID NO: 2022 - DNA, 37 bp, Artificial Sequence
  Synthetic oligonucleotide
accggcgaataacgccaaagcctgcgactggccttga

SEQ ID NO: 2023 - DNA, 35 bp, Artificial Sequence
  Synthetic oligonucleotide
acgcttttaaaaccatacactcgataactataccc

SEQ ID NO: 2024 - DNA, 36 bp, Artificial Sequence
  Synthetic oligonucleotide
accctactattaacccatcaaaagttcgctacccta

SEQ ID NO: 2025 - DNA, 36 bp, Artificial Sequence
  Synthetic oligonucleotide
acgcccatcgtttcgggcctttgtccatttcataca

SEQ ID NO: 2026 - DNA, 35 bp, Artificial Sequence
  Synthetic oligonucleotide
accttcccttcaacgggtgtattccggcgggtagc

SEQ ID NO: 2027 - DNA, 36 bp, Artificial Sequence
  Synthetic oligonucleotide
acttcacccacacaataccatcatcgataactcaaa

SEQ ID NO: 2028 - DNA, 35 bp, Artificial Sequence
  Synthetic oligonucleotide
agcggctaatcactgaagtagccccaggttttgaa

SEQ ID NO: 2029 - DNA, 37 bp, Artificial Sequence
  Synthetic oligonucleotide
agcaggcccaacggcctctgggttagtatccgcgtga

SEQ ID NO: 2030 - DNA, 36 bp, Artificial Sequence
  Synthetic oligonucleotide
agccgatccttgtccccgttgaaggccggatcgaaa

SEQ ID NO: 2031 - DNA, 38 bp, Artificial Sequence
  Synthetic oligonucleotide
aggcatctcaagcgctcggaggtacgcactatttctga

SEQ ID NO: 2032 - DNA, 35 bp, Artificial Sequence
  Synthetic oligonucleotide
agagacggcttcaacgcggctttcgggctctcttc

SEQ ID NO: 2033 - DNA, 35 bp, Artificial Sequence
  Synthetic oligonucleotide
agtacccccttatccctggggcctcccggggtacc

SEQ ID NO: 2034 - DNA, 36 bp, Artificial Sequence
  Synthetic oligonucleotide
atcaacaccattccctatatccaacactaaacgtaa

SEQ ID NO: 2035 - DNA, 37 bp, Artificial Sequence
  Synthetic oligonucleotide
agtttctcgacaggggcactctggccacgtggctgga

SEQ ID NO: 2036 - DNA, 35 bp, Artificial Sequence
  Synthetic oligonucleotide
aggggatactcagaacccgatgtaaatcttaagaa

SEQ ID NO: 2037 - DNA, 37 bp, Artificial Sequence
  Synthetic oligonucleotide
atcttcccaccacttgtgccttatcattgccccccga

SEQ ID NO: 2038 - DNA, 35 bp, Artificial Sequence; identical to SEQ ID NO: 1663
  Synthetic oligonucleotide

SEQ ID NO: 2039 - DNA, 35 bp, Artificial Sequence
  Synthetic oligonucleotide
ccagctagaccagacgaatgtggaactgaatctgc

SEQ ID NO: 2040 - DNA, 35 bp, Artificial Sequence
  Synthetic oligonucleotide
ccctaaaagcgacccactcagcggatttgacttgc

SEQ ID NO: 2041 - DNA, 35 bp, Artificial Sequence
  Synthetic oligonucleotide
ccaccccaccgagaggggctcatggcatacgctga

SEQ ID NO: 2042 - DNA, 36 bp, Artificial Sequence
  Synthetic oligonucleotide
cccgggaacacggtccgttcgtaggagaacgaccaa

SEQ ID NO: 2043 - DNA, 38 bp, Artificial Sequence
  Synthetic oligonucleotide
ccatgctctccggaggccgttttacggagggagcgtga

SEQ ID NO: 2044 - DNA, 36 bp, Artificial Sequence; identical to SEQ ID NO: 1422
  Synthetic oligonucleotide

SEQ ID NO: 2045 - DNA, 37 bp, Artificial Sequence
  Synthetic oligonucleotide
cgcttccgctacgtaccccccgggcgttcgccttgga

SEQ ID NO: 2046 - DNA, 37 bp, Artificial Sequence
  Synthetic oligonucleotide
ctcaaagcaacttgctggtgccagcaccgaagtccga

SEQ ID NO: 2047 - DNA, 38 bp, Artificial Sequence
  Synthetic oligonucleotide
ccttacatttatgttgaggcccccggtaattattgtga

SEQ ID NO: 2048 - DNA, 35 bp, Artificial Sequence
  Synthetic oligonucleotide
ctggtaccctgcgattcgggtctcgacttggttcc

SEQ ID NO: 2049 - DNA, 37 bp, Artificial Sequence
  Synthetic oligonucleotide
gaacgtacgccttcctcgtaataattggaaccttcta

SEQ ID NO: 2050 - DNA, 35 bp, Artificial Sequence
  Synthetic oligonucleotide
cttcgccatcttccggtcggcgaaaaacaggccac

SEQ ID NO: 2051 - DNA, 35 bp, Artificial Sequence; identical to SEQ ID NO: 1689
  Synthetic oligonucleotide

SEQ ID NO: 2052 - DNA, 37 bp, Artificial Sequence
  Synthetic oligonucleotide
gaggacattggaccgccccatacgaacgccactctga

SEQ ID NO: 2053 - DNA, 36 bp, Artificial Sequence
  Synthetic oligonucleotide
gagtacgactaattatcttaacaacatttatgaaca

SEQ ID NO: 2054 - DNA, 35 bp, Artificial Sequence
  Synthetic oligonucleotide
gagtagttgcatcgaagcggaggcttttccggatc

SEQ ID NO: 2055 - DNA, 36 bp, Artificial Sequence
  Synthetic oligonucleotide
gcactgtccccggttttctactaactctgatcttga

SEQ ID NO: 2056 - DNA, 38 bp, Artificial Sequence
  Synthetic oligonucleotide
gcgtcctgcactgttttacagttcttggtaatatttga

SEQ ID NO: 2057 - DNA, 37 bp, Artificial Sequence
  Synthetic oligonucleotide
ggcacacacctagcctgaaaggtcctttaacattgga

SEQ ID NO: 2058 - DNA, 37 bp, Artificial Sequence
  Synthetic oligonucleotide
ggcccagtactcacgctagaccctcgaggggactcga

SEQ ID NO: 2059 - DNA, 35 bp, Artificial Sequence
  Synthetic oligonucleotide
ggacccgtaccgacacctatagccttcccccagag

SEQ ID NO: 2060 - DNA, 37 bp, Artificial Sequence
  Synthetic oligonucleotide
ggtctagcgggtacaccttctggggttcggtttgtga

SEQ ID NO: 2061 - DNA, 37 bp, Artificial Sequence; identical to SEQ ID NO: 1710
  Synthetic oligonucleotide

SEQ ID NO: 2062 - DNA, 37 bp, Artificial Sequence
  Synthetic oligonucleotide
gggaactcgcaaaatttcttgaccccaaggtacccga

SEQ ID NO: 2063 - DNA, 37 bp, Artificial Sequence
  Synthetic oligonucleotide
ggtccttgagcatcaaatcgctaagggggtccgcaga

SEQ ID NO: 2064 - DNA, 37 bp, Artificial Sequence
  Synthetic oligonucleotide
gtctggtttttatattcagagccctgtttgggttaga

SEQ ID NO: 2065 - DNA, 35 bp, Artificial Sequence
  Synthetic oligonucleotide
taaggatagcgctcggcctttattgatacttgttt

SEQ ID NO: 2066 - DNA, 38 bp, Artificial Sequence
  Synthetic oligonucleotide
taaccgcatcactttcacttgacactaatacctcatga

SEQ ID NO: 2067 - DNA, 36 bp, Artificial Sequence
  Synthetic oligonucleotide
taatatccctgctctcgaacacttcgctttaaacta

SEQ ID NO: 2068 - DNA, 36 bp, Artificial Sequence; identical to SEQ ID NO: 1490
  Synthetic oligonucleotide

SEQ ID NO: 2069 - DNA, 36 bp, Artificial Sequence
  Synthetic oligonucleotide
gttccgctccagggaacagaggatcagggagttcga

SEQ ID NO: 2070 - DNA, 37 bp, Artificial Sequence
  Synthetic oligonucleotide
tatatccgcatcccgaagcatagatctcaagtactga

SEQ ID NO: 2071 - DNA, 38 bp, Artificial Sequence
  Synthetic oligonucleotide
tatacacccgaaaagcgggttatcaaaaattatcatga

SEQ ID NO: 2072 - DNA, 35 bp, Artificial Sequence
  Synthetic oligonucleotide
tactatcttctagttcaacagccacttatgaccca

SEQ ID NO: 2073 - DNA, 35 bp, Artificial Sequence
  Synthetic oligonucleotide
tacgccccttaacctctaaccagcgagggtagttc

SEQ ID NO: 2074 - DNA, 36 bp, Artificial Sequence
  Synthetic oligonucleotide
tcaacgaccgcgaggttgaacgacgtggggactgta

SEQ ID NO: 2075 - DNA, 38 bp, Artificial Sequence
  Synthetic oligonucleotide
tattatgttcacggccggaggggggccgggggatgcga

SEQ ID NO: 2076 - DNA, 36 bp, Artificial Sequence
  Synthetic oligonucleotide
tcgcatacaacaaaattacgcctaaccataacacca

SEQ ID NO: 2077 - DNA, 38 bp, Artificial Sequence
  Synthetic oligonucleotide
tgaagtactcgtaagttttatagtttttcattctatga

SEQ ID NO: 2078 - DNA, 36 bp, Artificial Sequence
  Synthetic oligonucleotide
tgacaaaagtcccctgaggggtggactcgtgaccca

SEQ ID NO: 2079 - DNA, 35 bp, Artificial Sequence
  Synthetic oligonucleotide
tgcgggtgcatgccgagtgagccgaacgacccatc

SEQ ID NO: 2080 - DNA, 38 bp, Artificial Sequence
  Synthetic oligonucleotide
tggccggggtttggccccagaaagatacgccggggtga

SEQ ID NO: 2081 - DNA, 36 bp, Artificial Sequence
  Synthetic oligonucleotide
tggacctactacgcttgggcaacgcgggggccccta

SEQ ID NO: 2082 - DNA, 38 bp, Artificial Sequence
  Synthetic oligonucleotide
tggacgattttgccaccgttagtacaacccgggggtga

SEQ ID NO: 2083 - DNA, 35 bp, Artificial Sequence
  Synthetic oligonucleotide
tgtagcccaggagaaaccctaccccaacggacgcg

SEQ ID NO: 2084 - DNA, 36 bp, Artificial Sequence
  Synthetic oligonucleotide
tgtggcgagggccgcctccaggcatgaaatgtatca

SEQ ID NO: 2085 - DNA, 38 bp, Artificial Sequence
  Synthetic oligonucleotide
tgtttgcttcatagtaacgttgagactgcataaactga

SEQ ID NO: 2086 - DNA, 35 bp, Artificial Sequence
  Synthetic oligonucleotide
tgttagttccactttccgataatccgcctccctta

SEQ ID NO: 2087 - DNA, 35 bp, Artificial Sequence
  Synthetic oligonucleotide
ttctcgacggccttccaggcgggagacaaagctgc

SEQ ID NO: 2088 - DNA, 38 bp, Artificial Sequence
  Synthetic oligonucleotide
ttcatggacgaaacgggcggcggacatttattcgctga

SEQ ID NO: 2089 - DNA, 38 bp, Artificial Sequence
  Synthetic oligonucleotide
tttgctccggtgtttgaccctcgcagtccggagagtga

SEQ ID NO: 2090 - DNA, 35 bp, Artificial Sequence; identical to SEQ ID NO: 1778
  Synthetic oligonucleotide

SEQ ID NO: 2091 - DNA, 36 bp, Artificial Sequence; identical to SEQ ID NO: 1361
  Synthetic oligonucleotide

SEQ ID NO: 2092 - DNA, 35 bp, Artificial Sequence; identical to SEQ ID NO: 1362
  Synthetic oligonucleotide

SEQ ID NO: 2093 - DNA, 38 bp, Artificial Sequence; identical to SEQ ID NO: 1787
  Synthetic oligonucleotide

SEQ ID NO: 2094 - DNA, 37 bp, Artificial Sequence
  Synthetic oligonucleotide
aacgcgctggtcttcgtgtattgtttcgcgctaagga

SEQ ID NO: 2095 - DNA, 35 bp, Artificial Sequence
  Synthetic oligonucleotide
aactatcattcatcttggtgtgatctacctttgtt

SEQ ID NO: 2096 - DNA, 37 bp, Artificial Sequence; identical to SEQ ID NO: 1776
  Synthetic oligonucleotide

SEQ ID NO: 2097 - DNA, 36 bp, Artificial Sequence
  Synthetic oligonucleotide
cttctatatatctcattcttccggtttattcaatca

SEQ ID NO: 2098 - DNA, 36 bp, Artificial Sequence; identical to SEQ ID NO: 1357
  Synthetic oligonucleotide

SEQ ID NO: 2099 - DNA, 37 bp, Artificial Sequence; identical to SEQ ID NO: 1366
  Synthetic oligonucleotide

SEQ ID NO: 2100 - DNA, 35 bp, Artificial Sequence; identical to SEQ ID NO: 1511
  Synthetic oligonucleotide

SEQ ID NO: 2101 - DNA, 35 bp, Artificial Sequence
  Synthetic oligonucleotide
acgcttcttttacttagctaaccattattcattgt

SEQ ID NO: 2102 - DNA, 37 bp, Artificial Sequence; identical to SEQ ID NO: 1358
  Synthetic oligonucleotide

SEQ ID NO: 2103 - DNA, 38 bp, Artificial Sequence; identical to SEQ ID NO: 1783
  Synthetic oligonucleotide

SEQ ID NO: 2104 - DNA, 35 bp, Artificial Sequence; identical to SEQ ID NO: 1785
  Synthetic oligonucleotide

SEQ ID NO: 2105 - DNA, 38 bp, Artificial Sequence; identical to SEQ ID NO: 1367
  Synthetic oligonucleotide

SEQ ID NO: 2106 - DNA, 35 bp, Artificial Sequence; identical to SEQ ID NO: 1799
  Synthetic oligonucleotide

SEQ ID NO: 2107 - DNA, 35 bp, Artificial Sequence; identical to SEQ ID NO: 1415
  Synthetic oligonucleotide

SEQ ID NO: 2108 - DNA, 36 bp, Artificial Sequence; identical to SEQ ID NO: 1409
  Synthetic oligonucleotide

SEQ ID NO: 2109 - DNA, 36 bp, Artificial Sequence; identical to SEQ ID NO: 1809
  Synthetic oligonucleotide

SEQ ID NO: 2110 - DNA, 35 bp, Artificial Sequence; identical to SEQ ID NO: 1377
  Synthetic oligonucleotide

SEQ ID NO: 2111 - DNA, 35 bp, Artificial Sequence; identical to SEQ ID NO: 1816
  Synthetic oligonucleotide

SEQ ID NO: 2112 - DNA, 38 bp, Artificial Sequence
  Synthetic oligonucleotide
ttctgccggtttttacggtcaaattctagatagtttga

SEQ ID NO: 2113 - DNA, 36 bp, Artificial Sequence; identical to SEQ ID NO: 1540
  Synthetic oligonucleotide

SEQ ID NO: 2114 - DNA, 38 bp, Artificial Sequence; identical to SEQ ID NO: 1372
  Synthetic oligonucleotide

SEQ ID NO: 2115 - DNA, 36 bp, Artificial Sequence; identical to SEQ ID NO: 1375
  Synthetic oligonucleotide

SEQ ID NO: 2116 - DNA, 35 bp, Artificial Sequence; identical to SEQ ID NO: 1376
  Synthetic oligonucleotide

SEQ ID NO: 2117 - DNA, 35 bp, Artificial Sequence; identical to SEQ ID NO: 1813
  Synthetic oligonucleotide

SEQ ID NO: 2118 - DNA, 36 bp, Artificial Sequence; identical to SEQ ID NO: 1814
  Synthetic oligonucleotide

SEQ ID NO: 2119 - DNA, 36 bp, Artificial Sequence; identical to SEQ ID NO: 1818
  Synthetic oligonucleotide

SEQ ID NO: 2120 - DNA, 36 bp, Artificial Sequence; identical to SEQ ID NO: 1382
  Synthetic oligonucleotide

SEQ ID NO: 2121 - DNA, 36 bp, Artificial Sequence; identical to SEQ ID NO: 1521
  Synthetic oligonucleotide

SEQ ID NO: 2122 - DNA, 36 bp, Artificial Sequence; identical to SEQ ID NO: 1369
  Synthetic oligonucleotide

SEQ ID NO: 2123 - DNA, 35 bp, Artificial Sequence; identical to SEQ ID NO: 1370
  Synthetic oligonucleotide

SEQ ID NO: 2124 - DNA, 37 bp, Artificial Sequence; identical to SEQ ID NO: 1420
  Synthetic oligonucleotide

SEQ ID NO: 2125 - DNA, 36 bp, Artificial Sequence; identical to SEQ ID NO: 1374
  Synthetic oligonucleotide

SEQ ID NO: 2126 - DNA, 36 bp, Artificial Sequence; identical to SEQ ID NO: 1819
  Synthetic oligonucleotide

SEQ ID NO: 2127 - DNA, 38 bp, Artificial Sequence; identical to SEQ ID NO: 1380
  Synthetic oligonucleotide

SEQ ID NO: 2128 - DNA, 35 bp, Artificial Sequence
  Synthetic oligonucleotide
aaatcccaacgagcccttaacccagaccaactaca

SEQ ID NO: 2129 - DNA, 37 bp, Artificial Sequence; identical to SEQ ID NO: 1826
  Synthetic oligonucleotide

SEQ ID NO: 2130 - DNA, 37 bp, Artificial Sequence
  Synthetic oligonucleotide
aacgtagtgaggtattccgcaccccctttattcgtga

SEQ ID NO: 2131 - DNA, 36 bp, Artificial Sequence
  Synthetic oligonucleotide
aacccaattcacatacactctcacccacactaaaca

SEQ ID NO: 2132 - DNA, 38 bp, Artificial Sequence
  Synthetic oligonucleotide
aaaaccgctcgcttaagctttctttgactttttgatga

SEQ ID NO: 2133 - DNA, 36 bp, Artificial Sequence
  Synthetic oligonucleotide
aatgcacaaccgcgctgaaaatcacctttatcgaaa

SEQ ID NO: 2134 - DNA, 37 bp, Artificial Sequence
  Synthetic oligonucleotide
aattgatctttttgtttacgaattcgtattccattga

SEQ ID NO: 2135 - DNA, 38 bp, Artificial Sequence
  Synthetic oligonucleotide
aatcaccacaaatactttcgcctatctcgcttatctga

SEQ ID NO: 2136 - DNA, 36 bp, Artificial Sequence
  Synthetic oligonucleotide
aacttgtcttatgctctccaccttacctattaacaa

SEQ ID NO: 2137 - DNA, 37 bp, Artificial Sequence
  Synthetic oligonucleotide
aactcctgatatcgtttcttcgtttccgccaattcta

SEQ ID NO: 2138 - DNA, 35 bp, Artificial Sequence; identical to SEQ ID NO: 1832
  Synthetic oligonucleotide

SEQ ID NO: 2139 - DNA, 38 bp, Artificial Sequence; identical to SEQ ID NO: 1795
  Synthetic oligonucleotide

SEQ ID NO: 2140 - DNA, 36 bp, Artificial Sequence
  Synthetic oligonucleotide
accgggaacatttctgttgtttcatttcatcactaa

SEQ ID NO: 2141 - DNA, 35 bp, Artificial Sequence; identical to SEQ ID NO: 2101
  Synthetic oligonucleotide

SEQ ID NO: 2142 - DNA, 37 bp, Artificial Sequence; identical to SEQ ID NO: 1838
  Synthetic oligonucleotide

SEQ ID NO: 2143 - DNA, 35 bp, Artificial Sequence
  Synthetic oligonucleotide
accgacgcactctcctttctaaaatctatctactt

SEQ ID NO: 2144 - DNA, 35 bp, Artificial Sequence
  Synthetic oligonucleotide
acgttaatttcccaaaaacgatcccactttgaaca

SEQ ID NO: 2145 - DNA, 36 bp, Artificial Sequence
  Synthetic oligonucleotide
actcgcccttcacgactttatcaaaatgtactttca

SEQ ID NO: 2146 - DNA, 38 bp, Artificial Sequence; identical to SEQ ID NO: 1842
  Synthetic oligonucleotide

SEQ ID NO: 2147 - DNA, 35 bp, Artificial Sequence; identical to SEQ ID NO: 1368
  Synthetic oligonucleotide

SEQ ID NO: 2148 - DNA, 36 bp, Artificial Sequence; identical to SEQ ID NO: 1388
  Synthetic oligonucleotide

SEQ ID NO: 2149 - DNA, 36 bp, Artificial Sequence
  Synthetic oligonucleotide
acttcgcccacacaataccattatcgataactcaaa

SEQ ID NO: 2150 - DNA, 35 bp, Artificial Sequence; identical to SEQ ID NO: 1362
  Synthetic oligonucleotide

SEQ ID NO: 2151 - DNA, 36 bp, Artificial Sequence; identical to SEQ ID NO: 1361
  Synthetic oligonucleotide

SEQ ID NO: 2152 - DNA, 38 bp, Artificial Sequence; identical to SEQ ID NO: 1794
  Synthetic oligonucleotide

SEQ ID NO: 2153 - DNA, 36 bp, Artificial Sequence; identical to SEQ ID NO: 1357
  Synthetic oligonucleotide

SEQ ID NO: 2154 - DNA, 35 bp, Artificial Sequence; identical to SEQ ID NO: 1391
  Synthetic oligonucleotide

SEQ ID NO: 2155 - DNA, 35 bp, Artificial Sequence
  Synthetic oligonucleotide
atatgcccgctccctactcaatatcttcccataca

SEQ ID NO: 2156 - DNA, 35 bp, Artificial Sequence; identical to SEQ ID NO: 1365
  Synthetic oligonucleotide

SEQ ID NO: 2157 - DNA, 37 bp, Artificial Sequence
  Synthetic oligonucleotide
atgcattatcccagctttaaacgctctacccaccgaa

SEQ ID NO: 2158 - DNA, 36 bp, Artificial Sequence; identical to SEQ ID NO: 1863
  Synthetic oligonucleotide

SEQ ID NO: 2159 - DNA, 35 bp, Artificial Sequence
  Synthetic oligonucleotide
atctgcttgtaagtccccgtgtatacctgttcagt

SEQ ID NO: 2160 - DNA, 35 bp, Artificial Sequence
  Synthetic oligonucleotide
atcactggagtgatagtctgggccctgaaactcct

SEQ ID NO: 2161 - DNA, 36 bp, Artificial Sequence
  Synthetic oligonucleotide
atcaccgtccttatcatacccacttcgttttttata

SEQ ID NO: 2162 - DNA, 35 bp, Artificial Sequence; identical to SEQ ID NO: 1511
  Synthetic oligonucleotide

SEQ ID NO: 2163 - DNA, 37 bp, Artificial Sequence; identical to SEQ ID NO: 1865
  Synthetic oligonucleotide

SEQ ID NO: 2164 - DNA, 36 bp, Artificial Sequence; identical to SEQ ID NO: 1869
  Synthetic oligonucleotide

SEQ ID NO: 2165 - DNA, 37 bp, Artificial Sequence; identical to SEQ ID NO: 1358
  Synthetic oligonucleotide

SEQ ID NO: 2166 - DNA, 38 bp, Artificial Sequence; identical to SEQ ID NO: 1871
  Synthetic oligonucleotide

SEQ ID NO: 2167 - DNA, 35 bp, Artificial Sequence
  Synthetic oligonucleotide
ccagcacactgacttttccttacccacctcctttc

SEQ ID NO: 2168 - DNA, 38 bp, Artificial Sequence
  Synthetic oligonucleotide
ccccgccatggtttcaaatggctgaagctatctattga

SEQ ID NO: 2169 - DNA, 38 bp, Artificial Sequence
  Synthetic oligonucleotide
ccggtatctgcactcgtttggaatcgaccaacccctga

SEQ ID NO: 2170 - DNA, 37 bp, Artificial Sequence
  Synthetic oligonucleotide
ccgtctactgcaacaggaggccaccacggtcttccga

SEQ ID NO: 2171 - DNA, 37 bp, Artificial Sequence
  Synthetic oligonucleotide
cgctcttcttactttattcaatatggtcataaattga

SEQ ID NO: 2172 - DNA, 37 bp, Artificial Sequence
  Synthetic oligonucleotide
cgtttctttatcccaaagtcattcgcatgccctttga

SEQ ID NO: 2173 - DNA, 38 bp, Artificial Sequence; identical to SEQ ID NO: 1367
  Synthetic oligonucleotide

SEQ ID NO: 2174 - DNA, 35 bp, Artificial Sequence
  Synthetic oligonucleotide
cgcgcctccttccccgatgatatgccactgccgca

SEQ ID NO: 2175 - DNA, 35 bp, Artificial Sequence; identical to SEQ ID NO: 1885
  Synthetic oligonucleotide

SEQ ID NO: 2176 - DNA, 37 bp, Artificial Sequence
  Synthetic oligonucleotide
cgcttcttgggcaggaggcgacacaggttcatattga

SEQ ID NO: 2177 - DNA, 35 bp, Artificial Sequence; identical to SEQ ID NO: 1891
  Synthetic oligonucleotide

SEQ ID NO: 2178 - DNA, 37 bp, Artificial Sequence
  Synthetic oligonucleotide
ctgtcccttgtaaggattattcgtaggtatttagtga

SEQ ID NO: 2179 - DNA, 37 bp, Artificial Sequence
  Synthetic oligonucleotide
ctgcggtcacctgcatagtaattaataatatacgtga

SEQ ID NO: 2180 - DNA, 37 bp, Artificial Sequence
  Synthetic oligonucleotide
cttcgctaaatggctgggggaatcatactgccggaga

SEQ ID NO: 2181 - DNA, 35 bp, Artificial Sequence
  Synthetic oligonucleotide
ctcctgcagatcttggtacctcttgttctttcata

SEQ ID NO: 2182 - DNA, 37 bp, Artificial Sequence; identical to SEQ ID NO: 1366
  Synthetic oligonucleotide

SEQ ID NO: 2183 - DNA, 35 bp, Artificial Sequence
  Synthetic oligonucleotide
gaggacttttacttatcaaccccacctttcgaaca

SEQ ID NO: 2184 - DNA, 35 bp, Artificial Sequence
  Synthetic oligonucleotide
gagtacttgactcttgtatattttttctccccctt

SEQ ID NO: 2185 - DNA, 37 bp, Artificial Sequence
  Synthetic oligonucleotide
gatcccgttccttttttaacgatctattttcttttga

SEQ ID NO: 2186 - DNA, 35 bp, Artificial Sequence; identical to SEQ ID NO: 1911
  Synthetic oligonucleotide

SEQ ID NO: 2187 - DNA, 35 bp, Artificial Sequence; identical to SEQ ID NO: 1785
  Synthetic oligonucleotide

SEQ ID NO: 2188 - DNA, 35 bp, Artificial Sequence; identical to SEQ ID NO: 1371
  Synthetic oligonucleotide

SEQ ID NO: 2189 - DNA, 36 bp, Artificial Sequence; identical to SEQ ID NO: 1914
  Synthetic oligonucleotide

SEQ ID NO: 2190 - DNA, 36 bp, Artificial Sequence; identical to SEQ ID NO: 1918
  Synthetic oligonucleotide

SEQ ID NO: 2191 - DNA, 36 bp, Artificial Sequence; identical to SEQ ID NO: 1922
  Synthetic oligonucleotide

SEQ ID NO: 2192 - DNA, 37 bp, Artificial Sequence
  Synthetic oligonucleotide
gcggaatagtccacgggacgctaagcgtggagctcga

SEQ ID NO: 2193 - DNA, 36 bp, Artificial Sequence
  Synthetic oligonucleotide
gcgtccactctatccttgctttaatacatcgttaaa

SEQ ID NO: 2194 - DNA, 38 bp, Artificial Sequence
  Synthetic oligonucleotide
gcctttccaggttcttcttttcgaccgtttatttttga

SEQ ID NO: 2195 - DNA, 38 bp, Artificial Sequence
  Synthetic oligonucleotide
ggccctggtggcaccaagccgcgagcccactcaactga

SEQ ID NO: 2196 - DNA, 35 bp, Artificial Sequence
  Synthetic oligonucleotide
ggtgcccaactggtgcttctccttctttgagacgt

SEQ ID NO: 2197 - DNA, 38 bp, Artificial Sequence
  Synthetic oligonucleotide
gggagtttttatcctacaatgtaaattatcatacttga

SEQ ID NO: 2198 - DNA, 38 bp, Artificial Sequence; identical to SEQ ID NO: 1372
  Synthetic oligonucleotide

SEQ ID NO: 2199 - DNA, 36 bp, Artificial Sequence
  Synthetic oligonucleotide
ggtcccactctgaccatcaattcacctaacttgtaa

SEQ ID NO: 2200 - DNA, 35 bp, Artificial Sequence; identical to SEQ ID NO: 1377
  Synthetic oligonucleotide

SEQ ID NO: 2201 - DNA, 37 bp, Artificial Sequence; identical to SEQ ID NO: 1937
  Synthetic oligonucleotide

SEQ ID NO: 2202 - DNA, 36 bp, Artificial Sequence; identical to SEQ ID NO: 1369
  Synthetic oligonucleotide

SEQ ID NO: 2203 - DNA, 38 bp, Artificial Sequence; identical to SEQ ID NO: 1543
  Synthetic oligonucleotide

SEQ ID NO: 2204 - DNA, 35 bp, Artificial Sequence
  Synthetic oligonucleotide
gtcgaaagcggagcgactctccgcacaaccccaag

SEQ ID NO: 2205 - DNA, 36 bp, Artificial Sequence; identical to SEQ ID NO: 1373
  Synthetic oligonucleotide

SEQ ID NO: 2206 - DNA, 36 bp, Artificial Sequence; identical to SEQ ID NO: 1374
  Synthetic oligonucleotide

SEQ ID NO: 2207 - DNA, 35 bp, Artificial Sequence
  Synthetic oligonucleotide
gttcagattttgctttgtgacctggtgtggggtct

SEQ ID NO: 2208 - DNA, 37 bp, Artificial Sequence; identical to SEQ ID NO: 1949
  Synthetic oligonucleotide

SEQ ID NO: 2209 - DNA, 36 bp, Artificial Sequence; identical to SEQ ID NO: 1819
  Synthetic oligonucleotide

SEQ ID NO: 2210 - DNA, 35 bp, Artificial Sequence; identical to SEQ ID NO: 1378
  Synthetic oligonucleotide

SEQ ID NO: 2211 - DNA, 36 bp, Artificial Sequence
  Synthetic oligonucleotide
tactctagtcagaggatctcttgcgatcaatatgga

SEQ ID NO: 2212 - DNA, 35 bp, Artificial Sequence
  Synthetic oligonucleotide
tactgtccttttcaattcttgtcttggttttatta

SEQ ID NO: 2213 - DNA, 35 bp, Artificial Sequence
  Synthetic oligonucleotide
tactcggccctactacacgaactcttttcaaatca

SEQ ID NO: 2214 - DNA, 35 bp, Artificial Sequence; identical to SEQ ID NO: 1957
  Synthetic oligonucleotide

SEQ ID NO: 2215 - DNA, 38 bp, Artificial Sequence
  Synthetic oligonucleotide
tattgtagcctgtacggcggctgcacctcgtacgttga

SEQ ID NO: 2216 - DNA, 35 bp, Artificial Sequence
  Synthetic oligonucleotide
tcactttgcccttttgtttcttcattaattccttc

SEQ ID NO: 2217 - DNA, 38 bp, Artificial Sequence
  Synthetic oligonucleotide
tcacgctcccggggttctatctatttcgttattcttga

SEQ ID NO: 2218 - DNA, 36 bp, Artificial Sequence; identical to SEQ ID NO: 1409
  Synthetic oligonucleotide

SEQ ID NO: 2219 - DNA, 36 bp, Artificial Sequence; identical to SEQ ID NO: 1809
  Synthetic oligonucleotide

SEQ ID NO: 2220 - DNA, 38 bp, Artificial Sequence; identical to SEQ ID NO: 1379
  Synthetic oligonucleotide

SEQ ID NO: 2221 - DNA, 35 bp, Artificial Sequence
  Synthetic oligonucleotide
tccatcatattcattattccatgcctacccatccc

SEQ ID NO: 2222 - DNA, 37 bp, Artificial Sequence; identical to SEQ ID NO: 1410
  Synthetic oligonucleotide

SEQ ID NO: 2223 - DNA, 38 bp, Artificial Sequence
  Synthetic oligonucleotide
tccccataatctccgtcctcattgcttccaaaatttga

SEQ ID NO: 2224 - DNA, 38 bp, Artificial Sequence
  Synthetic oligonucleotide
tcccctcgccactgacccatctactcgccaaatcttga

SEQ ID NO: 2225 - DNA, 38 bp, Artificial Sequence
  Synthetic oligonucleotide
tcgggcaataccctttcccatattatcttctttcctta

SEQ ID NO: 2226 - DNA, 36 bp, Artificial Sequence
  Synthetic oligonucleotide
tctcgggattttccgcgactactcgagcgctactca

SEQ ID NO: 2227 - DNA, 36 bp, Artificial Sequence
  Synthetic oligonucleotide
tcgcttccttgtacttcctattcccttttcaccaca

SEQ ID NO: 2228 - DNA, 36 bp, Artificial Sequence; identical to SEQ ID NO: 1375
  Synthetic oligonucleotide

SEQ ID NO: 2229 - DNA, 36 bp, Artificial Sequence
  Synthetic oligonucleotide
tcttcacgatatgcagtgaaaacaccacccaactta

SEQ ID NO: 2230 - DNA, 37 bp, Artificial Sequence
  Synthetic oligonucleotide
tctgcttgatggtgctttcagtttcttacttctacga

SEQ ID NO: 2231 - DNA, 35 bp, Artificial Sequence
  Synthetic oligonucleotide
tcttctgtaaccattttgttccggtttttttattt

SEQ ID NO: 2232 - DNA, 36 bp, Artificial Sequence
  Synthetic oligonucleotide
tgaagctccgaaggggtgcacttgccgacagtagta

SEQ ID NO: 2233 - DNA, 35 bp, Artificial Sequence
  Synthetic oligonucleotide
tgacgtctcctgttcggttaaccctgtgtgcctgt

SEQ ID NO: 2234 - DNA, 37 bp, Artificial Sequence
  Synthetic oligonucleotide
tgcccttcttcgtttactcttatccacattaccttga

SEQ ID NO: 2235 - DNA, 36 bp, Artificial Sequence; identical to SEQ ID NO: 1521
  Synthetic oligonucleotide

SEQ ID NO: 2236 - DNA, 36 bp, Artificial Sequence
  Synthetic oligonucleotide
tgacatatcgctcttacatcccctcacacaatttca

SEQ ID NO: 2237 - DNA, 35 bp, Artificial Sequence
  Synthetic oligonucleotide
tgctccgagtaccataaactaatttgaagctctac

SEQ ID NO: 2238 - DNA, 37 bp, Artificial Sequence; identical to SEQ ID NO: 1980
  Synthetic oligonucleotide

SEQ ID NO: 2239 - DNA, 36 bp, Artificial Sequence
  Synthetic oligonucleotide
tggaccggtcaaaggatggcaccggttcctctcaca

SEQ ID NO: 2240 - DNA, 38 bp, Artificial Sequence; identical to SEQ ID NO: 1380
  Synthetic oligonucleotide

SEQ ID NO: 2241 - DNA, 38 bp, Artificial Sequence
  Synthetic oligonucleotide
tgctttgtacaacgttggtgtttggcatttgctgttga

SEQ ID NO: 2242 - DNA, 38 bp, Artificial Sequence; identical to SEQ ID NO: 1989
  Synthetic oligonucleotide

SEQ ID NO: 2243 - DNA, 35 bp, Artificial Sequence
  Synthetic oligonucleotide
tgtgccactcgtgttcgaatttctgttccttatct

SEQ ID NO: 2244 - DNA, 37 bp, Artificial Sequence
  Synthetic oligonucleotide
tgttacgcccgtcctctatacaccaattacgatatga

SEQ ID NO: 2245 - DNA, 36 bp, Artificial Sequence
  Synthetic oligonucleotide
tgttaggcctttatttccattatcttaattgtttta

SEQ ID NO: 2246 - DNA, 35 bp, Artificial Sequence; identical to SEQ ID NO: 1415
  Synthetic oligonucleotide

SEQ ID NO: 2247 - DNA, 36 bp, Artificial Sequence
  Synthetic oligonucleotide
ttctgccggatacatttgattcaataactacttgta

SEQ ID NO: 2248 - DNA, 35 bp, Artificial Sequence
  Synthetic oligonucleotide
ttctgcttgcgagccgtccagttagggccgccacc

SEQ ID NO: 2249 - DNA, 38 bp, Artificial Sequence; identical to SEQ ID NO: 2112
  Synthetic oligonucleotide

SEQ ID NO: 2250 - DNA, 36 bp, Artificial Sequence
  Synthetic oligonucleotide
ttgcacgccccaatacacctaatctttatccataca

SEQ ID NO: 2251 - DNA, 38 bp, Artificial Sequence
  Synthetic oligonucleotide
ttcgttccggaccacccatttcctcaatcatatattga

SEQ ID NO: 2252 - DNA, 37 bp, Artificial Sequence
  Synthetic oligonucleotide
ttctgcgttttacgatgctcgatgtctgtgacatgga

SEQ ID NO: 2253 - DNA, 36 bp, Artificial Sequence
  Synthetic oligonucleotide
ttgctccgacctagtttactaaatttcaaccattga

SEQ ID NO: 2254 - DNA, 36 bp, Artificial Sequence
  Synthetic oligonucleotide
tttcattataccccatcgactttctctctagttcca

SEQ ID NO: 2255 - DNA, 35 bp, Artificial Sequence
  Synthetic oligonucleotide
ttgtcccaggcagtttccacgagaacgcgtacggt

SEQ ID NO: 2256 - DNA, 38 bp, Artificial Sequence
  Synthetic oligonucleotide
tttggacgtatcactccctaaccatttttttaccctga

SEQ ID NO: 2257 - DNA, 36 bp, Artificial Sequence; identical to SEQ ID NO: 1382
  Synthetic oligonucleotide

SEQ ID NO: 2258 - DNA, 35 bp, Artificial Sequence
  Synthetic oligonucleotide
tttcctgtttcttctttgtgtgtccatataatcga

SEQ ID NO: 2259 - DNA, 35 bp, Artificial Sequence; identical to SEQ ID NO: 1376
  Synthetic oligonucleotide

SEQ ID NO: 2260 - DNA, 36 bp, Artificial Sequence
  Synthetic oligonucleotide
tttaaacgtacgatattacttccgatccatacatta

SEQ ID NO: 2261 - DNA, 37 bp, Artificial Sequence; identical to SEQ ID NO: 1420
  Synthetic oligonucleotide

SEQ ID NO: 2262 - DNA, 35 bp, Artificial Sequence; identical to SEQ ID NO: 1370
  Synthetic oligonucleotide

SEQ ID NO: 2263 - DNA, 36 bp, Artificial Sequence; identical to SEQ ID NO: 1422
  Synthetic oligonucleotide

SEQ ID NO: 2264 - DNA, 36 bp, Artificial Sequence; identical to SEQ ID NO: 1423
  Synthetic oligonucleotide

SEQ ID NO: 2265 - DNA, 37 bp, Artificial Sequence; identical to SEQ ID NO: 2008
  Synthetic oligonucleotide

SEQ ID NO: 2266 - DNA, 38 bp, Artificial Sequence; identical to SEQ ID NO: 1424
  Synthetic oligonucleotide

SEQ ID NO: 2267 - DNA, 37 bp, Artificial Sequence
  Synthetic oligonucleotide
acaactatcaaataaacctgcgccctctatgaatgga

SEQ ID NO: 2268 - DNA, 36 bp, Artificial Sequence
  Synthetic oligonucleotide
gaccaatagacccggccaagactggagatgaaagta

SEQ ID NO: 2269 - DNA, 38 bp, Artificial Sequence; identical to SEQ ID NO: 1563
  Synthetic oligonucleotide

SEQ ID NO: 2270 - DNA, 36 bp, Artificial Sequence; identical to SEQ ID NO: 1432
  Synthetic oligonucleotide

SEQ ID NO: 2271 - DNA, 35 bp, Artificial Sequence
  Synthetic oligonucleotide
acggtatttgttttttcgattgatggggaagtaga

SEQ ID NO: 2272 - DNA, 38 bp, Artificial Sequence
  Synthetic oligonucleotide
ccacccgtacgaagccgcgttttctgagtgcctattga

SEQ ID NO: 2273 - DNA, 38 bp, Artificial Sequence; identical to SEQ ID NO: 1502
  Synthetic oligonucleotide

SEQ ID NO: 2274 - DNA, 35 bp, Artificial Sequence
  Synthetic oligonucleotide
ggccaatttgaatgagggttgtgaattatttaaga

SEQ ID NO: 2275 - DNA, 37 bp, Artificial Sequence
  Synthetic oligonucleotide
ggcctaaccatggggggtggtgattattatgaaggga

SEQ ID NO: 2276 - DNA, 36 bp, Artificial Sequence
  Synthetic oligonucleotide
ttcatcgcggggccgaggtaagcctaatcttccgta

SEQ ID NO: 2277 - DNA, 37 bp, Artificial Sequence
  Synthetic oligonucleotide
gtaactggtatcctaaaagaataggttcgtaccccga

SEQ ID NO: 2278 - DNA, 36 bp, Artificial Sequence; identical to SEQ ID NO: 2013
  Synthetic oligonucleotide

SEQ ID NO: 2279 - DNA, 36 bp, Artificial Sequence; identical to SEQ ID NO: 2014
  Synthetic oligonucleotide

SEQ ID NO: 2280 - DNA, 35 bp, Artificial Sequence; identical to SEQ ID NO: 2015
  Synthetic oligonucleotide

SEQ ID NO: 2281 - DNA, 35 bp, Artificial Sequence; identical to SEQ ID NO: 2016
  Synthetic oligonucleotide

SEQ ID NO: 2282 - DNA, 38 bp, Artificial Sequence; identical to SEQ ID NO: 2017
  Synthetic oligonucleotide

SEQ ID NO: 2283 - DNA, 35 bp, Artificial Sequence; identical to SEQ ID NO: 2018
  Synthetic oligonucleotide

SEQ ID NO: 2284 - DNA, 38 bp, Artificial Sequence; identical to SEQ ID NO: 2019
  Synthetic oligonucleotide

SEQ ID NO: 2285 - DNA, 37 bp, Artificial Sequence; identical to SEQ ID NO: 2020
  Synthetic oligonucleotide

SEQ ID NO: 2286 - DNA, 35 bp, Artificial Sequence; identical to SEQ ID NO: 2021
  Synthetic oligonucleotide

SEQ ID NO: 2287 - DNA, 37 bp, Artificial Sequence; identical to SEQ ID NO: 2022
  Synthetic oligonucleotide

SEQ ID NO: 2288 - DNA, 35 bp, Artificial Sequence; identical to SEQ ID NO: 2023
  Synthetic oligonucleotide

SEQ ID NO: 2289 - DNA, 36 bp, Artificial Sequence; identical to SEQ ID NO: 2024
  Synthetic oligonucleotide

SEQ ID NO: 2290 - DNA, 36 bp, Artificial Sequence; identical to SEQ ID NO: 2025
  Synthetic oligonucleotide

SEQ ID NO: 2291 - DNA, 35 bp, Artificial Sequence; identical to SEQ ID NO: 2026
  Synthetic oligonucleotide

SEQ ID NO: 2292 - DNA, 36 bp, Artificial Sequence; identical to SEQ ID NO: 2027
  Synthetic oligonucleotide

SEQ ID NO: 2293 - DNA, 35 bp, Artificial Sequence; identical to SEQ ID NO: 2028
  Synthetic oligonucleotide

SEQ ID NO: 2294 - DNA, 37 bp, Artificial Sequence; identical to SEQ ID NO: 2029
  Synthetic oligonucleotide

SEQ ID NO: 2295 - DNA, 36 bp, Artificial Sequence; identical to SEQ ID NO: 2030
  Synthetic oligonucleotide

SEQ ID NO: 2296 - DNA, 38 bp, Artificial Sequence; identical to SEQ ID NO: 2031
  Synthetic oligonucleotide

SEQ ID NO: 2297 - DNA, 35 bp, Artificial Sequence; identical to SEQ ID NO: 2032
  Synthetic oligonucleotide

SEQ ID NO: 2298 - DNA, 35 bp, Artificial Sequence; identical to SEQ ID NO: 2033
  Synthetic oligonucleotide

SEQ ID NO: 2299 - DNA, 36 bp, Artificial Sequence; identical to SEQ ID NO: 2034
  Synthetic oligonucleotide

SEQ ID NO: 2300 - DNA, 37 bp, Artificial Sequence; identical to SEQ ID NO: 2035
  Synthetic oligonucleotide

SEQ ID NO: 2301 - DNA, 35 bp, Artificial Sequence; identical to SEQ ID NO: 2036
  Synthetic oligonucleotide

SEQ ID NO: 2302 - DNA, 37 bp, Artificial Sequence; identical to SEQ ID NO: 2037
  Synthetic oligonucleotide

SEQ ID NO: 2303 - DNA, 35 bp, Artificial Sequence; identical to SEQ ID NO: 1663
  Synthetic oligonucleotide

SEQ ID NO: 2304 - DNA, 35 bp, Artificial Sequence; identical to SEQ ID NO: 2039
  Synthetic oligonucleotide

SEQ ID NO: 2305 - DNA, 35 bp, Artificial Sequence; identical to SEQ ID NO: 2040
  Synthetic oligonucleotide

SEQ ID NO: 2306 - DNA, 35 bp, Artificial Sequence; identical to SEQ ID NO: 2041
  Synthetic oligonucleotide

SEQ ID NO: 2307 - DNA, 36 bp, Artificial Sequence; identical to SEQ ID NO: 2042
  Synthetic oligonucleotide

SEQ ID NO: 2308 - DNA, 38 bp, Artificial Sequence; identical to SEQ ID NO: 2043
  Synthetic oligonucleotide

SEQ ID NO: 2309 - DNA, 36 bp, Artificial Sequence; identical to SEQ ID NO: 1422
  Synthetic oligonucleotide

SEQ ID NO: 2310 - DNA, 37 bp, Artificial Sequence; identical to SEQ ID NO: 2045
  Synthetic oligonucleotide

SEQ ID NO: 2311 - DNA, 37 bp, Artificial Sequence; identical to SEQ ID NO: 2046
  Synthetic oligonucleotide

SEQ ID NO: 2312 - DNA, 38 bp, Artificial Sequence; identical to SEQ ID NO: 2047
  Synthetic oligonucleotide

SEQ ID NO: 2313 - DNA, 35 bp, Artificial Sequence; identical to SEQ ID NO: 2048
  Synthetic oligonucleotide

SEQ ID NO: 2314 - DNA, 37 bp, Artificial Sequence; identical to SEQ ID NO: 2049
  Synthetic oligonucleotide

SEQ ID NO: 2315 - DNA, 35 bp, Artificial Sequence; identical to SEQ ID NO: 2050
  Synthetic oligonucleotide

SEQ ID NO: 2316 - DNA, 35 bp, Artificial Sequence; identical to SEQ ID NO: 1689
  Synthetic oligonucleotide

SEQ ID NO: 2317 - DNA, 37 bp, Artificial Sequence; identical to SEQ ID NO: 2052
  Synthetic oligonucleotide

SEQ ID NO: 2318 - DNA, 36 bp, Artificial Sequence; identical to SEQ ID NO: 2053
  Synthetic oligonucleotide

SEQ ID NO: 2319 - DNA, 35 bp, Artificial Sequence; identical to SEQ ID NO: 2054
  Synthetic oligonucleotide

SEQ ID NO: 2320 - DNA, 36 bp, Artificial Sequence; identical to SEQ ID NO: 2055
  Synthetic oligonucleotide

SEQ ID NO: 2321 - DNA, 38 bp, Artificial Sequence; identical to SEQ ID NO: 2056
  Synthetic oligonucleotide

SEQ ID NO: 2322 - DNA, 37 bp, Artificial Sequence; identical to SEQ ID NO: 2057
  Synthetic oligonucleotide

SEQ ID NO: 2323 - DNA, 37 bp, Artificial Sequence; identical to SEQ ID NO: 2058
  Synthetic oligonucleotide

SEQ ID NO: 2324 - DNA, 35 bp, Artificial Sequence; identical to SEQ ID NO: 2059
  Synthetic oligonucleotide

SEQ ID NO: 2325 - DNA, 37 bp, Artificial Sequence; identical to SEQ ID NO: 2060
  Synthetic oligonucleotide

SEQ ID NO: 2326 - DNA, 37 bp, Artificial Sequence; identical to SEQ ID NO: 1710
  Synthetic oligonucleotide

SEQ ID NO: 2327 - DNA, 37 bp, Artificial Sequence; identical to SEQ ID NO: 2062
  Synthetic oligonucleotide

SEQ ID NO: 2328 - DNA, 37 bp, Artificial Sequence; identical to SEQ ID NO: 2063
  Synthetic oligonucleotide

SEQ ID NO: 2329 - DNA, 37 bp, Artificial Sequence; identical to SEQ ID NO: 2064
  Synthetic oligonucleotide

SEQ ID NO: 2330 - DNA, 35 bp, Artificial Sequence; identical to SEQ ID NO: 2065
  Synthetic oligonucleotide

SEQ ID NO: 2331 - DNA, 38 bp, Artificial Sequence; identical to SEQ ID NO: 2066
  Synthetic oligonucleotide

SEQ ID NO: 2332 - DNA, 36 bp, Artificial Sequence; identical to SEQ ID NO: 2067
  Synthetic oligonucleotide

SEQ ID NO: 2333 - DNA, 36 bp, Artificial Sequence; identical to SEQ ID NO: 1490
  Synthetic oligonucleotide

SEQ ID NO: 2334 - DNA, 36 bp, Artificial Sequence; identical to SEQ ID NO: 2069
  Synthetic oligonucleotide

SEQ ID NO: 2335 - DNA, 37 bp, Artificial Sequence; identical to SEQ ID NO: 2070
  Synthetic oligonucleotide

SEQ ID NO: 2336 - DNA, 38 bp, Artificial Sequence; identical to SEQ ID NO: 2071
  Synthetic oligonucleotide

SEQ ID NO: 2337 - DNA, 35 bp, Artificial Sequence; identical to SEQ ID NO: 2072
  Synthetic oligonucleotide

SEQ ID NO: 2338 - DNA, 35 bp, Artificial Sequence; identical to SEQ ID NO: 2073
  Synthetic oligonucleotide

SEQ ID NO: 2339 - DNA, 36 bp, Artificial Sequence; identical to SEQ ID NO: 2074
  Synthetic oligonucleotide

SEQ ID NO: 2340 - DNA, 38 bp, Artificial Sequence; identical to SEQ ID NO: 2075
  Synthetic oligonucleotide

SEQ ID NO: 2341 - DNA, 36 bp, Artificial Sequence; identical to SEQ ID NO: 2076
  Synthetic oligonucleotide

SEQ ID NO: 2342 - DNA, 38 bp, Artificial Sequence; identical to SEQ ID NO: 2077
  Synthetic oligonucleotide

SEQ ID NO: 2343 - DNA, 36 bp, Artificial Sequence; identical to SEQ ID NO: 2078
  Synthetic oligonucleotide

SEQ ID NO: 2344 - DNA, 35 bp, Artificial Sequence; identical to SEQ ID NO: 2079
  Synthetic oligonucleotide

SEQ ID NO: 2345 - DNA, 38 bp, Artificial Sequence; identical to SEQ ID NO: 2080
  Synthetic oligonucleotide

SEQ ID NO: 2346 - DNA, 36 bp, Artificial Sequence; identical to SEQ ID NO: 2081
  Synthetic oligonucleotide

SEQ ID NO: 2347 - DNA, 38 bp, Artificial Sequence; identical to SEQ ID NO: 2082
  Synthetic oligonucleotide

SEQ ID NO: 2348 - DNA, 35 bp, Artificial Sequence; identical to SEQ ID NO: 2083
  Synthetic oligonucleotide

SEQ ID NO: 2349 - DNA, 36 bp, Artificial Sequence; identical to SEQ ID NO: 2084
  Synthetic oligonucleotide

SEQ ID NO: 2350 - DNA, 38 bp, Artificial Sequence; identical to SEQ ID NO: 2085
  Synthetic oligonucleotide

SEQ ID NO: 2351 - DNA, 35 bp, Artificial Sequence; identical to SEQ ID NO: 2086
  Synthetic oligonucleotide

SEQ ID NO: 2352 - DNA, 35 bp, Artificial Sequence; identical to SEQ ID NO: 2087
  Synthetic oligonucleotide

SEQ ID NO: 2353 - DNA, 38 bp, Artificial Sequence; identical to SEQ ID NO: 2088
  Synthetic oligonucleotide

SEQ ID NO: 2354 - DNA, 38 bp, Artificial Sequence; identical to SEQ ID NO: 2089
  Synthetic oligonucleotide

SEQ ID NO: 2355 - DNA, 38 bp, Artificial Sequence
  Synthetic oligonucleotide
atctatcgcctatcgctacaacccgtattcgcttctta

SEQ ID NO: 2356 - DNA, 38 bp, Artificial Sequence; identical to SEQ ID NO: 1314
  Synthetic oligonucleotide

SEQ ID NO: 2357 - DNA, 38 bp, Artificial Sequence; identical to SEQ ID NO: 1587
  Synthetic oligonucleotide

SEQ ID NO: 2358 - DNA, 38 bp, Artificial Sequence
  Synthetic oligonucleotide
attctctttattttatcgctttcatccagtgcatatga

SEQ ID NO: 2359 - DNA, 38 bp, Artificial Sequence; identical to SEQ ID NO: 1588
  Synthetic oligonucleotide

SEQ ID NO: 2360 - DNA, 35 bp, Artificial Sequence
  Synthetic oligonucleotide
ggcttcttatttgcttgaatatccgcttcctctct

SEQ ID NO: 2361 - DNA, 35 bp, Artificial Sequence; identical to SEQ ID NO: 1321
  Synthetic oligonucleotide

SEQ ID NO: 2362 - DNA, 35 bp, Artificial Sequence; identical to SEQ ID NO: 1322
  Synthetic oligonucleotide

SEQ ID NO: 2363 - DNA, 38 bp, Artificial Sequence; identical to SEQ ID NO: 1575
  Synthetic oligonucleotide

SEQ ID NO: 2364 - DNA, 37 bp, Artificial Sequence; identical to SEQ ID NO: 1591
  Synthetic oligonucleotide

SEQ ID NO: 2365 - DNA, 35 bp, Artificial Sequence; identical to SEQ ID NO: 2128
  Synthetic oligonucleotide

SEQ ID NO: 2366 - DNA, 37 bp, Artificial Sequence; identical to SEQ ID NO: 1826
  Synthetic oligonucleotide

SEQ ID NO: 2367 - DNA, 37 bp, Artificial Sequence; identical to SEQ ID NO: 2130
  Synthetic oligonucleotide

SEQ ID NO: 2368 - DNA, 36 bp, Artificial Sequence; identical to SEQ ID NO: 2131
  Synthetic oligonucleotide

SEQ ID NO: 2369 - DNA, 38 bp, Artificial Sequence; identical to SEQ ID NO: 2132
  Synthetic oligonucleotide

SEQ ID NO: 2370 - DNA, 36 bp, Artificial Sequence; identical to SEQ ID NO: 2133
  Synthetic oligonucleotide

SEQ ID NO: 2371 - DNA, 37 bp, Artificial Sequence; identical to SEQ ID NO: 2134
  Synthetic oligonucleotide

SEQ ID NO: 2372 - DNA, 38 bp, Artificial Sequence; identical to SEQ ID NO: 2135
  Synthetic oligonucleotide

SEQ ID NO: 2373 - DNA, 36 bp, Artificial Sequence; identical to SEQ ID NO: 2136
  Synthetic oligonucleotide

SEQ ID NO: 2374 - DNA, 37 bp, Artificial Sequence; identical to SEQ ID NO: 2137
  Synthetic oligonucleotide

SEQ ID NO: 2375 - DNA, 35 bp, Artificial Sequence; identical to SEQ ID NO: 1832
  Synthetic oligonucleotide

SEQ ID NO: 2376 - DNA, 38 bp, Artificial Sequence; identical to SEQ ID NO: 1795
  Synthetic oligonucleotide

SEQ ID NO: 2377 - DNA, 36 bp, Artificial Sequence; identical to SEQ ID NO: 2140
  Synthetic oligonucleotide

SEQ ID NO: 2378 - DNA, 35 bp, Artificial Sequence; identical to SEQ ID NO: 2101
  Synthetic oligonucleotide

SEQ ID NO: 2379 - DNA, 37 bp, Artificial Sequence; identical to SEQ ID NO: 1838
  Synthetic oligonucleotide

SEQ ID NO: 2380 - DNA, 35 bp, Artificial Sequence; identical to SEQ ID NO: 2143
  Synthetic oligonucleotide

SEQ ID NO: 2381 - DNA, 35 bp, Artificial Sequence; identical to SEQ ID NO: 2144
  Synthetic oligonucleotide

SEQ ID NO: 2382 - DNA, 36 bp, Artificial Sequence; identical to SEQ ID NO: 2145
  Synthetic oligonucleotide

SEQ ID NO: 2383 - DNA, 38 bp, Artificial Sequence; identical to SEQ ID NO: 1842
  Synthetic oligonucleotide

SEQ ID NO: 2384 - DNA, 35 bp, Artificial Sequence; identical to SEQ ID NO: 1368
  Synthetic oligonucleotide

SEQ ID NO: 2385 - DNA, 36 bp, Artificial Sequence; identical to SEQ ID NO: 1388
  Synthetic oligonucleotide

SEQ ID NO: 2386 - DNA, 36 bp, Artificial Sequence; identical to SEQ ID NO: 2149
  Synthetic oligonucleotide

SEQ ID NO: 2387 - DNA, 35 bp, Artificial Sequence; identical to SEQ ID NO: 1362
  Synthetic oligonucleotide

SEQ ID NO: 2388 - DNA, 36 bp, Artificial Sequence; identical to SEQ ID NO: 1361
  Synthetic oligonucleotide

SEQ ID NO: 2389 - DNA, 38 bp, Artificial Sequence; identical to SEQ ID NO: 1794
  Synthetic oligonucleotide

SEQ ID NO: 2390 - DNA, 36 bp, Artificial Sequence; identical to SEQ ID NO: 1357
  Synthetic oligonucleotide

SEQ ID NO: 2391 - DNA, 35 bp, Artificial Sequence; identical to SEQ ID NO: 1391
  Synthetic oligonucleotide

SEQ ID NO: 2392 - DNA, 35 bp, Artificial Sequence; identical to SEQ ID NO: 2155
  Synthetic oligonucleotide

SEQ ID NO: 2393 - DNA, 35 bp, Artificial Sequence; identical to SEQ ID NO: 1365
  Synthetic oligonucleotide

SEQ ID NO: 2394 - DNA, 37 bp, Artificial Sequence; identical to SEQ ID NO: 2157
  Synthetic oligonucleotide

SEQ ID NO: 2395 - DNA, 36 bp, Artificial Sequence; identical to SEQ ID NO: 1863
  Synthetic oligonucleotide

SEQ ID NO: 2396 - DNA, 35 bp, Artificial Sequence; identical to SEQ ID NO: 2159
  Synthetic oligonucleotide

SEQ ID NO: 2397 - DNA, 35 bp, Artificial Sequence; identical to SEQ ID NO: 2160
  Synthetic oligonucleotide

SEQ ID NO: 2398 - DNA, 36 bp, Artificial Sequence; identical to SEQ ID NO: 2161
  Synthetic oligonucleotide

SEQ ID NO: 2399 - DNA, 35 bp, Artificial Sequence; identical to SEQ ID NO: 1511
  Synthetic oligonucleotide

SEQ ID NO: 2400 - DNA, 37 bp, Artificial Sequence; identical to SEQ ID NO: 1865
  Synthetic oligonucleotide

SEQ ID NO: 2401 - DNA, 36 bp, Artificial Sequence; identical to SEQ ID NO: 1869
  Synthetic oligonucleotide

SEQ ID NO: 2402 - DNA, 37 bp, Artificial Sequence; identical to SEQ ID NO: 1358
  Synthetic oligonucleotide

SEQ ID NO: 2403 - DNA, 38 bp, Artificial Sequence; identical to SEQ ID NO: 1871
  Synthetic oligonucleotide

SEQ ID NO: 2404 - DNA, 35 bp, Artificial Sequence; identical to SEQ ID NO: 2167
  Synthetic oligonucleotide

SEQ ID NO: 2405 - DNA, 38 bp, Artificial Sequence; identical to SEQ ID NO: 2168
  Synthetic oligonucleotide

SEQ ID NO: 2406 - DNA, 38 bp, Artificial Sequence; identical to SEQ ID NO: 2169
  Synthetic oligonucleotide

SEQ ID NO: 2407 - DNA, 37 bp, Artificial Sequence; identical to SEQ ID NO: 2170
  Synthetic oligonucleotide

SEQ ID NO: 2408 - DNA, 37 bp, Artificial Sequence; identical to SEQ ID NO: 2171
  Synthetic oligonucleotide

SEQ ID NO: 2409 - DNA, 37 bp, Artificial Sequence; identical to SEQ ID NO: 2172
  Synthetic oligonucleotide

SEQ ID NO: 2410 - DNA, 38 bp, Artificial Sequence; identical to SEQ ID NO: 1367
  Synthetic oligonucleotide

SEQ ID NO: 2411 - DNA, 35 bp, Artificial Sequence; identical to SEQ ID NO: 2174
  Synthetic oligonucleotide

SEQ ID NO: 2412 - DNA, 35 bp, Artificial Sequence; identical to SEQ ID NO: 1885
  Synthetic oligonucleotide

SEQ ID NO: 2413 - DNA, 37 bp, Artificial Sequence; identical to SEQ ID NO: 2176
  Synthetic oligonucleotide

SEQ ID NO: 2414 - DNA, 35 bp, Artificial Sequence; identical to SEQ ID NO: 1891
  Synthetic oligonucleotide

SEQ ID NO: 2415 - DNA, 37 bp, Artificial Sequence; identical to SEQ ID NO: 2178
  Synthetic oligonucleotide

SEQ ID NO: 2416 - DNA, 37 bp, Artificial Sequence; identical to SEQ ID NO: 2179
  Synthetic oligonucleotide

SEQ ID NO: 2417 - DNA, 37 bp, Artificial Sequence; identical to SEQ ID NO: 2180
  Synthetic oligonucleotide

SEQ ID NO: 2418 - DNA, 35 bp, Artificial Sequence; identical to SEQ ID NO: 2181
  Synthetic oligonucleotide

SEQ ID NO: 2419 - DNA, 37 bp, Artificial Sequence; identical to SEQ ID NO: 1366
  Synthetic oligonucleotide

SEQ ID NO: 2420 - DNA, 35 bp, Artificial Sequence; identical to SEQ ID NO: 2183
  Synthetic oligonucleotide

SEQ ID NO: 2421 - DNA, 35 bp, Artificial Sequence; identical to SEQ ID NO: 2184
  Synthetic oligonucleotide

SEQ ID NO: 2422 - DNA, 37 bp, Artificial Sequence; identical to SEQ ID NO: 2185
  Synthetic oligonucleotide

SEQ ID NO: 2423 - DNA, 35 bp, Artificial Sequence; identical to SEQ ID NO: 1911
  Synthetic oligonucleotide

SEQ ID NO: 2424 - DNA, 35 bp, Artificial Sequence; identical to SEQ ID NO: 1785
  Synthetic oligonucleotide

SEQ ID NO: 2425 - DNA, 35 bp, Artificial Sequence; identical to SEQ ID NO: 1371
  Synthetic oligonucleotide

SEQ ID NO: 2426 - DNA, 36 bp, Artificial Sequence; identical to SEQ ID NO: 1914
  Synthetic oligonucleotide

SEQ ID NO: 2427 - DNA, 36 bp, Artificial Sequence; identical to SEQ ID NO: 1918
  Synthetic oligonucleotide

SEQ ID NO: 2428 - DNA, 36 bp, Artificial Sequence; identical to SEQ ID NO: 1922
  Synthetic oligonucleotide

SEQ ID NO: 2429 - DNA, 37 bp, Artificial Sequence; identical to SEQ ID NO: 2192
  Synthetic oligonucleotide

SEQ ID NO: 2430 - DNA, 36 bp, Artificial Sequence; identical to SEQ ID NO: 2193
  Synthetic oligonucleotide

SEQ ID NO: 2431 - DNA, 38 bp, Artificial Sequence; identical to SEQ ID NO: 2194
  Synthetic oligonucleotide

SEQ ID NO: 2432 - DNA, 38 bp, Artificial Sequence; identical to SEQ ID NO: 2195
  Synthetic oligonucleotide

SEQ ID NO: 2433 - DNA, 35 bp, Artificial Sequence; identical to SEQ ID NO: 2196
  Synthetic oligonucleotide

SEQ ID NO: 2434 - DNA, 38 bp, Artificial Sequence; identical to SEQ ID NO: 2197
  Synthetic oligonucleotide

SEQ ID NO: 2435 - DNA, 38 bp, Artificial Sequence; identical to SEQ ID NO: 1372
  Synthetic oligonucleotide

SEQ ID NO: 2436 - DNA, 36 bp, Artificial Sequence; identical to SEQ ID NO: 2199
  Synthetic oligonucleotide

SEQ ID NO: 2437 - DNA, 35 bp, Artificial Sequence; identical to SEQ ID NO: 1377
  Synthetic oligonucleotide

SEQ ID NO: 2438 - DNA, 37 bp, Artificial Sequence; identical to SEQ ID NO: 1937
  Synthetic oligonucleotide

SEQ ID NO: 2439 - DNA, 36 bp, Artificial Sequence; identical to SEQ ID NO: 1369
  Synthetic oligonucleotide

SEQ ID NO: 2440 - DNA, 38 bp, Artificial Sequence; identical to SEQ ID NO: 1543
  Synthetic oligonucleotide

SEQ ID NO: 2441 - DNA, 35 bp, Artificial Sequence; identical to SEQ ID NO: 2204
  Synthetic oligonucleotide

SEQ ID NO: 2442 - DNA, 36 bp, Artificial Sequence; identical to SEQ ID NO: 1373
  Synthetic oligonucleotide

SEQ ID NO: 2443 - DNA, 36 bp, Artificial Sequence; identical to SEQ ID NO: 1374
  Synthetic oligonucleotide

SEQ ID NO: 2444 - DNA, 35 bp, Artificial Sequence; identical to SEQ ID NO: 2207
  Synthetic oligonucleotide

SEQ ID NO: 2445 - DNA, 37 bp, Artificial Sequence; identical to SEQ ID NO: 1949
  Synthetic oligonucleotide

SEQ ID NO: 2446 - DNA, 36 bp, Artificial Sequence; identical to SEQ ID NO: 1819
  Synthetic oligonucleotide

SEQ ID NO: 2447 - DNA, 35 bp, Artificial Sequence; identical to SEQ ID NO: 1378
  Synthetic oligonucleotide

SEQ ID NO: 2448 - DNA, 36 bp, Artificial Sequence; identical to SEQ ID NO: 2211
  Synthetic oligonucleotide

SEQ ID NO: 2449 - DNA, 35 bp, Artificial Sequence; identical to SEQ ID NO: 2212
  Synthetic oligonucleotide

SEQ ID NO: 2450 - DNA, 35 bp, Artificial Sequence; identical to SEQ ID NO: 2213
  Synthetic oligonucleotide

SEQ ID NO: 2451 - DNA, 35 bp, Artificial Sequence; identical to SEQ ID NO: 1957
  Synthetic oligonucleotide

SEQ ID NO: 2452 - DNA, 38 bp, Artificial Sequence; identical to SEQ ID NO: 2215
  Synthetic oligonucleotide

SEQ ID NO: 2453 - DNA, 35 bp, Artificial Sequence; identical to SEQ ID NO: 2216
  Synthetic oligonucleotide

SEQ ID NO: 2454 - DNA, 38 bp, Artificial Sequence; identical to SEQ ID NO: 2217
  Synthetic oligonucleotide

SEQ ID NO: 2455 - DNA, 36 bp, Artificial Sequence; identical to SEQ ID NO: 1409
  Synthetic oligonucleotide

SEQ ID NO: 2456 - DNA, 36 bp, Artificial Sequence; identical to SEQ ID NO: 1809
  Synthetic oligonucleotide

SEQ ID NO: 2457 - DNA, 38 bp, Artificial Sequence; identical to SEQ ID NO: 1379
  Synthetic oligonucleotide

SEQ ID NO: 2458 - DNA, 35 bp, Artificial Sequence; identical to SEQ ID NO: 2221
  Synthetic oligonucleotide

SEQ ID NO: 2459 - DNA, 37 bp, Artificial Sequence; identical to SEQ ID NO: 1410
  Synthetic oligonucleotide

SEQ ID NO: 2460 - DNA, 38 bp, Artificial Sequence; identical to SEQ ID NO: 2223
  Synthetic oligonucleotide

SEQ ID NO: 2461 - DNA, 38 bp, Artificial Sequence; identical to SEQ ID NO: 2224
  Synthetic oligonucleotide

SEQ ID NO: 2462 - DNA, 38 bp, Artificial Sequence; identical to SEQ ID NO: 2225
  Synthetic oligonucleotide

SEQ ID NO: 2463 - DNA, 36 bp, Artificial Sequence; identical to SEQ ID NO: 2226
  Synthetic oligonucleotide

SEQ ID NO: 2464 - DNA, 36 bp, Artificial Sequence; identical to SEQ ID NO: 2227
  Synthetic oligonucleotide

SEQ ID NO: 2465 - DNA, 36 bp, Artificial Sequence; identical to SEQ ID NO: 1375
  Synthetic oligonucleotide

SEQ ID NO: 2466 - DNA, 36 bp, Artificial Sequence; identical to SEQ ID NO: 2229
  Synthetic oligonucleotide

SEQ ID NO: 2467 - DNA, 37 bp, Artificial Sequence; identical to SEQ ID NO: 2230
  Synthetic oligonucleotide

SEQ ID NO: 2468 - DNA, 35 bp, Artificial Sequence; identical to SEQ ID NO: 2231
  Synthetic oligonucleotide

SEQ ID NO: 2469 - DNA, 36 bp, Artificial Sequence; identical to SEQ ID NO: 2232
  Synthetic oligonucleotide

SEQ ID NO: 2470 - DNA, 35 bp, Artificial Sequence; identical to SEQ ID NO: 2233
  Synthetic oligonucleotide

SEQ ID NO: 2471 - DNA, 37 bp, Artificial Sequence; identical to SEQ ID NO: 2234
  Synthetic oligonucleotide

SEQ ID NO: 2472 - DNA, 36 bp, Artificial Sequence; identical to SEQ ID NO: 1521
  Synthetic oligonucleotide

SEQ ID NO: 2473 - DNA, 36 bp, Artificial Sequence; identical to SEQ ID NO: 2236
  Synthetic oligonucleotide

SEQ ID NO: 2474 - DNA, 35 bp, Artificial Sequence; identical to SEQ ID NO: 2237
  Synthetic oligonucleotide

SEQ ID NO: 2475 - DNA, 37 bp, Artificial Sequence; identical to SEQ ID NO: 1980
  Synthetic oligonucleotide

SEQ ID NO: 2476 - DNA, 36 bp, Artificial Sequence; identical to SEQ ID NO: 2239
  Synthetic oligonucleotide

SEQ ID NO: 2477 - DNA, 38 bp, Artificial Sequence; identical to SEQ ID NO: 1380
  Synthetic oligonucleotide

SEQ ID NO: 2478 - DNA, 38 bp, Artificial Sequence; identical to SEQ ID NO: 2241
  Synthetic oligonucleotide

SEQ ID NO: 2479 - DNA, 38 bp, Artificial Sequence; identical to SEQ ID NO: 1989
  Synthetic oligonucleotide

SEQ ID NO: 2480 - DNA, 35 bp, Artificial Sequence; identical to SEQ ID NO: 2243
  Synthetic oligonucleotide

SEQ ID NO: 2481 - DNA, 37 bp, Artificial Sequence; identical to SEQ ID NO: 2244
  Synthetic oligonucleotide

SEQ ID NO: 2482 - DNA, 36 bp, Artificial Sequence; identical to SEQ ID NO: 2245
  Synthetic oligonucleotide

SEQ ID NO: 2483 - DNA, 35 bp, Artificial Sequence; identical to SEQ ID NO: 1415
  Synthetic oligonucleotide

SEQ ID NO: 2484 - DNA, 36 bp, Artificial Sequence; identical to SEQ ID NO: 2247
  Synthetic oligonucleotide

SEQ ID NO: 2485 - DNA, 35 bp, Artificial Sequence; identical to SEQ ID NO: 2248
  Synthetic oligonucleotide

SEQ ID NO: 2486 - DNA, 38 bp, Artificial Sequence; identical to SEQ ID NO: 2112
  Synthetic oligonucleotide

SEQ ID NO: 2487 - DNA, 36 bp, Artificial Sequence; identical to SEQ ID NO: 2250
  Synthetic oligonucleotide

SEQ ID NO: 2488 - DNA, 38 bp, Artificial Sequence; identical to SEQ ID NO: 2251
  Synthetic oligonucleotide

SEQ ID NO: 2489 - DNA, 37 bp, Artificial Sequence; identical to SEQ ID NO: 2252
  Synthetic oligonucleotide

SEQ ID NO: 2490 - DNA, 36 bp, Artificial Sequence; identical to SEQ ID NO: 2253
  Synthetic oligonucleotide

SEQ ID NO: 2491 - DNA, 36 bp, Artificial Sequence; identical to SEQ ID NO: 2254
  Synthetic oligonucleotide

SEQ ID NO: 2492 - DNA, 35 bp, Artificial Sequence; identical to SEQ ID NO: 2255
  Synthetic oligonucleotide

SEQ ID NO: 2493 - DNA, 38 bp, Artificial Sequence; identical to SEQ ID NO: 2256
  Synthetic oligonucleotide

SEQ ID NO: 2494 - DNA, 36 bp, Artificial Sequence; identical to SEQ ID NO: 1382
  Synthetic oligonucleotide

SEQ ID NO: 2495 - DNA, 35 bp, Artificial Sequence; identical to SEQ ID NO: 2258
  Synthetic oligonucleotide

SEQ ID NO: 2496 - DNA, 35 bp, Artificial Sequence; identical to SEQ ID NO: 1376
  Synthetic oligonucleotide

SEQ ID NO: 2497 - DNA, 36 bp, Artificial Sequence; identical to SEQ ID NO: 2260
  Synthetic oligonucleotide

SEQ ID NO: 2498 - DNA, 37 bp, Artificial Sequence; identical to SEQ ID NO: 1420
  Synthetic oligonucleotide

SEQ ID NO: 2499 - DNA, 35 bp, Artificial Sequence; identical to SEQ ID NO: 1370
  Synthetic oligonucleotide

SEQ ID NO: 2500 - DNA, 36 bp, Artificial Sequence
  Synthetic oligonucleotide
aattgtgaatcacaactcctggtatataggctttga

SEQ ID NO: 2501 - DNA, 36 bp, Artificial Sequence
  Synthetic oligonucleotide
cggcatacgaacctgtctcaaatcctagtaaggtaa

SEQ ID NO: 2502 - DNA, 36 bp, Artificial Sequence
  Synthetic oligonucleotide
agttgtgaaacacaactcctggtatataggctttga

SEQ ID NO: 2503 - DNA, 36 bp, Artificial Sequence
  Synthetic oligonucleotide
gagcttgatatcatcttccacttcttcgctattcta

SEQ ID NO: 2504 - DNA, 38 bp, Artificial Sequence
  Synthetic oligonucleotide
ggtcataatgtgaatcatgaatagtactaatttactga

SEQ ID NO: 2505 - DNA, 36 bp, Artificial Sequence
  Synthetic oligonucleotide
tggcggctcacgtattctgaaagttagtggtgcgga

SEQ ID NO: 2506 - DNA, 37 bp, Artificial Sequence
  Synthetic oligonucleotide
tagctcatgggttgcatcctcaggataactccgctga

SEQ ID NO: 2507 - DNA, 35 bp, Artificial Sequence
  Synthetic oligonucleotide
tcttattttcgcaagatcttttatctaaatacaat

SEQ ID NO: 2508 - DNA, 38 bp, Artificial Sequence
  Synthetic oligonucleotide
tttcgaccattgtgggatttccggcggtccaattatga

SEQ ID NO: 2509 - DNA, 38 bp, Artificial Sequence
  Synthetic oligonucleotide
actaggaagaacaggtacgtagggacacctgacagtga

SEQ ID NO: 2510 - DNA, 37 bp, Artificial Sequence
  Synthetic oligonucleotide
gacagctatcaacgaccgacaacggaaattggtgtga

SEQ ID NO: 2511 - DNA, 37 bp, Artificial Sequence
  Synthetic oligonucleotide
gggcgtcccttgcgttctctcaacgaatgtgtcgcga

SEQ ID NO: 2512 - DNA, 38 bp, Artificial Sequence
  Synthetic oligonucleotide
tggcgggcgtgggtgttgccgagacgtcagtaccgtga

SEQ ID NO: 2513 - DNA, 37 bp, Artificial Sequence
  Synthetic oligonucleotide
tggagcggcgagttggaatcctgatgtgggctcatga

SEQ ID NO: 2514 - DNA, 38 bp, Artificial Sequence
  Synthetic oligonucleotide
atagataaatggggaggtcgcgcattgaatgatggtga

SEQ ID NO: 2515 - DNA, 38 bp, Artificial Sequence
  Synthetic oligonucleotide
gccgtatgattaagcgatctctggcatatggcatctga

SEQ ID NO: 2516 - DNA, 38 bp, Artificial Sequence
  Synthetic oligonucleotide
tctcgaagttccgtttagccccaaggtcgcgggcgtga

SEQ ID NO: 2517 - DNA, 37 bp, Artificial Sequence
  Synthetic oligonucleotide
aaccgggtgtccaaaccgtaatttaatgtttctggga

SEQ ID NO: 2518 - DNA, 37 bp, Artificial Sequence
  Synthetic oligonucleotide
aaccgggcgtccaaaccgtaatttaatgtttctggga

SEQ ID NO: 2519 - DNA, 35 bp, Artificial Sequence
  Synthetic oligonucleotide
ataattcgcgtccggtccttggaaataaacggcgt

SEQ ID NO: 2520 - DNA, 35 bp, Artificial Sequence
  Synthetic oligonucleotide
gggcggcctcgttttatcgggaaaaggaacaaagt

SEQ ID NO: 2521 - DNA, 35 bp, Artificial Sequence
  Synthetic oligonucleotide
gggcggcctcgttttatcgggaaaaggaacaatat

SEQ ID NO: 2522 - DNA, 35 bp, Artificial Sequence
  Synthetic oligonucleotide
gggcggcctcgttttatcgggaaaaggaacaatct

SEQ ID NO: 2523 - DNA, 36 bp, Artificial Sequence
  Synthetic oligonucleotide
tggctgctggacgcgtcttacagccgaccacatcaa

SEQ ID NO: 2524 - DNA, 38 bp, Artificial Sequence
  Synthetic oligonucleotide
tagccctaattgcgcttcttagcagggctcgtggttga

SEQ ID NO: 2525 - DNA, 35 bp, Artificial Sequence
  Synthetic oligonucleotide
tttaggctttagggtacgacagcaataggtacaaa

SEQ ID NO: 2526 - DNA, 38 bp, Artificial Sequence
  Synthetic oligonucleotide
atagataaatggggagagcgcgcattgaatgatggtga

SEQ ID NO: 2527 - DNA, 35 bp, Artificial Sequence
  Synthetic oligonucleotide
gagagaagtatttgttaagccacatagttttcata

SEQ ID NO: 2528 - DNA, 35 bp, Artificial Sequence
  Synthetic oligonucleotide
gagagaagtatttgttaagccacatagttttcatc

SEQ ID NO: 2529 - DNA, 36 bp, Artificial Sequence; identical to SEQ ID NO: 2503
  Synthetic oligonucleotide

SEQ ID NO: 2530 - DNA, 35 bp, Artificial Sequence
  Synthetic oligonucleotide
tcttattttagcaagatcttttatctaaataaact

SEQ ID NO: 2531 - DNA, 35 bp, Artificial Sequence
  Synthetic oligonucleotide
tcttattttagcaagatcttttatctaaatacctt

SEQ ID NO: 2532 - DNA, 35 bp, Artificial Sequence
  Synthetic oligonucleotide
tcttattttagcaagatcttttatctaaatactaa

SEQ ID NO: 2533 - DNA, 35 bp, Artificial Sequence
  Synthetic oligonucleotide
tcttattttagcaagatcttttatctaaatactag

SEQ ID NO: 2534 - DNA, 37 bp, Artificial Sequence
  Synthetic oligonucleotide
tgggaggttcagaagtctttggccttgatctgcagga

SEQ ID NO: 2535 - DNA, 36 bp, Artificial Sequence
  Synthetic oligonucleotide
accaccaaatccccaaccacttttccgcttatccca

SEQ ID NO: 2536 - DNA, 35 bp, Artificial Sequence
  Synthetic oligonucleotide
catgcagccccacaccgcttttatattgttttctc

SEQ ID NO: 2537 - DNA, 35 bp, Artificial Sequence
  Synthetic oligonucleotide
catgcataggctcactcctggaacactacctttat

SEQ ID NO: 2538 - DNA, 36 bp, Artificial Sequence
  Synthetic oligonucleotide
caacagtcatgtcaccctattatttgctttcattca

SEQ ID NO: 2539 - DNA, 36 bp, Artificial Sequence
  Synthetic oligonucleotide
catgccatatgtcccatcacttacctaccatcccta

SEQ ID NO: 2540 - DNA, 35 bp, Artificial Sequence
  Synthetic oligonucleotide
catgcgatccaatcctatagtccttggaccttata

SEQ ID NO: 2541 - DNA, 35 bp, Artificial Sequence
  Synthetic oligonucleotide
catgcgatccctcacacaactttcatcccaatacc

SEQ ID NO: 2542 - DNA, 35 bp, Artificial Sequence
  Synthetic oligonucleotide
cttgcgatattaactttccatcactttccttcttt

SEQ ID NO: 2543 - DNA, 35 bp, Artificial Sequence
  Synthetic oligonucleotide
catgcgccgatacccatttcccaattcctcttcaa

SEQ ID NO: 2544 - DNA, 35 bp, Artificial Sequence
  Synthetic oligonucleotide
cactgccacgtcaaatgcctctttcatttccattt

SEQ ID NO: 2545 - DNA, 36 bp, Artificial Sequence
  Synthetic oligonucleotide
cactgcggtcgagcctcctaattgttctcaccctta

SEQ ID NO: 2546 - DNA, 38 bp, Artificial Sequence
  Synthetic oligonucleotide
cgaacagtggtacacgacgtagtgcactctttttatga

SEQ ID NO: 2547 - DNA, 35 bp, Artificial Sequence
  Synthetic oligonucleotide
attgatctgcatgtgccattttcccacctttgttt

SEQ ID NO: 2548 - DNA, 35 bp, Artificial Sequence
  Synthetic oligonucleotide
gcacatgcgtactctcattaacttcattaccatcc

SEQ ID NO: 2549 - DNA, 35 bp, Artificial Sequence
  Synthetic oligonucleotide
gcgattacccactcttgtaaactaatttgcccatt

SEQ ID NO: 2550 - DNA, 38 bp, Artificial Sequence
  Synthetic oligonucleotide
gagacacgccactctcacgacacgttccttatttctga

SEQ ID NO: 2551 - DNA, 35 bp, Artificial Sequence; identical to SEQ ID NO: 325
  Synthetic oligonucleotide

SEQ ID NO: 2552 - DNA, 34 bp, Artificial Sequence
  Synthetic oligonucleotide
gccacaacacaattcttccgccatcactgcccaa

SEQ ID NO: 2553 - DNA, 35 bp, Artificial Sequence
  Synthetic oligonucleotide
gcctgaccacccgtataatttaccgcctaaacctt

SEQ ID NO: 2554 - DNA, 34 bp, Artificial Sequence; identical to SEQ ID NO: 34
  Synthetic oligonucleotide

SEQ ID NO: 2555 - DNA, 36 bp, Artificial Sequence
  Synthetic oligonucleotide
tacgactcatacttccattccgcctaaccttttcca

SEQ ID NO: 2556 - DNA, 35 bp, Artificial Sequence
  Synthetic oligonucleotide
gcgtatcaccatggctcacttttcctatctccttt

SEQ ID NO: 2557 - DNA, 35 bp, Artificial Sequence
  Synthetic oligonucleotide
ggccacgtaacagctactcaacgcgcaacactaac

SEQ ID NO: 2558 - DNA, 36 bp, Artificial Sequence
  Synthetic oligonucleotide
gcggccacactttgccttcttattcgttaattccta

SEQ ID NO: 2559 - DNA, 35 bp, Artificial Sequence
  Synthetic oligonucleotide
tgctgtcaacgcgaagatctttctcttttattctt

SEQ ID NO: 2560 - DNA, 35 bp, Artificial Sequence
  Synthetic oligonucleotide
tatgcggcgaacgccttctatttcctggttctctt

SEQ ID NO: 2561 - DNA, 35 bp, Artificial Sequence
  Synthetic oligonucleotide
tatgccccacgataatttcctctttttgcatattt

SEQ ID NO: 2562 - DNA, 36 bp, Artificial Sequence; identical to SEQ ID NO: 443
  Synthetic oligonucleotide

SEQ ID NO: 2563 - DNA, 36 bp, Artificial Sequence
  Synthetic oligonucleotide
acaccacgcctctgccggtggacgtactgcccatta

SEQ ID NO: 2564 - DNA, 38 bp, Artificial Sequence
  Synthetic oligonucleotide
gccacgtagaacacccatcctgatccatacaatactga

SEQ ID NO: 2565 - DNA, 35 bp, Artificial Sequence; identical to SEQ ID NO: 651
  Synthetic oligonucleotide

SEQ ID NO: 2566 - DNA, 36 bp, Artificial Sequence
  Synthetic oligonucleotide
acgcacgtgcagtcgtatcccgtttcttgcgcttta

SEQ ID NO: 2567 - DNA, 35 bp, Artificial Sequence
  Synthetic oligonucleotide
gacctagaagagggcgcttaaaattgggagtggtt

SEQ ID NO: 2568 - DNA, 35 bp, Artificial Sequence
  Synthetic oligonucleotide
atgcactacgcagatgcaaactatctttcgccttc

SEQ ID NO: 2569 - DNA, 35 bp, Artificial Sequence; identical to SEQ ID NO: 302
  Synthetic oligonucleotide

SEQ ID NO: 2570 - DNA, 38 bp, Artificial Sequence
  Synthetic oligonucleotide
gatgtagctgccacgagtgcgtatactcctttatctga

SEQ ID NO: 2571 - DNA, 36 bp, Artificial Sequence
  Synthetic oligonucleotide
gcccagctgcggtcacttgcccagccattccaccaa

SEQ ID NO: 2572 - DNA, 35 bp, Artificial Sequence; identical to SEQ ID NO: 325
  Synthetic oligonucleotide

SEQ ID NO: 2573 - DNA, 34 bp, Artificial Sequence; identical to SEQ ID NO: 34
  Synthetic oligonucleotide

SEQ ID NO: 2574 - DNA, 35 bp, Artificial Sequence
  Synthetic oligonucleotide
gccgagtcaatcaagctcggattacagtgtttacc

SEQ ID NO: 2575 - DNA, 35 bp, Artificial Sequence
  Synthetic oligonucleotide
tactgcaggtacagagtatcttcatccacctccat

SEQ ID NO: 2576 - DNA, 36 bp, Artificial Sequence
  Synthetic oligonucleotide
ggtgccgttgaggtatacggaccgtgcaggccatca

SEQ ID NO: 2577 - DNA, 36 bp, Artificial Sequence; identical to SEQ ID NO: 579
  Synthetic oligonucleotide

SEQ ID NO: 2578 - DNA, 35 bp, Artificial Sequence
  Synthetic oligonucleotide
gtcgtgcgaggtcaagtactcctattctctctaaa

SEQ ID NO: 2579 - DNA, 38 bp, Artificial Sequence
  Synthetic oligonucleotide
tggagggccgagtggtgggggtttgagaagcattatga

SEQ ID NO: 2580 - DNA, 37 bp, Artificial Sequence
  Synthetic oligonucleotide
tcacgacgtacaaaggttggcgtacttaccttactga

SEQ ID NO: 2581 - DNA, 35 bp, Artificial Sequence
  Synthetic oligonucleotide
tgcactgtaggtcatttcgtttacttgccaccatc

SEQ ID NO: 2582 - DNA, 36 bp, Artificial Sequence
  Synthetic oligonucleotide
tgtaacagcagtcgcggggaattattggctcttgaa

SEQ ID NO: 2583 - DNA, 36 bp, Artificial Sequence
  Synthetic oligonucleotide
tgtacaagtcagacgcgcccaaccctgtttacacta

SEQ ID NO: 2584 - DNA, 38 bp, Artificial Sequence
  Synthetic oligonucleotide
tgtacacctgcaatgcgtggtattactttgttccttga

SEQ ID NO: 2585 - DNA, 38 bp, Artificial Sequence
  Synthetic oligonucleotide
tccacatgccgttgaactctttattccctttaccttga

SEQ ID NO: 2586 - DNA, 35 bp, Artificial Sequence
  Synthetic oligonucleotide
ttggtacccgatagaatctagtttttgtagccaag

SEQ ID NO: 2587 - DNA, 35 bp, Artificial Sequence
  Synthetic oligonucleotide
acggacatgcgagcaacaatgaacgtctttttttc

SEQ ID NO: 2588 - DNA, 36 bp, Artificial Sequence
  Synthetic oligonucleotide
aaccacgaaggtacggacacactttacataccctta

SEQ ID NO: 2589 - DNA, 38 bp, Artificial Sequence
  Synthetic oligonucleotide
atgtacgcggtacccatcacacactatgtgtcccttga

SEQ ID NO: 2590 - DNA, 35 bp, Artificial Sequence
  Synthetic oligonucleotide
agtcacacaagcctccgattcattcttctaaacat

SEQ ID NO: 2591 - DNA, 38 bp, Artificial Sequence
  Synthetic oligonucleotide
catgcgcaggtatcttgctacactattctcccgtttga

SEQ ID NO: 2592 - DNA, 36 bp, Artificial Sequence
  Synthetic oligonucleotide
atgcgcacccgctatctacccgtgacacacgcctta

SEQ ID NO: 2593 - DNA, 35 bp, Artificial Sequence
  Synthetic oligonucleotide
atctcgaaccaccaccttccatcccttatgttgtc

SEQ ID NO: 2594 - DNA, 35 bp, Artificial Sequence
  Synthetic oligonucleotide
gcgaaccggaacttaatatccttgtaaccgctatc

SEQ ID NO: 2595 - DNA, 36 bp, Artificial Sequence
  Synthetic oligonucleotide
gcaacccgacctcgctccaaccgcttacgactccta

SEQ ID NO: 2596 - DNA, 36 bp, Artificial Sequence
  Synthetic oligonucleotide
gcaccccacatcccacgatcccatggatacccgcca

SEQ ID NO: 2597 - DNA, 36 bp, Artificial Sequence
  Synthetic oligonucleotide
gccaacctcaccaccggtacgccttatcgctaatta

SEQ ID NO: 2598 - DNA, 35 bp, Artificial Sequence
  Synthetic oligonucleotide
tcagtaccgccattcccaaaaatttttccccaaca

SEQ ID NO: 2599 - DNA, 35 bp, Artificial Sequence
  Synthetic oligonucleotide
tgaagccagctgacgtacatccacatattccctac

SEQ ID NO: 2600 - DNA, 36 bp, Artificial Sequence
  Synthetic oligonucleotide
tcaaccaactcaccctcatttactcgcataacatta

SEQ ID NO: 2601 - DNA, 35 bp, Artificial Sequence
  Synthetic oligonucleotide
tatgcccgcctgactctcttattactggttccgac

SEQ ID NO: 2602 - DNA, 36 bp, Artificial Sequence
  Synthetic oligonucleotide
actgctggcaccgcaatctacctaaagtttccgtta

SEQ ID NO: 2603 - DNA, 35 bp, Artificial Sequence
  Synthetic oligonucleotide
accacgcactcaggttcatgcatcttgaactttac

SEQ ID NO: 2604 - DNA, 36 bp, Artificial Sequence
  Synthetic oligonucleotide
gaccgtcgcaggccgtggctagcaggacgttggcta

SEQ ID NO: 2605 - DNA, 38 bp, Artificial Sequence
  Synthetic oligonucleotide
gacgaacgtgctgttggtattttttgaactcttattga

SEQ ID NO: 2606 - DNA, 37 bp, Artificial Sequence
  Synthetic oligonucleotide
gacatcctggaggtcctaactgcggtctcacacttga

SEQ ID NO: 2607 - DNA, 35 bp, Artificial Sequence
  Synthetic oligonucleotide
atgccggggtcacgacgttaccgcactccatctat

SEQ ID NO: 2608 - DNA, 35 bp, Artificial Sequence
  Synthetic oligonucleotide
atcagcaacgcccagtggtgcaagctttacccttt

SEQ ID NO: 2609 - DNA, 36 bp, Artificial Sequence
  Synthetic oligonucleotide
gactaccgtacgtgcatggcccccagttacacaata

SEQ ID NO: 2610 - DNA, 35 bp, Artificial Sequence
  Synthetic oligonucleotide
tacctcaaccgcgaactttgctacgttttgtaggg

SEQ ID NO: 2611 - DNA, 35 bp, Artificial Sequence
  Synthetic oligonucleotide
tacgctgtcgtgtgaggccctaccgctcccctatc

SEQ ID NO: 2612 - DNA, 35 bp, Artificial Sequence
  Synthetic oligonucleotide
gtcacggaagcagttacgaacgatgcccttccatc

SEQ ID NO: 2613 - DNA, 36 bp, Artificial Sequence; identical to SEQ ID NO: 2582
  Synthetic oligonucleotide

SEQ ID NO: 2614 - DNA, 35 bp, Artificial Sequence
  Synthetic oligonucleotide
ttgtgacgtctcgtgcgcattaccggttaatattt

SEQ ID NO: 2615 - DNA, 35 bp, Artificial Sequence; identical to SEQ ID NO: 2586
  Synthetic oligonucleotide

SEQ ID NO: 2616 - DNA, 35 bp, Artificial Sequence
  Synthetic oligonucleotide
tttaacgtagtgagtcaccattgatcctttaattt

SEQ ID NO: 2617 - DNA, 35 bp, Artificial Sequence
  Synthetic oligonucleotide
acccacgcctaccctaatccttgtctgttattttc

SEQ ID NO: 2618 - DNA, 36 bp, Artificial Sequence
  Synthetic oligonucleotide
catgccgaataatctctttcgttcctggtcctttta

SEQ ID NO: 2619 - DNA, 37 bp, Artificial Sequence
  Synthetic oligonucleotide
catgccgccaaaccacactgttccgtcttacttatga

SEQ ID NO: 2620 - DNA, 35 bp, Artificial Sequence
  Synthetic oligonucleotide
catgcgaacaacctttaccattcactagcacccct

SEQ ID NO: 2621 - DNA, 38 bp, Artificial Sequence
  Synthetic oligonucleotide
catgcgacacgctctatcgctttcacatcttcgcttga

SEQ ID NO: 2622 - DNA, 35 bp, Artificial Sequence; identical to SEQ ID NO: 2541
  Synthetic oligonucleotide

SEQ ID NO: 2623 - DNA, 35 bp, Artificial Sequence
  Synthetic oligonucleotide
catgcgcactttcctcacatgataccctgcatgac

SEQ ID NO: 2624 - DNA, 35 bp, Artificial Sequence
  Synthetic oligonucleotide
catgcgcatccaatcacactttttaatttcatttc

SEQ ID NO: 2625 - DNA, 35 bp, Artificial Sequence
  Synthetic oligonucleotide
atgcctagcagccaagcaatgcctttcatttattc

SEQ ID NO: 2626 - DNA, 36 bp, Artificial Sequence
  Synthetic oligonucleotide
gccgcagccatcatctacgcttcacactcatcacca

SEQ ID NO: 2627 - DNA, 36 bp, Artificial Sequence
  Synthetic oligonucleotide
ggtacgcaggcgcgatttgtacatttttgatcctga

SEQ ID NO: 2628 - DNA, 38 bp, Artificial Sequence
  Synthetic oligonucleotide
tctaacgtactatcatgtgccacgccttcatttcctga

SEQ ID NO: 2629 - DNA, 35 bp, Artificial Sequence
  Synthetic oligonucleotide
tcaactgccaccgaccccaacccgcgacccatcct

SEQ ID NO: 2630 - DNA, 36 bp, Artificial Sequence; identical to SEQ ID NO: 241
  Synthetic oligonucleotide

SEQ ID NO: 2631 - DNA, 36 bp, Artificial Sequence
  Synthetic oligonucleotide
cgcgagccagggtactgcctgcggtctaaacaataa

SEQ ID NO: 2632 - DNA, 36 bp, Artificial Sequence; identical to SEQ ID NO: 24
  Synthetic oligonucleotide

SEQ ID NO: 2633 - DNA, 35 bp, Artificial Sequence; identical to SEQ ID NO: 199
  Synthetic oligonucleotide

SEQ ID NO: 2634 - DNA, 35 bp, Artificial Sequence; identical to SEQ ID NO: 54
  Synthetic oligonucleotide

SEQ ID NO: 2635 - DNA, 38 bp, Artificial Sequence; identical to SEQ ID NO: 725
  Synthetic oligonucleotide

SEQ ID NO: 2636 - DNA, 36 bp, Artificial Sequence; identical to SEQ ID NO: 57
  Synthetic oligonucleotide

SEQ ID NO: 2637 - DNA, 36 bp, Artificial Sequence
  Synthetic oligonucleotide
tgggtgtcgtactggtaccaaggagtgcgaaatcta

SEQ ID NO: 2638 - DNA, 35 bp, Artificial Sequence; identical to SEQ ID NO: 145
  Synthetic oligonucleotide

SEQ ID NO: 2639 - DNA, 35 bp, Artificial Sequence
  Synthetic oligonucleotide
acgcgcataaaccaatcactaccgaccacttattc

SEQ ID NO: 2640 - DNA, 35 bp, Artificial Sequence
  Synthetic oligonucleotide
acgtcaggcataaattcttcaaactcttactatca

SEQ ID NO: 2641 - DNA, 36 bp, Artificial Sequence
  Synthetic oligonucleotide
catgcccggaccattattattcgcttaccattccca

SEQ ID NO: 2642 - DNA, 37 bp, Artificial Sequence
  Synthetic oligonucleotide
catgccgaccactgttccttttacctcttatacctga

SEQ ID NO: 2643 - DNA, 35 bp, Artificial Sequence
  Synthetic oligonucleotide
catgcgaacagacgaatgattcttacaaccgcaac

SEQ ID NO: 2644 - DNA, 35 bp, Artificial Sequence
  Synthetic oligonucleotide
cccgtccgcaggcatccacgtttatgccttttatc

SEQ ID NO: 2645 - DNA, 36 bp, Artificial Sequence
  Synthetic oligonucleotide
cacgcgaccctcattaacatcatctaacccaatcca

SEQ ID NO: 2646 - DNA, 35 bp, Artificial Sequence
  Synthetic oligonucleotide
catgcgccaattttactgtacatttctttttttat

SEQ ID NO: 2647 - DNA, 35 bp, Artificial Sequence
  Synthetic oligonucleotide
catgcgcgccgacctactcgcttaatctcacgttt

SEQ ID NO: 2648 - DNA, 35 bp, Artificial Sequence
  Synthetic oligonucleotide
catggcgaccctcaatctcacattttacctcttct

SEQ ID NO: 2649 - DNA, 35 bp, Artificial Sequence
  Synthetic oligonucleotide
gacggactgcgtatcgcatagtttatccttttttt

SEQ ID NO: 2650 - DNA, 35 bp, Artificial Sequence
  Synthetic oligonucleotide
gcccaccatatcgcaatcatattcctcgccttgtt

SEQ ID NO: 2651 - DNA, 35 bp, Artificial Sequence
  Synthetic oligonucleotide
gcgcatgtcaaccttacctctattggcccttattc

SEQ ID NO: 2652 - DNA, 35 bp, Artificial Sequence
  Synthetic oligonucleotide
gcatccagtccataactcaatctcacctgtaattc

SEQ ID NO: 2653 - DNA, 35 bp, Artificial Sequence
  Synthetic oligonucleotide
gccgcatacccctgtaatttcgtaacctacaccca

SEQ ID NO: 2654 - DNA, 34 bp, Artificial Sequence
  Synthetic oligonucleotide
gcgcaactccgactatcactgccttaccaatcac

SEQ ID NO: 2655 - DNA, 36 bp, Artificial Sequence
  Synthetic oligonucleotide
gcgacgcctctgacctacatataactttgatagtaa

SEQ ID NO: 2656 - DNA, 35 bp, Artificial Sequence
  Synthetic oligonucleotide
gcgacgcgtgaacacccttattctgtaatcttttt

SEQ ID NO: 2657 - DNA, 35 bp, Artificial Sequence
  Synthetic oligonucleotide
gtactgtcaacccgatctttgtttgtatttatttt

SEQ ID NO: 2658 - DNA, 38 bp, Artificial Sequence
  Synthetic oligonucleotide
gcgcggtactcattatccttatatcatcttacatttga

SEQ ID NO: 2659 - DNA, 37 bp, Artificial Sequence
  Synthetic oligonucleotide
tatgcgagcccatttttcacctttgctatttcttaga

SEQ ID NO: 2660 - DNA, 35 bp, Artificial Sequence
  Synthetic oligonucleotide
tcctccagcacattctaccacactaccacattcat

SEQ ID NO: 2661 - DNA, 35 bp, Artificial Sequence
  Synthetic oligonucleotide
tatgcggtgccacttctctattacttctattactt

SEQ ID NO: 2662 - DNA, 36 bp, Artificial Sequence
  Synthetic oligonucleotide
tcatgcagcctagtatctatcctaccatattattca

SEQ ID NO: 2663 - DNA, 35 bp, Artificial Sequence
  Synthetic oligonucleotide
tgacggacagtgcatgcgttatacttattctctat

SEQ ID NO: 2664 - DNA, 38 bp, Artificial Sequence
  Synthetic oligonucleotide
aagcctggccgtggtgctgcagtttattccgttagtga

SEQ ID NO: 2665 - DNA, 36 bp, Artificial Sequence; identical to SEQ ID NO: 2631
  Synthetic oligonucleotide

SEQ ID NO: 2666 - DNA, 36 bp, Artificial Sequence; identical to SEQ ID NO: 24
  Synthetic oligonucleotide

SEQ ID NO: 2667 - DNA, 36 bp, Artificial Sequence
  Synthetic oligonucleotide
gcattcgcgtactgtggacaacctatatccgggtaa

SEQ ID NO: 2668 - DNA, 36 bp, Artificial Sequence
  Synthetic oligonucleotide
gcaactatcgcgagcgccttcaagattagcgtgtca

SEQ ID NO: 2669 - DNA, 38 bp, Artificial Sequence; identical to SEQ ID NO: 42
  Synthetic oligonucleotide

SEQ ID NO: 2670 - DNA, 38 bp, Artificial Sequence
  Synthetic oligonucleotide
gtgcggggccacaggtgatagcaatgcatgccctatga

SEQ ID NO: 2671 - DNA, 37 bp, Artificial Sequence
  Synthetic oligonucleotide
tcaccccaagcagtcattgcctacaggagtctggtga

SEQ ID NO: 2672 - DNA, 37 bp, Artificial Sequence
  Synthetic oligonucleotide
tgcagttagtgcaatgaatatctcggacacgcggaga

SEQ ID NO: 2673 - DNA, 35 bp, Artificial Sequence
  Synthetic oligonucleotide
tccgcagacagccgggggtcaggactacggctacg

SEQ ID NO: 2674 - DNA, 37 bp, Artificial Sequence
  Synthetic oligonucleotide
ttacagctactctgcgctccaagtggacactttacga

SEQ ID NO: 2675 - DNA, 36 bp, Artificial Sequence
  Synthetic oligonucleotide
ttagcatcactgacttggatacatacagcatgtcga

SEQ ID NO: 2676 - DNA, 35 bp, Artificial Sequence
  Synthetic oligonucleotide
agcacgactgcaatccacatccgttcttattcctt

SEQ ID NO: 2677 - DNA, 37 bp, Artificial Sequence
  Synthetic oligonucleotide
aatgcgcacatctgtttttgtaccttagaatgtttga

SEQ ID NO: 2678 - DNA, 35 bp, Artificial Sequence; identical to SEQ ID NO: 2640
  Synthetic oligonucleotide

SEQ ID NO: 2679 - DNA, 36 bp, Artificial Sequence
  Synthetic oligonucleotide
catgcaccactcgcacattccaccacaatctataca

SEQ ID NO: 2680 - DNA, 35 bp, Artificial Sequence
  Synthetic oligonucleotide
ctgccactagccgcccatactatccacaccataat

SEQ ID NO: 2681 - DNA, 35 bp, Artificial Sequence
  Synthetic oligonucleotide
ccatgcgcggtcacacataccagtccttaccattt

SEQ ID NO: 2682 - DNA, 35 bp, Artificial Sequence
  Synthetic oligonucleotide
catgccgacacaccacttttttccgaccgacttcc

SEQ ID NO: 2683 - DNA, 35 bp, Artificial Sequence
  Synthetic oligonucleotide
catgccgcctttcgacttccatatcccaacacgac

SEQ ID NO: 2684 - DNA, 35 bp, Artificial Sequence; identical to SEQ ID NO: 67
  Synthetic oligonucleotide

SEQ ID NO: 2685 - DNA, 35 bp, Artificial Sequence; identical to SEQ ID NO: 68
  Synthetic oligonucleotide

SEQ ID NO: 2686 - DNA, 35 bp, Artificial Sequence
  Synthetic oligonucleotide
cttgccgatcccgctccctagttcccttgcccact

SEQ ID NO: 2687 - DNA, 36 bp, Artificial Sequence
  Synthetic oligonucleotide
cacgcatgtctgcgctcgtatcttttcaccctatga

SEQ ID NO: 2688 - DNA, 38 bp, Artificial Sequence
  Synthetic oligonucleotide
cactgcggtcaacacccaccaacctccgaccttactga

SEQ ID NO: 2689 - DNA, 38 bp, Artificial Sequence
  Synthetic oligonucleotide
catgcgtacgccactttcgcctactctaacatatctga

SEQ ID NO: 2690 - DNA, 35 bp, Artificial Sequence
  Synthetic oligonucleotide
cagtctgcgcgaccctttctgttccttcatcccca

SEQ ID NO: 2691 - DNA, 35 bp, Artificial Sequence
  Synthetic oligonucleotide
cattgcgccttctattttattttccttatatttgt

SEQ ID NO: 2692 - DNA, 38 bp, Artificial Sequence
  Synthetic oligonucleotide
cattgcggccattacccctctaccgttaccctttttga

SEQ ID NO: 2693 - DNA, 35 bp, Artificial Sequence
  Synthetic oligonucleotide
gcacacacctgcggagcaccactccaaattaccca

SEQ ID NO: 2694 - DNA, 35 bp, Artificial Sequence
  Synthetic oligonucleotide
gcacactacgtttaccctggcccttctaattgttt

SEQ ID NO: 2695 - DNA, 35 bp, Artificial Sequence
  Synthetic oligonucleotide
gcactgccattgatttcttcccacttcacactctt

SEQ ID NO: 2696 - DNA, 36 bp, Artificial Sequence
  Synthetic oligonucleotide
gcgaacactgatcttaactaacgcccgcccaattta

SEQ ID NO: 2697 - DNA, 36 bp, Artificial Sequence
  Synthetic oligonucleotide
gcacccccaatgaccgccatcaaaccatatattcca

SEQ ID NO: 2698 - DNA, 36 bp, Artificial Sequence
  Synthetic oligonucleotide
gcgcaaccatcactataacccatttacctgttttca

SEQ ID NO: 2699 - DNA, 38 bp, Artificial Sequence
  Synthetic oligonucleotide
gcgcaccacacttgagttctttaactttccctttatga

SEQ ID NO: 2700 - DNA, 35 bp, Artificial Sequence
  Synthetic oligonucleotide
gccgacgtacctgctgggtctctctattcattttt

SEQ ID NO: 2701 - DNA, 35 bp, Artificial Sequence
  Synthetic oligonucleotide
tacgccgtccaccatcctcttctatatacctaacc

SEQ ID NO: 2702 - DNA, 35 bp, Artificial Sequence
  Synthetic oligonucleotide
tactacgaaccatcccactctttgcacctgttttc

SEQ ID NO: 2703 - DNA, 34 bp, Artificial Sequence
  Synthetic oligonucleotide
tcatgcgcggtacacatttcttaatcacttttct

SEQ ID NO: 2704 - DNA, 35 bp, Artificial Sequence
  Synthetic oligonucleotide
tgcgggcattggtgcaatcttaacttattctttat

SEQ ID NO: 2705 - DNA, 35 bp, Artificial Sequence
  Synthetic oligonucleotide
tggtagtgctgcatcaccgatcatccttttacatt

SEQ ID NO: 2706 - DNA, 37 bp, Artificial Sequence
  Synthetic oligonucleotide
tccgcgactgttcatcccccatcccaacataacccga

SEQ ID NO: 2707 - DNA, 38 bp, Artificial Sequence
  Synthetic oligonucleotide
tgtgaacgtcactgcaccctaaactaatattcccttga

SEQ ID NO: 2708 - DNA, 36 bp, Artificial Sequence
  Synthetic oligonucleotide
ttgacaactgccactaccaactgaacccgctactta

SEQ ID NO: 2709 - DNA, 38 bp, Artificial Sequence
  Synthetic oligonucleotide
ttgtcaagcgctatccaccatttctcttttatctatga

SEQ ID NO: 2710 - DNA, 35 bp, Artificial Sequence
  Synthetic oligonucleotide
caatgcgacgaggcttctatgtcatgaactaagct

SEQ ID NO: 2711 - DNA, 37 bp, Artificial Sequence
  Synthetic oligonucleotide
ccgaacggtcgcaaagtggtgtagcctctaatccgga

SEQ ID NO: 2712 - DNA, 35 bp, Artificial Sequence; identical to SEQ ID NO: 2648
  Synthetic oligonucleotide

SEQ ID NO: 2713 - DNA, 38 bp, Artificial Sequence
  Synthetic oligonucleotide
accggaatgtacatgccctggtttttgttattatttga

SEQ ID NO: 2714 - DNA, 35 bp, Artificial Sequence
  Synthetic oligonucleotide
accatgcgcccaccactattttttccacttcctta

SEQ ID NO: 2715 - DNA, 37 bp, Artificial Sequence
  Synthetic oligonucleotide
acggagtaccctgcccactatataacttaaaccttga

SEQ ID NO: 2716 - DNA, 35 bp, Artificial Sequence
  Synthetic oligonucleotide
acgggcgtgtcgcactgtctgtcactggcttattc

SEQ ID NO: 2717 - DNA, 35 bp, Artificial Sequence
  Synthetic oligonucleotide
agacggtgggtgggtgggtggtgctgcagtctacc

SEQ ID NO: 2718 - DNA, 35 bp, Artificial Sequence
  Synthetic oligonucleotide
catgccgcaccccaacacgtaccatttcattattt

SEQ ID NO: 2719 - DNA, 36 bp, Artificial Sequence
  Synthetic oligonucleotide
catgcgggcatccttagcttaacctcaattccatta

SEQ ID NO: 2720 - DNA, 35 bp, Artificial Sequence
  Synthetic oligonucleotide
catggccattctaccctccattccattccttgcct

SEQ ID NO: 2721 - DNA, 35 bp, Artificial Sequence
  Synthetic oligonucleotide
cgttcggtacgcagtcatttcactctatcttgttc

SEQ ID NO: 2722 - DNA, 37 bp, Artificial Sequence
  Synthetic oligonucleotide
aacccacgagttgttggtccacgcctcgttatcacga

SEQ ID NO: 2723 - DNA, 36 bp, Artificial Sequence
  Synthetic oligonucleotide
aacccatgcctgccccatgtgcattcaggcagagca

SEQ ID NO: 2724 - DNA, 36 bp, Artificial Sequence
  Synthetic oligonucleotide
accgccacagtcatcaacccacctggccgacgacga

SEQ ID NO: 2725 - DNA, 36 bp, Artificial Sequence
  Synthetic oligonucleotide
gacaacgcaaccgcaggctcatggagccaatatgta

SEQ ID NO: 2726 - DNA, 37 bp, Artificial Sequence
  Synthetic oligonucleotide
gacaacacgtcgcatgatcttaaaagaggacctagga

SEQ ID NO: 2727 - DNA, 38 bp, Artificial Sequence
  Synthetic oligonucleotide
gagtggtcgccactcacaacgatgcggtatccccttga

SEQ ID NO: 2728 - DNA, 37 bp, Artificial Sequence
  Synthetic oligonucleotide
gcgtggtggtccgccggtggtgagtcgatgaactgga

SEQ ID NO: 2729 - DNA, 36 bp, Artificial Sequence
  Synthetic oligonucleotide
gtgatcgatagcgagtgttgagctgtcgagagtgga

SEQ ID NO: 2730 - DNA, 36 bp, Artificial Sequence
  Synthetic oligonucleotide
tcacacaccgcgtggctcggacgacaagtagtccta

SEQ ID NO: 2731 - DNA, 35 bp, Artificial Sequence
  Synthetic oligonucleotide
tgaacctgcacagctgttaagaggtggcttacgta

SEQ ID NO: 2732 - DNA, 35 bp, Artificial Sequence
  Synthetic oligonucleotide
actgaccacagctacgtaagcaataaccgatcgtt

SEQ ID NO: 2733 - DNA, 35 bp, Artificial Sequence
  Synthetic oligonucleotide
aagagtacgggcatgagtaataagggagtagccgt

SEQ ID NO: 2734 - DNA, 35 bp, Artificial Sequence
  Synthetic oligonucleotide
agatcgcggtcaatcggtgggtagttaggatcggg

SEQ ID NO: 2735 - DNA, 35 bp, Artificial Sequence
  Synthetic oligonucleotide
gaacacacgtcgatcgccactgagagcagatgtca

SEQ ID NO: 2736 - DNA, 35 bp, Artificial Sequence
  Synthetic oligonucleotide
atcggaggccgtatcaccatatcccaccaccactt

SEQ ID NO: 2737 - DNA, 34 bp, Artificial Sequence
  Synthetic oligonucleotide
cttattttagcaagatcttttatctaaatacaat

SEQ ID NO: 2738 - DNA, 36 bp, Artificial Sequence
  Synthetic oligonucleotide
gacaaacgtagtgctgaacatggcgttctggtccaa

SEQ ID NO: 2739 - DNA, 35 bp, Artificial Sequence
  Synthetic oligonucleotide
ataccgggacaggcgacagaagggtgaaccaatgt

SEQ ID NO: 2740 - DNA, 37 bp, Artificial Sequence
  Synthetic oligonucleotide
gagtggacgtggacgcgaaacgggtcaggcataacga

SEQ ID NO: 2741 - DNA, 36 bp, Artificial Sequence
  Synthetic oligonucleotide
taccacgtggcgcctgacgacttacgcaactgggga

SEQ ID NO: 2742 - DNA, 36 bp, Artificial Sequence
  Synthetic oligonucleotide
tacagccgacatgaacatcccttaatcccaccctaa

SEQ ID NO: 2743 - DNA, 37 bp, Artificial Sequence
  Synthetic oligonucleotide
tgataccgcgcaacgagacttaccacgtcaggatgga

SEQ ID NO: 2744 - DNA, 36 bp, Artificial Sequence
  Synthetic oligonucleotide
atggtgggagcaccgacgtaggaggcctatggcgta

SEQ ID NO: 2745 - DNA, 37 bp, Artificial Sequence; identical to SEQ ID NO: 2726
  Synthetic oligonucleotide

SEQ ID NO: 2746 - DNA, 38 bp, Artificial Sequence
  Synthetic oligonucleotide
gtgaacgtcgctagaaacgatggtgtaaatagtcttga

SEQ ID NO: 2747 - DNA, 36 bp, Artificial Sequence; identical to SEQ ID NO: 2729
  Synthetic oligonucleotide

SEQ ID NO: 2748 - DNA, 37 bp, Artificial Sequence
  Synthetic oligonucleotide
aacacgcaacacacaactctcggcaaatccagcgcga

SEQ ID NO: 2749 - DNA, 37 bp, Artificial Sequence
  Synthetic oligonucleotide
acgacgcaccctgccactatcgtagatactccgacta

SEQ ID NO: 2750 - DNA, 36 bp, Artificial Sequence
  Synthetic oligonucleotide
gaccaatggaccggggactactctgagaaagcgcga

SEQ ID NO: 2751 - DNA, 36 bp, Artificial Sequence
  Synthetic oligonucleotide
agtggaacgcaccgaagttacctacctgagatggga

SEQ ID NO: 2752 - DNA, 37 bp, Artificial Sequence
  Synthetic oligonucleotide
gacgacggggatcctgacaattcctgactaagcgcga

SEQ ID NO: 2753 - DNA, 35 bp, Artificial Sequence
  Synthetic oligonucleotide
gacccgcccagtaagcacacacacagcccaaattt

SEQ ID NO: 2754 - DNA, 37 bp, Artificial Sequence
  Synthetic oligonucleotide
gagcggactcgaatagaactccgcaacaccagcgcga

SEQ ID NO: 2755 - DNA, 37 bp, Artificial Sequence
  Synthetic oligonucleotide
gagacgaggccgggatcatgctagggatcggacagga

SEQ ID NO: 2756 - DNA, 36 bp, Artificial Sequence
  Synthetic oligonucleotide
taccgacaccctcgtgttcccaaacaaggagacgga

SEQ ID NO: 2757 - DNA, 37 bp, Artificial Sequence
  Synthetic oligonucleotide
ggatacgcaccttaaggagggacgaataaaagcgcga

SEQ ID NO: 2758 - DNA, 36 bp, Artificial Sequence
  Synthetic oligonucleotide
tagcacagtggtgcttacggaacatcaccagcgcga

SEQ ID NO: 2759 - DNA, 37 bp, Artificial Sequence
  Synthetic oligonucleotide
tagtcggtcggcctgccgatgcgtcaaggtagcgcga

SEQ ID NO: 2760 - DNA, 37 bp, Artificial Sequence
  Synthetic oligonucleotide
taggaatcaccggctcgggcgaggccgggaagcgcga

SEQ ID NO: 2761 - DNA, 37 bp, Artificial Sequence
  Synthetic oligonucleotide
tgagccgcaaccggcaaacaaggcttcaacagcgcga

SEQ ID NO: 2762 - DNA, 36 bp, Artificial Sequence
  Synthetic oligonucleotide
aacaccacaccgccgctgatccggatggaacctcga

SEQ ID NO: 2763 - DNA, 35 bp, Artificial Sequence; identical to SEQ ID NO: 2733
  Synthetic oligonucleotide

SEQ ID NO: 2764 - DNA, 36 bp, Artificial Sequence
  Synthetic oligonucleotide
acacgtgccccaccaatatgcgataagactttgtta

SEQ ID NO: 2765 - DNA, 36 bp, Artificial Sequence
  Synthetic oligonucleotide
gacaccgaagacgaggctaaagagagaagtgccata

SEQ ID NO: 2766 - DNA, 35 bp, Artificial Sequence
  Synthetic oligonucleotide
atcgccgcacacctgccactcactcttccatcgct

SEQ ID NO: 2767 - DNA, 34 bp, Artificial Sequence; identical to SEQ ID NO: 2737
  Synthetic oligonucleotide

SEQ ID NO: 2768 - DNA, 36 bp, Artificial Sequence
  Synthetic oligonucleotide
gactaacgccgcttatcctcaacgcctaaccttgtt

SEQ ID NO: 2769 - DNA, 37 bp, Artificial Sequence
  Synthetic oligonucleotide
gagtggtcgcctgcaggtgcattccatccagctccga

SEQ ID NO: 2770 - DNA, 35 bp, Artificial Sequence
  Synthetic oligonucleotide
gtggaggctgcaatacggtgcaagagagcttaggg

SEQ ID NO: 2771 - DNA, 37 bp, Artificial Sequence
  Synthetic oligonucleotide
gtcaccgcatgcgggtcaagccctcaactttacttga

SEQ ID NO: 2772 - DNA, 37 bp, Artificial Sequence
  Synthetic oligonucleotide
taagtcgcgccccagtcagtgattgatacagatagga

SEQ ID NO: 2773 - DNA, 36 bp, Artificial Sequence
  Synthetic oligonucleotide
tcaacatgcgtgcaagtggcaccgttctcgtttcga

SEQ ID NO: 2774 - DNA, 34 bp, Artificial Sequence
  Synthetic oligonucleotide
tcttatttagcaagatcttttatctaaatacaat

SEQ ID NO: 2775 - DNA, 37 bp, Artificial Sequence; identical to SEQ ID NO: 2748
  Synthetic oligonucleotide

SEQ ID NO: 2776 - DNA, 37 bp, Artificial Sequence; identical to SEQ ID NO: 2749
  Synthetic oligonucleotide

SEQ ID NO: 2777 - DNA, 36 bp, Artificial Sequence; identical to SEQ ID NO: 2750
  Synthetic oligonucleotide

SEQ ID NO: 2778 - DNA, 37 bp, Artificial Sequence; identical to SEQ ID NO: 2752
  Synthetic oligonucleotide

SEQ ID NO: 2779 - DNA, 37 bp, Artificial Sequence; identical to SEQ ID NO: 2754
  Synthetic oligonucleotide

SEQ ID NO: 2780 - DNA, 37 bp, Artificial Sequence; identical to SEQ ID NO: 2755
  Synthetic oligonucleotide

SEQ ID NO: 2781 - DNA, 36 bp, Artificial Sequence
  Synthetic oligonucleotide
tacgcgggtggtcgaccccactagtagtcatccata

SEQ ID NO: 2782 - DNA, 36 bp, Artificial Sequence; identical to SEQ ID NO: 2756
  Synthetic oligonucleotide

SEQ ID NO: 2783 - DNA, 37 bp, Artificial Sequence; identical to SEQ ID NO: 2757
  Synthetic oligonucleotide

SEQ ID NO: 2784 - DNA, 36 bp, Artificial Sequence; identical to SEQ ID NO: 2758
  Synthetic oligonucleotide

SEQ ID NO: 2785 - DNA, 37 bp, Artificial Sequence; identical to SEQ ID NO: 2759
  Synthetic oligonucleotide

SEQ ID NO: 2786 - DNA, 37 bp, Artificial Sequence; identical to SEQ ID NO: 2760
  Synthetic oligonucleotide

SEQ ID NO: 2787 - DNA, 38 bp, Artificial Sequence
  Synthetic oligonucleotide
tccgaacgggacgtacaccaagccgagctctatcctga

SEQ ID NO: 2788 - DNA, 37 bp, Artificial Sequence; identical to SEQ ID NO: 2761
  Synthetic oligonucleotide

SEQ ID NO: 2789 - DNA, 36 bp, Artificial Sequence
  Synthetic oligonucleotide
accatcgggtcacgtaaaagcggttctaatttctaa

SEQ ID NO: 2790 - DNA, 35 bp, Artificial Sequence; identical to SEQ ID NO: 594
  Synthetic oligonucleotide

SEQ ID NO: 2791 - DNA, 36 bp, Artificial Sequence
  Synthetic oligonucleotide
gaacaggcgttccctactgatttatctgtccccata

SEQ ID NO: 2792 - DNA, 36 bp, Artificial Sequence
  Synthetic oligonucleotide
gaccatgcgagcggcaaagcacggaaaatgtttgaa

SEQ ID NO: 2793 - DNA, 38 bp, Artificial Sequence
  Synthetic oligonucleotide
gagtcatgtccgcctttaacccgacttaagaactttga

SEQ ID NO: 2794 - DNA, 38 bp, Artificial Sequence
  Synthetic oligonucleotide
gcaagatgaagttggtactttcctctctattcttttga

SEQ ID NO: 2795 - DNA, 37 bp, Artificial Sequence
  Synthetic oligonucleotide
gccacaccgcccgtacatacttcctcaccaacattga

SEQ ID NO: 2796 - DNA, 35 bp, Artificial Sequence
  Synthetic oligonucleotide
gcgcgcccaccagtatcttttggtctagataggca

SEQ ID NO: 2797 - DNA, 35 bp, Artificial Sequence
  Synthetic oligonucleotide
gggcccacgccaccgtttgtccacaggaaggatac

SEQ ID NO: 2798 - DNA, 37 bp, Artificial Sequence
  Synthetic oligonucleotide
gtgcggtcatggaattcttttaagcatgataatacga

SEQ ID NO: 2799 - DNA, 35 bp, Artificial Sequence
  Synthetic oligonucleotide
ttgcaaagcgcaccgtccgagccggtggcaccgaa

SEQ ID NO: 2800 - DNA, 37 bp, Artificial Sequence
  Synthetic oligonucleotide
ttcacgccacattcacgggaactgagagtgacgacga

SEQ ID NO: 2801 - DNA, 37 bp, Artificial Sequence
  Synthetic oligonucleotide
tttgcggtcattaacttgcgtgtaggacaccggtgga

SEQ ID NO: 2802 - DNA, 35 bp, Artificial Sequence
  Synthetic oligonucleotide
acgcagtgccgccgaatcctgatcccctaactttc

SEQ ID NO: 2803 - DNA, 35 bp, Artificial Sequence
  Synthetic oligonucleotide
aatgcgtccgacctaactgttgcgattcttctttt

SEQ ID NO: 2804 - DNA, 38 bp, Artificial Sequence
  Synthetic oligonucleotide
acacacaagtccatgcgggcctcacttttcgcctatga

SEQ ID NO: 2805 - DNA, 36 bp, Artificial Sequence
  Synthetic oligonucleotide
agtcccaactgcagggtttatacctctggttctctc

SEQ ID NO: 2806 - DNA, 36 bp, Artificial Sequence
  Synthetic oligonucleotide
gcacacgcccacattgtcctactagctattttatta

SEQ ID NO: 2807 - DNA, 38 bp, Artificial Sequence
  Synthetic oligonucleotide
gccgcccctgagtagttttcgtttttcttgtcctctga

SEQ ID NO: 2808 - DNA, 35 bp, Artificial Sequence
  Synthetic oligonucleotide
gcgatcgatatgttgcctatcctcttacgacatct

SEQ ID NO: 2809 - DNA, 35 bp, Artificial Sequence
  Synthetic oligonucleotide
gcgttgtccgtgtccatccatcttgtcatttgttt

SEQ ID NO: 2810 - DNA, 35 bp, Artificial Sequence
  Synthetic oligonucleotide
taacgtacaaccgggcgcacaggccattcttctac

SEQ ID NO: 2811 - DNA, 35 bp, Artificial Sequence
  Synthetic oligonucleotide
gttcggggtgcatgtcgtgaagccgctaacctctt

SEQ ID NO: 2812 - DNA, 38 bp, Artificial Sequence
  Synthetic oligonucleotide
tgctcagtcaagcgagtaccactacgcctattccgtga

SEQ ID NO: 2813 - DNA, 38 bp, Artificial Sequence
  Synthetic oligonucleotide
tgctaaacgtactggggcttcctcagatctttgcttga

SEQ ID NO: 2814 - DNA, 36 bp, Artificial Sequence
  Synthetic oligonucleotide
tgtacccccgccgtaatcatctatcttgtccccgaa

SEQ ID NO: 2815 - DNA, 35 bp, Artificial Sequence
  Synthetic oligonucleotide
accactgaactcatggtactaatcacacaccaatt

SEQ ID NO: 2816 - DNA, 37 bp, Artificial Sequence
  Synthetic oligonucleotide
actgtacagtagtccacgaacatatcgctttctatga

SEQ ID NO: 2817 - DNA, 38 bp, Artificial Sequence
  Synthetic oligonucleotide
accgcgcgctgcagtatatcccacttcgttctatatga

SEQ ID NO: 2818 - DNA, 35 bp, Artificial Sequence
  Synthetic oligonucleotide
agtggatcactgggcggagtgcgttaggaagacgg

SEQ ID NO: 2819 - DNA, 35 bp, Artificial Sequence
  Synthetic oligonucleotide
gattacgccttaagtggtactcagttatgaggaga

SEQ ID NO: 2820 - DNA, 37 bp, Artificial Sequence
  Synthetic oligonucleotide
gcgtaggtcatgcgacgtataaccttcccacaaatga

SEQ ID NO: 2821 - DNA, 37 bp, Artificial Sequence
  Synthetic oligonucleotide
tacaccaaaaagatcggtgattaccatgcaacaagga

SEQ ID NO: 2822 - DNA, 35 bp, Artificial Sequence
  Synthetic oligonucleotide
taccagacgtaccgcacacctttcatctgcctaac

SEQ ID NO: 2823 - DNA, 35 bp, Artificial Sequence
  Synthetic oligonucleotide
tttgagactgcgggctgtgcgttgctttgatatcc

SEQ ID NO: 2824 - DNA, 35 bp, Artificial Sequence
  Synthetic oligonucleotide
actgactgcatacatccgcatattaaacccgtatt

SEQ ID NO: 2825 - DNA, 36 bp, Artificial Sequence
  Synthetic oligonucleotide
acatctccaggattccccttcagccatggccctaca

SEQ ID NO: 2826 - DNA, 38 bp, Artificial Sequence
  Synthetic oligonucleotide
acgctcagctggcatgtaccccccctctctacacttga

SEQ ID NO: 2827 - DNA, 36 bp, Artificial Sequence
  Synthetic oligonucleotide
actcgcgtgtccaacacggactgcagtagcaatcca

SEQ ID NO: 2828 - DNA, 37 bp, Artificial Sequence
  Synthetic oligonucleotide
gcaggtggtgcaggttattcatgcgaaagggtactga

SEQ ID NO: 2829 - DNA, 36 bp, Artificial Sequence
  Synthetic oligonucleotide
gcggtggaaacgtaatcggacactgcgcatgcgaca

SEQ ID NO: 2830 - DNA, 36 bp, Artificial Sequence
  Synthetic oligonucleotide
tgaacctgcgatggtccgtgcgaacccgatctcaca

SEQ ID NO: 2831 - DNA, 35 bp, Artificial Sequence
  Synthetic oligonucleotide
tcacgtccccaacaacccggagtaattccctgcca

SEQ ID NO: 2832 - DNA, 35 bp, Artificial Sequence
  Synthetic oligonucleotide
tgggtacacatccggcatgccaataacgcttaagt

SEQ ID NO: 2833 - DNA, 35 bp, Artificial Sequence
  Synthetic oligonucleotide
acgcctgtacgatgtcctcggtctcattttatttc

SEQ ID NO: 2834 - DNA, 35 bp, Artificial Sequence
  Synthetic oligonucleotide
aaacgtcaagggaaagcgtagtctcctcgaccctt

SEQ ID NO: 2835 - DNA, 36 bp, Artificial Sequence
  Synthetic oligonucleotide
actgggaagtacgctgtcaggcatttgctaactaaa

SEQ ID NO: 2836 - DNA, 35 bp, Artificial Sequence
  Synthetic oligonucleotide
aatcattgcaggtatatgcgagcgaactacgattc

SEQ ID NO: 2837 - DNA, 35 bp, Artificial Sequence
  Synthetic oligonucleotide
atacgttccggccaactgaaacggagttcgggtct

SEQ ID NO: 2838 - DNA, 36 bp, Artificial Sequence
  Synthetic oligonucleotide
atgcatagctgcccttcttatccgtttccaactaca

SEQ ID NO: 2839 - DNA, 38 bp, Artificial Sequence
  Synthetic oligonucleotide
atgcgaaactgtaagcacccttccaccttgtaccatga

SEQ ID NO: 2840 - DNA, 38 bp, Artificial Sequence
  Synthetic oligonucleotide
gacgccgaaacactaagcttttaacacttacgatatga

SEQ ID NO: 2841 - DNA, 35 bp, Artificial Sequence
  Synthetic oligonucleotide
attatcccagcgatcccgagtcccggcatttactg

SEQ ID NO: 2842 - DNA, 36 bp, Artificial Sequence
  Synthetic oligonucleotide
catgcgcatatcgctccgttcgttcctcaatttcca

SEQ ID NO: 2843 - DNA, 38 bp, Artificial Sequence
  Synthetic oligonucleotide
gcccgaacccgaaaaccgatcgcctgaatcccaattga

SEQ ID NO: 2844 - DNA, 35 bp, Artificial Sequence
  Synthetic oligonucleotide
gcaggctcgcgtagcttcaaactagcagaccacgt

SEQ ID NO: 2845 - DNA, 38 bp, Artificial Sequence
  Synthetic oligonucleotide
gcacgggacgcaagctagactacacaccgactttttga

SEQ ID NO: 2846 - DNA, 38 bp, Artificial Sequence
  Synthetic oligonucleotide
gctggcactgcgaatatcgatctacactatcccactga

SEQ ID NO: 2847 - DNA, 36 bp, Artificial Sequence
  Synthetic oligonucleotide
gctagcacacaggatccctctttattagcacttcaa

SEQ ID NO: 2848 - DNA, 35 bp, Artificial Sequence
  Synthetic oligonucleotide
tatgcgacccgttaaacccgtactcttcctaaact

SEQ ID NO: 2849 - DNA, 38 bp, Artificial Sequence
  Synthetic oligonucleotide
tagtcatgcgcgcatctcaaaatttacttctcaaatga

SEQ ID NO: 2850 - DNA, 38 bp, Artificial Sequence
  Synthetic oligonucleotide
tctacactccgctccttgacctaatttaaagaccttga

SEQ ID NO: 2851 - DNA, 35 bp, Artificial Sequence
  Synthetic oligonucleotide
tcgcggaaacctgcccctgcatcgtagccatccac

SEQ ID NO: 2852 - DNA, 36 bp, Artificial Sequence
  Synthetic oligonucleotide
ttcaccaccacccctttggacccttttaccgagaga

SEQ ID NO: 2853 - DNA, 36 bp, Artificial Sequence
  Synthetic oligonucleotide
ttgcagacctcatttacgcacttgggacttctgcca

SEQ ID NO: 2854 - DNA, 37 bp, Artificial Sequence
  Synthetic oligonucleotide
ttggcacctccactgcttgttctcgattcatgtgcga

SEQ ID NO: 2855 - DNA, 35 bp, Artificial Sequence
  Synthetic oligonucleotide
actgcggtcatcgagttactggctattgcctgacc

SEQ ID NO: 2856 - DNA, 36 bp, Artificial Sequence
  Synthetic oligonucleotide
cccgcggtaatagtgcgggcggacgcggtcatgaca

SEQ ID NO: 2857 - DNA, 36 bp, Artificial Sequence
  Synthetic oligonucleotide
gaacgtagactgactacggtccacacgcccattgta

SEQ ID NO: 2858 - DNA, 35 bp, Artificial Sequence
  Synthetic oligonucleotide
ccaacgacagatatggacgtgctgcgggggcaatc

SEQ ID NO: 2859 - DNA, 35 bp, Artificial Sequence
  Synthetic oligonucleotide
atgcgatgtcacgtgacgtgagtaaccgcccaccc

SEQ ID NO: 2860 - DNA, 35 bp, Artificial Sequence
  Synthetic oligonucleotide
gcccacccttgccagcatgtatgcttgcatgtaac

SEQ ID NO: 2861 - DNA, 35 bp, Artificial Sequence
  Synthetic oligonucleotide
gccggtcatgcggtttgcacaccactccattctac

SEQ ID NO: 2862 - DNA, 36 bp, Artificial Sequence
  Synthetic oligonucleotide
gccaggcccattccttgcgggaggttaacaccagca

SEQ ID NO: 2863 - DNA, 36 bp, Artificial Sequence; identical to SEQ ID NO: 2829
  Synthetic oligonucleotide

SEQ ID NO: 2864 - DNA, 37 bp, Artificial Sequence
  Synthetic oligonucleotide
gtttcaccccggctgggctagttctgttaatgcgaga

SEQ ID NO: 2865 - DNA, 36 bp, Artificial Sequence
  Synthetic oligonucleotide
tgtaccgcggttgcgactatttccttactgcccata

SEQ ID NO: 2866 - DNA, 35 bp, Artificial Sequence
  Synthetic oligonucleotide
ttcgcgacgataactagttgcatgtctgaattcac

SEQ ID NO: 2867 - DNA, 37 bp, Artificial Sequence
  Synthetic oligonucleotide
tgtcactgcacgatgagactttcggcgaatatactga

SEQ ID NO: 2868 - DNA, 36 bp, Artificial Sequence
  Synthetic oligonucleotide
aatgcattgcgttatttcaattgaggcgtcctaaaa

SEQ ID NO: 2869 - DNA, 38 bp, Artificial Sequence
  Synthetic oligonucleotide
gcactgccaactttcttctggggactatttagctttga

SEQ ID NO: 2870 - DNA, 36 bp, Artificial Sequence
  Synthetic oligonucleotide
ggtaccaaaagtactgccatgagagccacttcccaa

SEQ ID NO: 2871 - DNA, 35 bp, Artificial Sequence
  Synthetic oligonucleotide
catacgcacggtcctctactataattgtccaccaa

SEQ ID NO: 2872 - DNA, 35 bp, Artificial Sequence
  Synthetic oligonucleotide
atgctgcggtaatggagccggttcttaaactgcct

SEQ ID NO: 2873 - DNA, 36 bp, Artificial Sequence
  Synthetic oligonucleotide
agttactgacaggcgcgtctttcgcaacactttata

SEQ ID NO: 2874 - DNA, 35 bp, Artificial Sequence
  Synthetic oligonucleotide
gcacccgagcctaatagtcctctattccccttcca

SEQ ID NO: 2875 - DNA, 36 bp, Artificial Sequence
  Synthetic oligonucleotide
gcgagcagtccatggcccatcctcgacttaacctca

SEQ ID NO: 2876 - DNA, 36 bp, Artificial Sequence
  Synthetic oligonucleotide
ggtagcaggcataccctacggaacagttctgtggca

SEQ ID NO: 2877 - DNA, 36 bp, Artificial Sequence
  Synthetic oligonucleotide
taggcacgtgcatcaggcgttctttgcccctgttta

SEQ ID NO: 2878 - DNA, 35 bp, Artificial Sequence
  Synthetic oligonucleotide
tgtgcagtcagtgaacggtgacctagttatgattt

SEQ ID NO: 2879 - DNA, 38 bp, Artificial Sequence
  Synthetic oligonucleotide
agcccgttgctacgttgcagtaggtgtaacttcactga

SEQ ID NO: 2880 - DNA, 38 bp, Artificial Sequence
  Synthetic oligonucleotide
actaactgcaagcgcccttggcccgatttgacctttga

SEQ ID NO: 2881 - DNA, 35 bp, Artificial Sequence
  Synthetic oligonucleotide
actaccgcaaactgcactgtttaaaactccttgaa

SEQ ID NO: 2882 - DNA, 35 bp, Artificial Sequence
  Synthetic oligonucleotide
acgactatcgtacatgtgcgtagtttagattccaa

SEQ ID NO: 2883 - DNA, 37 bp, Artificial Sequence
  Synthetic oligonucleotide
agttgaccacggagtgtactgcaatggagtgtaccga

SEQ ID NO: 2884 - DNA, 36 bp, Artificial Sequence
  Synthetic oligonucleotide
gaacgagcccggatgttaggatcctcgatttgcgta

SEQ ID NO: 2885 - DNA, 35 bp, Artificial Sequence
  Synthetic oligonucleotide
agtgctgccactaagctagaaaagttttcatgccc

SEQ ID NO: 2886 - DNA, 36 bp, Artificial Sequence
  Synthetic oligonucleotide
atcgtaacggactgctatttgtacggatccctataa

SEQ ID NO: 2887 - DNA, 38 bp, Artificial Sequence
  Synthetic oligonucleotide
gcagtctagcgcccgcttgtaccacatcctcgctttga

SEQ ID NO: 2888 - DNA, 35 bp, Artificial Sequence
  Synthetic oligonucleotide
tgtactgagtgcacaacacgtgatgatgatatctt

SEQ ID NO: 2889 - DNA, 36 bp, Artificial Sequence
  Synthetic oligonucleotide
agcggtcaccgcctatggttattcatttttctctta

SEQ ID NO: 2890 - DNA, 35 bp, Artificial Sequence
  Synthetic oligonucleotide
actcagcgatgccctaacttggacgttcggctact

SEQ ID NO: 2891 - DNA, 35 bp, Artificial Sequence
  Synthetic oligonucleotide
cacaccgacgaaactgtcctcgcctactacctatc

SEQ ID NO: 2892 - DNA, 35 bp, Artificial Sequence
  Synthetic oligonucleotide
agtgaggcgtcacggctattactccgtgctaattt

SEQ ID NO: 2893 - DNA, 35 bp, Artificial Sequence; identical to SEQ ID NO: 2871
  Synthetic oligonucleotide

SEQ ID NO: 2894 - DNA, 35 bp, Artificial Sequence
  Synthetic oligonucleotide
gaaacggccatgaaccttttaatctttccaccttt

SEQ ID NO: 2895 - DNA, 36 bp, Artificial Sequence
  Synthetic oligonucleotide
gcgagaggatcaccgtgaggcttcccaactatttta

SEQ ID NO: 2896 - DNA, 35 bp, Artificial Sequence
  Synthetic oligonucleotide
gcgaggcgccctccaacccaacccattcaatggta

SEQ ID NO: 2897 - DNA, 35 bp, Artificial Sequence
  Synthetic oligonucleotide
gcgcagtccgtccacatttggtctactgctttcct

SEQ ID NO: 2898 - DNA, 35 bp, Artificial Sequence
  Synthetic oligonucleotide
gtgcgcctacatatatctcggttacaacctttttc

SEQ ID NO: 2899 - DNA, 35 bp, Artificial Sequence
  Synthetic oligonucleotide
tgcatcccaccactatgatatacctaatgccctct

SEQ ID NO: 2900 - DNA, 36 bp, Artificial Sequence
  Synthetic oligonucleotide
tgcaggccgcatcacctcttgtgccggttcatcaaa

SEQ ID NO: 2901 - DNA, 38 bp, Artificial Sequence
  Synthetic oligonucleotide
tgcgaggctagcttgttgccactatttggtccttatga

SEQ ID NO: 2902 - DNA, 38 bp, Artificial Sequence; identical to SEQ ID NO: 2879
  Synthetic oligonucleotide

SEQ ID NO: 2903 - DNA, 35 bp, Artificial Sequence
  Synthetic oligonucleotide
agggcaacgaacgcaggaatccctcattcctacgg

SEQ ID NO: 2904 - DNA, 35 bp, Artificial Sequence; identical to SEQ ID NO: 2885
  Synthetic oligonucleotide

SEQ ID NO: 2905 - DNA, 35 bp, Artificial Sequence
  Synthetic oligonucleotide
atcctcgttacgtgcacggacttctcatgcgaact

SEQ ID NO: 2906 - DNA, 36 bp, Artificial Sequence
  Synthetic oligonucleotide
gcccaggtttgacgactgccgtgcgctcggtcttaa

SEQ ID NO: 2907 - DNA, 37 bp, Artificial Sequence
  Synthetic oligonucleotide
ggtcatggcgcaacttcatcttttcacacctgattga

SEQ ID NO: 2908 - DNA, 36 bp, Artificial Sequence; identical to SEQ ID NO: 2876
  Synthetic oligonucleotide

SEQ ID NO: 2909 - DNA, 35 bp, Artificial Sequence
  Synthetic oligonucleotide
tcccgcaattacgcagaccgactacgattccaaaa

SEQ ID NO: 2910 - DNA, 38 bp, Artificial Sequence
  Synthetic oligonucleotide
tgtacgtaggtaagcgatacacactgcacccctactga

SEQ ID NO: 2911 - DNA, 35 bp, Artificial Sequence
  Synthetic oligonucleotide
tgacctctgcagtggccagcccattctttagcttc

SEQ ID NO: 2912 - DNA, 35 bp, Artificial Sequence
  Synthetic oligonucleotide
ttactgcaggtgcgatcgcgttctccaacatctct

SEQ ID NO: 2913 - DNA, 37 bp, Artificial Sequence
  Synthetic oligonucleotide
accacgttggttattgccctgctttgaagtcttacga

SEQ ID NO: 2914 - DNA, 36 bp, Artificial Sequence
  Synthetic oligonucleotide
aacacactgcgcctttactttaattttcgattatta

SEQ ID NO: 2915 - DNA, 35 bp, Artificial Sequence
  Synthetic oligonucleotide
agcaccgacgtgataggactgtaatgccctcctct

SEQ ID NO: 2916 - DNA, 35 bp, Artificial Sequence
  Synthetic oligonucleotide
atgcgcgagtcataaggcgtttcttttcactggct

SEQ ID NO: 2917 - DNA, 35 bp, Artificial Sequence
  Synthetic oligonucleotide
atgcgacatgcgttacaataatccgcgcaagccgc

SEQ ID NO: 2918 - DNA, 35 bp, Artificial Sequence
  Synthetic oligonucleotide
gagtgcgcgtacaatttgtcctcttgccgcttttt

SEQ ID NO: 2919 - DNA, 35 bp, Artificial Sequence
  Synthetic oligonucleotide
taagtcatgggcctcatctatacctgatcgatctc

SEQ ID NO: 2920 - DNA, 36 bp, Artificial Sequence
  Synthetic oligonucleotide
tcaggcgggatatgcgctcagggaagcggggagcaa

SEQ ID NO: 2921 - DNA, 37 bp, Artificial Sequence
  Synthetic oligonucleotide
tgagctcgacctgccgtcgtacaatttcccttactga

SEQ ID NO: 2922 - DNA, 36 bp, Artificial Sequence
  Synthetic oligonucleotide
ggggttgttttgggatgcctttttctctgtatttca

SEQ ID NO: 2923 - DNA, 37 bp, Artificial Sequence
  Synthetic oligonucleotide
gtcctcgcccgggcttctgtttgttttttggattcga

SEQ ID NO: 2924 - DNA, 38 bp, Artificial Sequence
  Synthetic oligonucleotide
aacgcttgatttgggtggttggattgacctttttatga

SEQ ID NO: 2925 - DNA, 35 bp, Artificial Sequence
  Synthetic oligonucleotide
ttttttattgggtgcgcataggcgagtggtctctt

SEQ ID NO: 2926 - DNA, 35 bp, Artificial Sequence
  Synthetic oligonucleotide
tgattacatcgcctgtatgggttgttgtttgtgtc

SEQ ID NO: 2927 - DNA, 89 bp, Artificial Sequence
  Synthetic oligonucleotide
tcgtcggcagcgtcagatgtgtataagagacagtgaaatacagagaaaaaggcatcccaaaacaaccccacgtactgcagtcatgctag

SEQ ID NO: 2928 - DNA, 91 bp, Artificial Sequence
  Synthetic oligonucleotide
tcgtcggcagcgtcagatgtgtataagagacagtcataaaaaggtcaatccaaccacccaaatcaagcgttacgtactgcagtcatgctag

SEQ ID NO: 2929 - DNA, 35 bp, Artificial Sequence
  Synthetic oligonucleotide
ggttttatcgtttctttagttgggttcttgggtga

SEQ ID NO: 2930 - DNA, 35 bp, Artificial Sequence
  Synthetic oligonucleotide
ggatcttggttagtatttttggtattttctgtggt

SEQ ID NO: 2931 - DNA, 35 bp, Artificial Sequence
  Synthetic oligonucleotide
ggatgctggttagtatttttggtattttctgtggt

SEQ ID NO: 2932 - DNA, 37 bp, Artificial Sequence
  Synthetic oligonucleotide
tatttaggggttgtgggtctaatttttgtttgttcga

SEQ ID NO: 2933 - DNA, 38 bp, Artificial Sequence
  Synthetic oligonucleotide
tcctggtttctggtggtttcatttagcttgttacctga

SEQ ID NO: 2934 - DNA, 38 bp, Artificial Sequence
  Synthetic oligonucleotide
tcctggtttctggtggtttaattttgcttgttacatga

SEQ ID NO: 2935 - DNA, 38 bp, Artificial Sequence
  Synthetic oligonucleotide
tcctggtttctggtggtttcattttgattgttacctga

SEQ ID NO: 2936 - DNA, 38 bp, Artificial Sequence
  Synthetic oligonucleotide
tttggttggtccatgggtaagcttggtgattctcttga

SEQ ID NO: 2937 - DNA, 38 bp, Artificial Sequence
  Synthetic oligonucleotide
tcctggtttctggtggtttcattttgcttgttacatga

SEQ ID NO: 2938 - DNA, 35 bp, Artificial Sequence
  Synthetic oligonucleotide
acatgcactgagcccgacacacccgcctgaactat

SEQ ID NO: 2939 - DNA, 35 bp, Artificial Sequence
  Synthetic oligonucleotide
actaattgttttgggggtagttgttttttttctgt

SEQ ID NO: 2940 - DNA, 35 bp, Artificial Sequence
  Synthetic oligonucleotide
ggatcctggttagtatttttggtatattctgtggt

SEQ ID NO: 2941 - DNA, 36 bp, Artificial Sequence
  Synthetic oligonucleotide
tatgttctttttattttagtggttgtggcctatcta

SEQ ID NO: 2942 - DNA, 35 bp, Artificial Sequence; identical to SEQ ID NO: 2929
  Synthetic oligonucleotide

SEQ ID NO: 2943 - DNA, 37 bp, Artificial Sequence; identical to SEQ ID NO: 2932
  Synthetic oligonucleotide

SEQ ID NO: 2944 - DNA, 38 bp, Artificial Sequence; identical to SEQ ID NO: 2933
  Synthetic oligonucleotide

SEQ ID NO: 2945 - DNA, 38 bp, Artificial Sequence; identical to SEQ ID NO: 2937
  Synthetic oligonucleotide

SEQ ID NO: 2946 - DNA, 35 bp, Artificial Sequence; identical to SEQ ID NO: 2938
  Synthetic oligonucleotide

SEQ ID NO: 2947 - DNA, 35 bp, Artificial Sequence; identical to SEQ ID NO: 2940
  Synthetic oligonucleotide

SEQ ID NO: 2948 - DNA, 88 bp, Artificial Sequence
  Synthetic oligonucleotide
tcgtcggcagcgtcagatgtgtataagagacagtcacccaagaacccaactaaagaaacgataaaaccacgtactgcagtcatgctag

SEQ ID NO: 2949 - DNA, 91 bp, Artificial Sequence
  Synthetic oligonucleotide
tcgtcggcagcgtcagatgtgtataagagacagtcaggtaacaagctaaatgaaaccaccagaaaccaggaacgtactgcagtcatgctag

SEQ ID NO: 2950 - DNA, 36 bp, Artificial Sequence
  Synthetic oligonucleotide
agttcttgggggttttggttggtgccttgtatgtta

SEQ ID NO: 2951 - DNA, 36 bp, Artificial Sequence
  Synthetic oligonucleotide
agttcttgggggttttggttgttgccttgtctatta

SEQ ID NO: 2952 - DNA, 37 bp, Artificial Sequence
  Synthetic oligonucleotide
ttgccgccctttatggtttgttttttgcgatgtggga

SEQ ID NO: 2953 - DNA, 38 bp, Artificial Sequence
  Synthetic oligonucleotide
atatggggtttatggggatggtgttatgggtggaatga

SEQ ID NO: 2954 - DNA, 35 bp, Artificial Sequence
  Synthetic oligonucleotide
atggggaggggggtaggctgtcttaattggtggtt

SEQ ID NO: 2955 - DNA, 38 bp, Artificial Sequence
  Synthetic oligonucleotide
attaatgggtggggggtttagcttgatgtgggttgtga

SEQ ID NO: 2956 - DNA, 35 bp, Artificial Sequence
  Synthetic oligonucleotide
gaatggggggatactgttagtgtgggtctgggggt

SEQ ID NO: 2957 - DNA, 35 bp, Artificial Sequence
  Synthetic oligonucleotide
ggggggggctttttatggtttctgggggacctgct

SEQ ID NO: 2958 - DNA, 36 bp, Artificial Sequence
  Synthetic oligonucleotide
ggtgatgaattaaatggggggggtatcaagtgtgga

SEQ ID NO: 2959 - DNA, 35 bp, Artificial Sequence
  Synthetic oligonucleotide
tacttaattggggggggggattctgttttgtctct

SEQ ID NO: 2960 - DNA, 38 bp, Artificial Sequence
  Synthetic oligonucleotide
tagcctttgggggttgttttgggggattgggttgttga

SEQ ID NO: 2961 - DNA, 38 bp, Artificial Sequence
  Synthetic oligonucleotide
tagtgactacgggtatggggattgggggtttggtttga

SEQ ID NO: 2962 - DNA, 91 bp, Artificial Sequence
  Synthetic oligonucleotide
tcgtcggcagcgtcagatgtgtataagagacagtcattccacccataacaccatccccataaaccccatatacgtactgcagtcatgctag

SEQ ID NO: 2963 - DNA, 88 bp, Artificial Sequence
  Synthetic oligonucleotide
tcgtcggcagcgtcagatgtgtataagagacagaaccaccaattaagacagcctacccccctccccatacgtactgcagtcatgctag

SEQ ID NO: 2964 - DNA, 91 bp, Artificial Sequence
  Synthetic oligonucleotide
tcgtcggcagcgtcagatgtgtataagagacagtcacaacccacatcaagctaaaccccccacccattaatacgtactgcagtcatgctag

SEQ ID NO: 2965 - DNA, 88 bp, Artificial Sequence
  Synthetic oligonucleotide
tcgtcggcagcgtcagatgtgtataagagacagacccccagacccacactaacagtatccccccattcacgtactgcagtcatgctag

SEQ ID NO: 2966 - DNA, 88 bp, Artificial Sequence
  Synthetic oligonucleotide
tcgtcggcagcgtcagatgtgtataagagacagagcaggtcccccagaaaccataaaaagccccccccacgtactgcagtcatgctag

SEQ ID NO: 2967 - DNA, 89 bp, Artificial Sequence
  Synthetic oligonucleotide
tcgtcggcagcgtcagatgtgtataagagacagtccacacttgataccccccccatttaattcatcaccacgtactgcagtcatgctag

SEQ ID NO: 2968 - DNA, 88 bp, Artificial Sequence
  Synthetic oligonucleotide
tcgtcggcagcgtcagatgtgtataagagacagagagacaaaacagaatccccccccccaattaagtaacgtactgcagtcatgctag

SEQ ID NO: 2969 - DNA, 91 bp, Artificial Sequence
  Synthetic oligonucleotide
tcgtcggcagcgtcagatgtgtataagagacagtcaacaacccaatcccccaaaacaacccccaaaggctaacgtactgcagtcatgctag

SEQ ID NO: 2970 - DNA, 91 bp, Artificial Sequence
  Synthetic oligonucleotide
tcgtcggcagcgtcagatgtgtataagagacagtcaaaccaaacccccaatccccatacccgtagtcactaacgtactgcagtcatgctag

SEQ ID NO: 2971 - DNA, 35 bp, Artificial Sequence
  Synthetic oligonucleotide
tccgtttatctacttttccggtactgttcccgttt

SEQ ID NO: 2972 - DNA, 35 bp, Artificial Sequence
  Synthetic oligonucleotide
atcgcgtcgcccccggatattattgtttcttgttc

SEQ ID NO: 2973 - DNA, 36 bp, Artificial Sequence
  Synthetic oligonucleotide
ttgcttgcccggccataaacacgatcttgttctcta

SEQ ID NO: 2974 - DNA, 38 bp, Artificial Sequence
  Synthetic oligonucleotide
gatacggtctttggtgcttgtgtgaatctatggggtga

SEQ ID NO: 2975 - DNA, 37 bp, Artificial Sequence
  Synthetic oligonucleotide
tcctggtttctggtggtttatttagcttgttacctga

SEQ ID NO: 2976 - DNA, 38 bp, Artificial Sequence
  Synthetic oligonucleotide
agtgggtggtgggttcggtttgcttggttccctgttga

SEQ ID NO: 2977 - DNA, 35 bp, Artificial Sequence
  Synthetic oligonucleotide
attgaggtggttttgaggtgggctatctgagggat

SEQ ID NO: 2978 - DNA, 35 bp, Artificial Sequence; identical to SEQ ID NO: 2957
  Synthetic oligonucleotide

SEQ ID NO: 2979 - DNA, 38 bp, Artificial Sequence
  Synthetic oligonucleotide
atatggggtttatggggatggtgttatgggtggaatgt

SEQ ID NO: 2980 - DNA, 88 bp, Artificial Sequence
  Synthetic oligonucleotide
tcgtcggcagcgtcagatgtgtataagagacagaaacgggaacagtaccggaaaagtagataaacggaacgtactgcagtcatgctag

SEQ ID NO: 2981 - DNA, 88 bp, Artificial Sequence
  Synthetic oligonucleotide
tcgtcggcagcgtcagatgtgtataagagacaggaacaagaaacaataatatccgggggcgacgcgatacgtactgcagtcatgctag

SEQ ID NO: 2982 - DNA, 89 bp, Artificial Sequence
  Synthetic oligonucleotide
tcgtcggcagcgtcagatgtgtataagagacagtagagaacaagatcgtgtttatggccgggcaagcaaacgtactgcagtcatgctag

SEQ ID NO: 2983 - DNA, 91 bp, Artificial Sequence
  Synthetic oligonucleotide
tcgtcggcagcgtcagatgtgtataagagacagtcaccccatagattcacacaagcaccaaagaccgtatcacgtactgcagtcatgctag

SEQ ID NO: 2984 - DNA, 90 bp, Artificial Sequence
  Synthetic oligonucleotide
tcgtcggcagcgtcagatgtgtataagagacagtcaggtaacaagctaaataaaccaccagaaaccaggaacgtactgcagtcatgctag

SEQ ID NO: 2985 - DNA, 91 bp, Artificial Sequence
  Synthetic oligonucleotide
tcgtcggcagcgtcagatgtgtataagagacagtcaacagggaaccaagcaaaccgaacccaccacccactacgtactgcagtcatgctag

SEQ ID NO: 2986 - DNA, 88 bp, Artificial Sequence
  Synthetic oligonucleotide
tcgtcggcagcgtcagatgtgtataagagacagatccctcagatagcccacctcaaaaccacctcaatacgtactgcagtcatgctag

SEQ ID NO: 2987 - DNA, 88 bp, Artificial Sequence; identical to SEQ ID NO: 2966
  Synthetic oligonucleotide

SEQ ID NO: 2988 - DNA, 91 bp, Artificial Sequence
  Synthetic oligonucleotide
tcgtcggcagcgtcagatgtgtataagagacagacattccacccataacaccatccccataaaccccatatacgtactgcagtcatgctag

SEQ ID NO: 2989 - DNA, 35 bp, Artificial Sequence
  Synthetic oligonucleotide
cactgcaggcctcagcacgtacctctataaccgcc

SEQ ID NO: 2990 - DNA, 35 bp, Artificial Sequence
  Synthetic oligonucleotide
ttgacccacccccctcgacgcacgggcctgacctg

SEQ ID NO: 2991 - DNA, 35 bp, Artificial Sequence
  Synthetic oligonucleotide
cccgacagaggtgtatccctacgttcgatctaacc

SEQ ID NO: 2992 - DNA, 36 bp, Artificial Sequence
  Synthetic oligonucleotide
gcccccatcgcgctccccttgggtgcccatagacta

SEQ ID NO: 2993 - DNA, 35 bp, Artificial Sequence
  Synthetic oligonucleotide
atgcgcccgccctactatgcgtcttatcccggccc

SEQ ID NO: 2994 - DNA, 35 bp, Artificial Sequence
  Synthetic oligonucleotide
cctaaccgcaccgtttgttcctttgtgcttatcgg

SEQ ID NO: 2995 - DNA, 35 bp, Artificial Sequence
  Synthetic oligonucleotide
tacaccggcgcaccctctgcatcgcttccctgcct

SEQ ID NO: 2996 - DNA, 35 bp, Artificial Sequence
  Synthetic oligonucleotide
tccagcctaccttccgccgccatcaccgacgccca

SEQ ID NO: 2997 - DNA, 36 bp, Artificial Sequence
  Synthetic oligonucleotide
ttggcagtcccctctcatccttgctatccgacgtta

SEQ ID NO: 2998 - DNA, 38 bp, Artificial Sequence
  Synthetic oligonucleotide
tccgcctccaccgccacgtgtcttagatgtgttcgtga

SEQ ID NO: 2999 - DNA, 35 bp, Artificial Sequence
  Synthetic oligonucleotide
gacgcccacctgccgttaacccgtaccatcccgaa

SEQ ID NO: 3000 - DNA, 37 bp, Artificial Sequence
  Synthetic oligonucleotide
gtgcccaccaccgttctgtctccccagccgtacccga

SEQ ID NO: 3001 - DNA, 36 bp, Artificial Sequence
  Synthetic oligonucleotide
tgtgccccccgctcgtcacggtcgtaaccacctgca

SEQ ID NO: 3002 - DNA, 36 bp, Artificial Sequence
  Synthetic oligonucleotide
accatccccgcagcgcaaccctcaccgagcgcacca

SEQ ID NO: 3003 - DNA, 35 bp, Artificial Sequence
  Synthetic oligonucleotide
ggtggaggggggtagggttggtcggtaaggcgcgc

SEQ ID NO: 3004 - DNA, 35 bp, Artificial Sequence
  Synthetic oligonucleotide
cccacccagctcccgatattcgtgctcctgctgcc

SEQ ID NO: 3005 - DNA, 36 bp, Artificial Sequence
  Synthetic oligonucleotide
ggccaacgcaccccccgccatcgtcacgaactggca

SEQ ID NO: 3006 - DNA, 35 bp, Artificial Sequence
  Synthetic oligonucleotide
ccccccgccgtggctttatcgcggccctgaccctt

SEQ ID NO: 3007 - DNA, 35 bp, Artificial Sequence
  Synthetic oligonucleotide
ccagccacgcctgtcaccttcccgaatgcagagcc

SEQ ID NO: 3008 - DNA, 35 bp, Artificial Sequence
  Synthetic oligonucleotide
cccaccctaccttttccaccgagaccacgctatgc

SEQ ID NO: 3009 - DNA, 35 bp, Artificial Sequence
  Synthetic oligonucleotide
cgcgcccactccccgcacagaacaaggacccgctt

SEQ ID NO: 3010 - DNA, 35 bp, Artificial Sequence
  Synthetic oligonucleotide
gaccacccccctgtacgcatccccgcctgcgaacg

SEQ ID NO: 3011 - DNA, 35 bp, Artificial Sequence
  Synthetic oligonucleotide
ccgtaagcacgccgtgtcacgctcattgcccttcc

SEQ ID NO: 3012 - DNA, 37 bp, Artificial Sequence
  Synthetic oligonucleotide
cccttccccagggccttcacacggtcgtactacacga

SEQ ID NO: 3013 - DNA, 35 bp, Artificial Sequence
  Synthetic oligonucleotide
accacacttgcccacgaccgtgcctccgcccatcc

SEQ ID NO: 3014 - DNA, 37 bp, Artificial Sequence
  Synthetic oligonucleotide
ccaacccacccgtacacgaacccattcagccagggga

SEQ ID NO: 3015 - DNA, 35 bp, Artificial Sequence
  Synthetic oligonucleotide
cacccgccccgttcctctgttacacacccgccatc

SEQ ID NO: 3016 - DNA, 35 bp, Artificial Sequence
  Synthetic oligonucleotide
ccatgcctgcccccccaggacccccccgacgtgca

SEQ ID NO: 3017 - DNA, 34 bp, Artificial Sequence
  Synthetic oligonucleotide
accgcgccccgaacacgcggtcgacctgggtgtc

SEQ ID NO: 3018 - DNA, 37 bp, Artificial Sequence
  Synthetic oligonucleotide
gcgaagcacccagccctgcccaccaccgcaaccgcga

SEQ ID NO: 3019 - DNA, 35 bp, Artificial Sequence
  Synthetic oligonucleotide
cgcatccgcacctctccgccgcacgacctcatcgt

SEQ ID NO: 3020 - DNA, 35 bp, Artificial Sequence
  Synthetic oligonucleotide
ttgcccccccgcactgtcgcacatcccgcccctcg

SEQ ID NO: 3021 - DNA, 37 bp, Artificial Sequence
  Synthetic oligonucleotide
tccaccgccccgccttttgttaccaccgcatccccga

SEQ ID NO: 3022 - DNA, 35 bp, Artificial Sequence
  Synthetic oligonucleotide
gtcgcccccctgacgctgacttccaccccgccccg

SEQ ID NO: 3023 - DNA, 35 bp, Artificial Sequence
  Synthetic oligonucleotide
tacacccactgcgggcacccccaccgttacctgcc

SEQ ID NO: 3024 - DNA, 35 bp, Artificial Sequence
  Synthetic oligonucleotide
tgccaaccagcgtgtacaatcggattcgctgtctc

SEQ ID NO: 3025 - DNA, 35 bp, Artificial Sequence
  Synthetic oligonucleotide
gcgacaccccagattcgcctcggcacccccacccg

SEQ ID NO: 3026 - DNA, 35 bp, Artificial Sequence
  Synthetic oligonucleotide
cccgcccactccgttacgggcacacctccactgtc

SEQ ID NO: 3027 - DNA, 36 bp, Artificial Sequence
  Synthetic oligonucleotide
gaaggggctgcaatggggtgggagggcgctttgcct

SEQ ID NO: 3028 - DNA, 35 bp, Artificial Sequence
  Synthetic oligonucleotide
gacaaatcattgtccgggcccaatcactattcgtg

SEQ ID NO: 3029 - DNA, 35 bp, Artificial Sequence
  Synthetic oligonucleotide
accccccgcgcccatcccgtttttttagtaccgca

SEQ ID NO: 3030 - DNA, 35 bp, Artificial Sequence
  Synthetic oligonucleotide
acccacccccacccccctagacagggcctggacgc

SEQ ID NO: 3031 - DNA, 38 bp, Artificial Sequence
  Synthetic oligonucleotide
accccccgcaaccatcgccccgtaagccctgcccttga

SEQ ID NO: 3032 - DNA, 38 bp, Artificial Sequence
  Synthetic oligonucleotide
tcaccctacccccaaccctgcctcggagacctgcttga

SEQ ID NO: 3033 - DNA, 35 bp, Artificial Sequence
  Synthetic oligonucleotide
cacccatcctgccgccagcctatcgcccattatgc

SEQ ID NO: 3034 - DNA, 35 bp, Artificial Sequence
  Synthetic oligonucleotide
tccagccccgcccatccgccatgaacgatcccatc

SEQ ID NO: 3035 - DNA, 37 bp, Artificial Sequence
  Synthetic oligonucleotide
ccaggaccgccctcaccgaccatttagcatcccctga

SEQ ID NO: 3036 - DNA, 34 bp, Artificial Sequence
  Synthetic oligonucleotide
gagagacaaatccgactgtcagtcaccctatgcg

SEQ ID NO: 3037 - DNA, 36 bp, Artificial Sequence
  Synthetic oligonucleotide
accccacccgccgcacgcacccatgaacaggtttca

SEQ ID NO: 3038 - DNA, 36 bp, Artificial Sequence
  Synthetic oligonucleotide
taccacgcgccgcctccgggcccatcacttagcata

SEQ ID NO: 3039 - DNA, 35 bp, Artificial Sequence
  Synthetic oligonucleotide
ccacgccctggatgtcgcgttcactggttctcccc

SEQ ID NO: 3040 - DNA, 35 bp, Artificial Sequence
  Synthetic oligonucleotide
tccgccctggtcgccgcttccccctgccgtttgtt

SEQ ID NO: 3041 - DNA, 35 bp, Artificial Sequence
  Synthetic oligonucleotide
ttggccccagccacacacccgtgcttaccaccccc

SEQ ID NO: 3042 - DNA, 35 bp, Artificial Sequence
  Synthetic oligonucleotide
atcccccaggcccccctccacggccaattccttgg

SEQ ID NO: 3043 - DNA, 35 bp, Artificial Sequence
  Synthetic oligonucleotide
gtgctcgcacgatccctacccccccgtagcaccca

SEQ ID NO: 3044 - DNA, 35 bp, Artificial Sequence
  Synthetic oligonucleotide
acccatgtgcacctccttcccgcctcatcgggatt

SEQ ID NO: 3045 - DNA, 38 bp, Artificial Sequence
  Synthetic oligonucleotide
gtgcccccttgtccgtatcgcccttcatccacgtgtga

SEQ ID NO: 3046 - DNA, 36 bp, Artificial Sequence
  Synthetic oligonucleotide
atgcctgcccaaccccctgccgtcgattacaccgta

SEQ ID NO: 3047 - DNA, 36 bp, Artificial Sequence
  Synthetic oligonucleotide
tccacgccccatcagcacgtcggcctcatactccca

SEQ ID NO: 3048 - DNA, 35 bp, Artificial Sequence
  Synthetic oligonucleotide
aaccccggcacccccgtcccccttcgatctggtca

SEQ ID NO: 3049 - DNA, 34 bp, Artificial Sequence
  Synthetic oligonucleotide
gacgcccccgccgttaccaccacccgcacttgaa

SEQ ID NO: 3050 - DNA, 37 bp, Artificial Sequence
  Synthetic oligonucleotide
cacaccggtggcggggcaagaatggtggtggtggaga

SEQ ID NO: 3051 - DNA, 35 bp, Artificial Sequence
  Synthetic oligonucleotide
tcaaccgccgcacgagccacctctgcactccacgc

SEQ ID NO: 3052 - DNA, 35 bp, Artificial Sequence
  Synthetic oligonucleotide
gcgaccccgcccacacccgttacatcaactgttcg

SEQ ID NO: 3053 - DNA, 36 bp, Artificial Sequence
  Synthetic oligonucleotide
tccacccgccccgacgcgcaacctagcctcaagcca

SEQ ID NO: 3054 - DNA, 35 bp, Artificial Sequence
  Synthetic oligonucleotide
gccccagtccgccatccagatccctgctccacctg

SEQ ID NO: 3055 - DNA, 35 bp, Artificial Sequence
  Synthetic oligonucleotide
actccaccgctcaccacgcccagtgagccatccct

SEQ ID NO: 3056 - DNA, 35 bp, Artificial Sequence
  Synthetic oligonucleotide
ccgcaccaacccaacacacacgaggtgatgccccc

SEQ ID NO: 3057 - DNA, 38 bp, Artificial Sequence
  Synthetic oligonucleotide
acccatcccaccgcttagagcgcacgcccctcctctga

SEQ ID NO: 3058 - DNA, 35 bp, Artificial Sequence
  Synthetic oligonucleotide
ttgactcgcacgcacacacatcacgcaccacctgc

SEQ ID NO: 3059 - DNA, 35 bp, Artificial Sequence
  Synthetic oligonucleotide
aatacccgccgccccgtaccaatacgctccgcacc

SEQ ID NO: 3060 - DNA, 35 bp, Artificial Sequence
  Synthetic oligonucleotide
gtacccgccccccccaatgacgcgttatgcgcccc

SEQ ID NO: 3061 - DNA, 35 bp, Artificial Sequence
  Synthetic oligonucleotide
tgcccatcctccacccctcgtgccgtcgatcccac

SEQ ID NO: 3062 - DNA, 35 bp, Artificial Sequence
  Synthetic oligonucleotide
tgcaaaccctgctccccacgcccataacttacgcc

SEQ ID NO: 3063 - DNA, 35 bp, Artificial Sequence
  Synthetic oligonucleotide
gatccaccgcactactgaaccctaaccagtcactt

SEQ ID NO: 3064 - DNA, 35 bp, Artificial Sequence
  Synthetic oligonucleotide
tacccacgcaccgccgccccatgagctacactatc

SEQ ID NO: 3065 - DNA, 35 bp, Artificial Sequence
  Synthetic oligonucleotide
tcctgcacccccgccttgttgagcccctcctctcg

SEQ ID NO: 3066 - DNA, 35 bp, Artificial Sequence
  Synthetic oligonucleotide
tcacgccgcattcctgctgtccgctatccacttcc

SEQ ID NO: 3067 - DNA, 35 bp, Artificial Sequence
  Synthetic oligonucleotide
gccacgcaccgcaacccgacacatcccgtgacctc

SEQ ID NO: 3068 - DNA, 35 bp, Artificial Sequence
  Synthetic oligonucleotide
tcaccacccgtactaccaacgccgcgctaaacgcc

SEQ ID NO: 3069 - DNA, 35 bp, Artificial Sequence
  Synthetic oligonucleotide
agtgtgcaccccctgaccgcagtgaccgcccctcc

SEQ ID NO: 3070 - DNA, 35 bp, Artificial Sequence
  Synthetic oligonucleotide
tacacaccgccccttaatggcaattaacactcacc

SEQ ID NO: 3071 - DNA, 35 bp, Artificial Sequence
  Synthetic oligonucleotide
tacgccccagcccttccatatcgtcaaccggcgcc

SEQ ID NO: 3072 - DNA, 37 bp, Artificial Sequence
  Synthetic oligonucleotide
tccatcacccgacctttgcgtagttctgcctgtttga

SEQ ID NO: 3073 - DNA, 35 bp, Artificial Sequence
  Synthetic oligonucleotide
accccccccatgatgcatagcccacggttcccttc

SEQ ID NO: 3074 - DNA, 35 bp, Artificial Sequence
  Synthetic oligonucleotide
tgccgagccgcccacatctgccatcgctccccaca

SEQ ID NO: 3075 - DNA, 35 bp, Artificial Sequence
  Synthetic oligonucleotide
gccaccggcacggacattaccaccgcaccttaatc

SEQ ID NO: 3076 - DNA, 37 bp, Artificial Sequence
  Synthetic oligonucleotide
acccaccccccaactgcccgtgttgtcgctcccttga

SEQ ID NO: 3077 - DNA, 35 bp, Artificial Sequence
  Synthetic oligonucleotide
acatcccgatccgttagtgcctcactgctggcgcc

SEQ ID NO: 3078 - DNA, 38 bp, Artificial Sequence
  Synthetic oligonucleotide
gtagccccgcccgttattagcccatcccgctaccctga

SEQ ID NO: 3079 - DNA, 34 bp, Artificial Sequence
  Synthetic oligonucleotide
atgccctgcccctgccctccttgtttaccctggt

SEQ ID NO: 3080 - DNA, 36 bp, Artificial Sequence
  Synthetic oligonucleotide
ttcacaccatccgccttggttccagtggctcttcca

SEQ ID NO: 3081 - DNA, 35 bp, Artificial Sequence
  Synthetic oligonucleotide
acccacctctgacctgtttaatgcttctgtctcac

SEQ ID NO: 3082 - DNA, 37 bp, Artificial Sequence
  Synthetic oligonucleotide
gcacgcccatcatctcacctgcgacctgccaattcga

SEQ ID NO: 3083 - DNA, 35 bp, Artificial Sequence
  Synthetic oligonucleotide
gaccccagtccggttggtcttgcctgcccctccca

SEQ ID NO: 3084 - DNA, 35 bp, Artificial Sequence
  Synthetic oligonucleotide
atgccacgccctcgcatacgacctgcccatccact

SEQ ID NO: 3085 - DNA, 35 bp, Artificial Sequence
  Synthetic oligonucleotide
tcacgacaccgcattattctgcctgcctgtcctcg

SEQ ID NO: 3086 - DNA, 38 bp, Artificial Sequence
  Synthetic oligonucleotide
cctgccgcacgcaacacctatggcctgtttcaccttga

SEQ ID NO: 3087 - DNA, 36 bp, Artificial Sequence
  Synthetic oligonucleotide
tgcacacgccccctgtcgccatccattcactgtgca

SEQ ID NO: 3088 - DNA, 35 bp, Artificial Sequence
  Synthetic oligonucleotide
gccacccgccttttgttcttgcttactgtaatatc

SEQ ID NO: 3089 - DNA, 35 bp, Artificial Sequence
  Synthetic oligonucleotide
attgcccgccccattctccgtacgtccaccgctgg

SEQ ID NO: 3090 - DNA, 38 bp, Artificial Sequence
  Synthetic oligonucleotide
tgcgggggggggcgaagatgatgcaggggcgatcgtga

SEQ ID NO: 3091 - DNA, 36 bp, Artificial Sequence
  Synthetic oligonucleotide
tcgagccccaccactgctcacttgacacacccccaa

SEQ ID NO: 3092 - DNA, 35 bp, Artificial Sequence
  Synthetic oligonucleotide
ccacgccacccacctcgagcaccaccggtcgtgct

SEQ ID NO: 3093 - DNA, 35 bp, Artificial Sequence
  Synthetic oligonucleotide
tccacctgcctcacccggacacatactcgcccgta

SEQ ID NO: 3094 - DNA, 35 bp, Artificial Sequence
  Synthetic oligonucleotide
gagaccagcagcccgtgccgtgtcacacctttcac

SEQ ID NO: 3095 - DNA, 35 bp, Artificial Sequence
  Synthetic oligonucleotide
tcccaacctcaccgtgccctcattgtaccgaagtc

SEQ ID NO: 3096 - DNA, 35 bp, Artificial Sequence
  Synthetic oligonucleotide
acatccaccgccttgagcttatccgccgcctgtta

SEQ ID NO: 3097 - DNA, 35 bp, Artificial Sequence
  Synthetic oligonucleotide
tgccctccccgccccatgtccttacaatgcacccg

SEQ ID NO: 3098 - DNA, 35 bp, Artificial Sequence
  Synthetic oligonucleotide
ttccccccgcccatcctggtgtctgcaaacgctcc

SEQ ID NO: 3099 - DNA, 35 bp, Artificial Sequence
  Synthetic oligonucleotide
gccccccggcacctctcatccaggacacgccttcc

SEQ ID NO: 3100 - DNA, 31 bp, Artificial Sequence
  Synthetic oligonucleotide
ttcccgccccggtccgccggttctcatccca

SEQ ID NO: 3101 - DNA, 35 bp, Artificial Sequence
  Synthetic oligonucleotide
acacggtggagcaatcgtcgacccccgccctttcc

SEQ ID NO: 3102 - DNA, 35 bp, Artificial Sequence
  Synthetic oligonucleotide
acccctgccccctgatcagcacctcttcacggtcc

SEQ ID NO: 3103 - DNA, 37 bp, Artificial Sequence
  Synthetic oligonucleotide
taccgcctcatcacacggcacacacccttgtcaccga

SEQ ID NO: 3104 - DNA, 35 bp, Artificial Sequence
  Synthetic oligonucleotide
tgagacgccgcacgctcgcctggcccttccctgtc

SEQ ID NO: 3105 - DNA, 35 bp, Artificial Sequence
  Synthetic oligonucleotide
gcgcacacaccaccgagctgctccatctgccccta

SEQ ID NO: 3106 - DNA, 36 bp, Artificial Sequence
  Synthetic oligonucleotide
gcacccgcaagctgtccgccacccatgcctgcgcta

SEQ ID NO: 3107 - DNA, 35 bp, Artificial Sequence
  Synthetic oligonucleotide
gatggaggaggaggggtcgaggtggacgggtacag

SEQ ID NO: 3108 - DNA, 35 bp, Artificial Sequence
  Synthetic oligonucleotide
gttcgaccgccacacattttcccacatagctgtac

SEQ ID NO: 3109 - DNA, 36 bp, Artificial Sequence
  Synthetic oligonucleotide
tcaccaccaccccacgcttaagacgtgctttgccca

SEQ ID NO: 3110 - DNA, 35 bp, Artificial Sequence
  Synthetic oligonucleotide
gacccttccaccgcccgatgcttggccaacgcatc

SEQ ID NO: 3111 - DNA, 35 bp, Artificial Sequence
  Synthetic oligonucleotide
atgccccgccaccactttctggcctacggttccac

SEQ ID NO: 3112 - DNA, 35 bp, Artificial Sequence
  Synthetic oligonucleotide
acccgcaccccctcgcacccgccgccttgcactca

SEQ ID NO: 3113 - DNA, 35 bp, Artificial Sequence
  Synthetic oligonucleotide
ttgtagcccgcctaccccccgccaccgattcatgc

SEQ ID NO: 3114 - DNA, 37 bp, Artificial Sequence
  Synthetic oligonucleotide
gacaccctccatggccccgattcgcgttctttcccga

SEQ ID NO: 3115 - DNA, 35 bp, Artificial Sequence
  Synthetic oligonucleotide
gttcccctcccatgtttacagccactggcctggat

SEQ ID NO: 3116 - DNA, 35 bp, Artificial Sequence
  Synthetic oligonucleotide
tcccatcccgtgtacttactgcgattttgtcttcc

SEQ ID NO: 3117 - DNA, 35 bp, Artificial Sequence
  Synthetic oligonucleotide
tgtccacctaacccatccgtatcatgcccctgttt

SEQ ID NO: 3118 - DNA, 35 bp, Artificial Sequence
  Synthetic oligonucleotide
accctgtccccaccccatgcgactcgttgctctta

SEQ ID NO: 3119 - DNA, 35 bp, Artificial Sequence
  Synthetic oligonucleotide
aacccccactcgacccaccttgttcgctgccatgc

SEQ ID NO: 3120 - DNA, 35 bp, Artificial Sequence
  Synthetic oligonucleotide
tgacactccccgtccctgcctctttgtttgctgcc

SEQ ID NO: 3121 - DNA, 35 bp, Artificial Sequence
  Synthetic oligonucleotide
accactgcccacgcccggtcgacgcccgctaccca

SEQ ID NO: 3122 - DNA, 38 bp, Artificial Sequence
  Synthetic oligonucleotide
atgcccccgcaactgctcccctctgtccatcttgatga

SEQ ID NO: 3123 - DNA, 38 bp, Artificial Sequence
  Synthetic oligonucleotide
atacaccacaccttctgccctacgtgctcaggccttga

SEQ ID NO: 3124 - DNA, 35 bp, Artificial Sequence
  Synthetic oligonucleotide
gccactttcccatgcccttgctacagccacgactc

SEQ ID NO: 3125 - DNA, 35 bp, Artificial Sequence
  Synthetic oligonucleotide
gacaccgacgccccttcgaactgccaccctagcgc

SEQ ID NO: 3126 - DNA, 37 bp, Artificial Sequence
  Synthetic oligonucleotide
tcccacctccgctgtcgtaccgctggcctttactcga

SEQ ID NO: 3127 - DNA, 35 bp, Artificial Sequence
  Synthetic oligonucleotide
acgcccattgcaaaatggctttaaaacacttcatc

SEQ ID NO: 3128 - DNA, 35 bp, Artificial Sequence
  Synthetic oligonucleotide
gcctcgtgaactctgctgttacatccttgcgtgcc

SEQ ID NO: 3129 - DNA, 35 bp, Artificial Sequence
  Synthetic oligonucleotide
tcgccctccgcccccaactgttgacgtaatattcc

SEQ ID NO: 3130 - DNA, 35 bp, Artificial Sequence
  Synthetic oligonucleotide
gacccctacagcccgcaccccaccgctattatgcg

SEQ ID NO: 3131 - DNA, 35 bp, Artificial Sequence
  Synthetic oligonucleotide
gcccacacctgcaaggtgttctttgccctctttcc

SEQ ID NO: 3132 - DNA, 35 bp, Artificial Sequence
  Synthetic oligonucleotide
ctttcccgccgccctgtaattggttaccgccactt

SEQ ID NO: 3133 - DNA, 35 bp, Artificial Sequence
  Synthetic oligonucleotide
tacacctgcgcacacgcgtgctactcaatccatcc

SEQ ID NO: 3134 - DNA, 35 bp, Artificial Sequence
  Synthetic oligonucleotide
ttcgagccgtccagcgttcacctctcaccttgcac

SEQ ID NO: 3135 - DNA, 35 bp, Artificial Sequence
  Synthetic oligonucleotide
gtgcctagcgcagccacgccctcctaaccaccttg

SEQ ID NO: 3136 - DNA, 35 bp, Artificial Sequence
  Synthetic oligonucleotide
tgtgccctccagctgactccccccgtcatctacgc

SEQ ID NO: 3137 - DNA, 35 bp, Artificial Sequence
  Synthetic oligonucleotide
tcccaccaccccaccatgtatttatgtcctattcc

SEQ ID NO: 3138 - DNA, 35 bp, Artificial Sequence
  Synthetic oligonucleotide
gccacatccaattcgactttactgcctaggttcct

SEQ ID NO: 3139 - DNA, 35 bp, Artificial Sequence
  Synthetic oligonucleotide
tgaccatccagcccgccccttacacgtgaactgcg

SEQ ID NO: 3140 - DNA, 35 bp, Artificial Sequence
  Synthetic oligonucleotide
tctcacctcccatcgcgtatttgccatttcaccat

SEQ ID NO: 3141 - DNA, 35 bp, Artificial Sequence
  Synthetic oligonucleotide
ttctgacaccgctactgacgatccgaccttccatc

SEQ ID NO: 3142 - DNA, 35 bp, Artificial Sequence
  Synthetic oligonucleotide
tcagccctgcccccctatccgtgacatccggcacg

SEQ ID NO: 3143 - DNA, 35 bp, Artificial Sequence
  Synthetic oligonucleotide
tcacatcctccttcccgtgtgtcgttactccctgt

SEQ ID NO: 3144 - DNA, 35 bp, Artificial Sequence
  Synthetic oligonucleotide
tgagcgggggggtggggagggagcaatatcgtacg

SEQ ID NO: 3145 - DNA, 35 bp, Artificial Sequence
  Synthetic oligonucleotide
tcaccaagcctgtaatctgccttcccttcggaccc

SEQ ID NO: 3146 - DNA, 35 bp, Artificial Sequence
  Synthetic oligonucleotide
atgaacccatcgccgctgcaggccctgcttcctat

SEQ ID NO: 3147 - DNA, 35 bp, Artificial Sequence
  Synthetic oligonucleotide
tgttatcccggcacatctaccctgcttcctttgcg

SEQ ID NO: 3148 - DNA, 36 bp, Artificial Sequence
  Synthetic oligonucleotide
acgctccgcccaccttcgattcgtgcgtgctcccca

SEQ ID NO: 3149 - DNA, 30 bp, Artificial Sequence
  Synthetic oligonucleotide
tccccatgctcgtttgcctctacctcttca

SEQ ID NO: 3150 - DNA, 35 bp, Artificial Sequence
  Synthetic oligonucleotide
catccaccccaggactcacgacaacgagtgggtcg

SEQ ID NO: 3151 - DNA, 35 bp, Artificial Sequence
  Synthetic oligonucleotide
tagtccacacagcagccacatcgcagcacccccca

SEQ ID NO: 3152 - DNA, 34 bp, Artificial Sequence
  Synthetic oligonucleotide
acatacaccctcaactcgccggacacacccactg

SEQ ID NO: 3153 - DNA, 35 bp, Artificial Sequence
  Synthetic oligonucleotide
tcgatacccacaacacgtttatatgccatctctca

SEQ ID NO: 3154 - DNA, 35 bp, Artificial Sequence
  Synthetic oligonucleotide
tcacacccccgtttatggtttgttcacttttctat

SEQ ID NO: 3155 - DNA, 35 bp, Artificial Sequence
  Synthetic oligonucleotide
atccccgcccctaagtaactgccccttgattagca

SEQ ID NO: 3156 - DNA, 35 bp, Artificial Sequence
  Synthetic oligonucleotide
acgctcacccgacgccttgtcatccgttgcctacc

SEQ ID NO: 3157 - DNA, 35 bp, Artificial Sequence
  Synthetic oligonucleotide
ttaccccccgcccactgggtcattacacctcttgc

SEQ ID NO: 3158 - DNA, 35 bp, Artificial Sequence
  Synthetic oligonucleotide
gacaccaccaccgaccacggaccgacaccacgccc

SEQ ID NO: 3159 - DNA, 35 bp, Artificial Sequence
  Synthetic oligonucleotide
tcctgacccctcccgatccgtacgagtgcccccga

SEQ ID NO: 3160 - DNA, 35 bp, Artificial Sequence
  Synthetic oligonucleotide
acgaccatccccccgcagtctccatggcctggttt

SEQ ID NO: 3161 - DNA, 35 bp, Artificial Sequence
  Synthetic oligonucleotide
ggaccacctgccactgtcttccatgctcgacattc

SEQ ID NO: 3162 - DNA, 35 bp, Artificial Sequence
  Synthetic oligonucleotide
tccctgcacgcgccttggtgcccacccccctaccc

SEQ ID NO: 3163 - DNA, 35 bp, Artificial Sequence
  Synthetic oligonucleotide
tcccaatgccccaattctgctatgaccttttctat

SEQ ID NO: 3164 - DNA, 35 bp, Artificial Sequence
  Synthetic oligonucleotide
acaaccaaggctctgaccacgaccgtccctgtcct

SEQ ID NO: 3165 - DNA, 31 bp, Artificial Sequence
  Synthetic oligonucleotide
tataccacccccgtctcagtcctcacgcata

SEQ ID NO: 3166 - DNA, 37 bp, Artificial Sequence
  Synthetic oligonucleotide
gaccaccgatccgcactgttgcactttcttgacccga

SEQ ID NO: 3167 - DNA, 35 bp, Artificial Sequence
  Synthetic oligonucleotide
gccacacctcactggaaccgaccctcctttgtaag

SEQ ID NO: 3168 - DNA, 35 bp, Artificial Sequence
  Synthetic oligonucleotide
agccaaccgcatggtgcacccgacttccatcttct

SEQ ID NO: 3169 - DNA, 35 bp, Artificial Sequence
  Synthetic oligonucleotide
gcccgcaccccactttgaactacagtacccgcctg

SEQ ID NO: 3170 - DNA, 35 bp, Artificial Sequence
  Synthetic oligonucleotide
tcacgctccatctcaatgctatctcagccgtgcca

SEQ ID NO: 3171 - DNA, 35 bp, Artificial Sequence
  Synthetic oligonucleotide
gtggacccgcactatattcgttcaaggcctcccct

SEQ ID NO: 3172 - DNA, 35 bp, Artificial Sequence
  Synthetic oligonucleotide
tgccccctccatgactgcttttccccttcacatgc

SEQ ID NO: 3173 - DNA, 36 bp, Artificial Sequence
  Synthetic oligonucleotide
aacgccacacctccattgcatccccgcccggtacta

SEQ ID NO: 3174 - DNA, 35 bp, Artificial Sequence
  Synthetic oligonucleotide
tccctcccgcgtactccgctcggctagtttcctcc

SEQ ID NO: 3175 - DNA, 35 bp, Artificial Sequence
  Synthetic oligonucleotide
tccccacgcccctcgtccaccttaggctctccgcc

SEQ ID NO: 3176 - DNA, 35 bp, Artificial Sequence
  Synthetic oligonucleotide
atcgcccgacaaccacactgatacgccaatcacgg

SEQ ID NO: 3177 - DNA, 36 bp, Artificial Sequence
  Synthetic oligonucleotide
tcactccgccggccacacgactccgccttcgcctgc

SEQ ID NO: 3178 - DNA, 36 bp, Artificial Sequence
  Synthetic oligonucleotide
attgccccctccgttgtgacacccctgctactctca

SEQ ID NO: 3179 - DNA, 37 bp, Artificial Sequence
  Synthetic oligonucleotide
tccgagcatcgcccttctgtacactgcgcctccctga

SEQ ID NO: 3180 - DNA, 35 bp, Artificial Sequence
  Synthetic oligonucleotide
tcccgccgccttgtttttttggtccgtcgtcactc

SEQ ID NO: 3181 - DNA, 35 bp, Artificial Sequence
  Synthetic oligonucleotide
tcaccaccgcaacccccggaactgtaatttacctt

SEQ ID NO: 3182 - DNA, 36 bp, Artificial Sequence
  Synthetic oligonucleotide
gcacgccgcaccgtttagggcctcgacccacccaca

SEQ ID NO: 3183 - DNA, 35 bp, Artificial Sequence
  Synthetic oligonucleotide
gccgaggtaggtggcggggggcttggaaggtggag

SEQ ID NO: 3184 - DNA, 35 bp, Artificial Sequence; identical to SEQ ID NO: 3052
  Synthetic oligonucleotide

SEQ ID NO: 3185 - DNA, 35 bp, Artificial Sequence
  Synthetic oligonucleotide
gtgccccatcgcccatcgccacagctatcctgccg

SEQ ID NO: 3186 - DNA, 35 bp, Artificial Sequence
  Synthetic oligonucleotide
accaagtgggtggggggggaagggtagtagatagg

SEQ ID NO: 3187 - DNA, 35 bp, Artificial Sequence
  Synthetic oligonucleotide
gtgcactcgaacagccgccccgacccgccgtttta

SEQ ID NO: 3188 - DNA, 35 bp, Artificial Sequence
  Synthetic oligonucleotide
gcgattagccgtactgttgtccatattccgcctcc

SEQ ID NO: 3189 - DNA, 35 bp, Artificial Sequence
  Synthetic oligonucleotide
tgacgaccacccctgcgcactctttcctaccaccg

SEQ ID NO: 3190 - DNA, 35 bp, Artificial Sequence
  Synthetic oligonucleotide
acaccgctctccgcacatcttccatcagcctgctt

SEQ ID NO: 3191 - DNA, 38 bp, Artificial Sequence
  Synthetic oligonucleotide
gcccacaccctcaatcgctgctttgacactagccctga

SEQ ID NO: 3192 - DNA, 35 bp, Artificial Sequence
  Synthetic oligonucleotide
gcccatctgcctgttcggtccatccaatcctctgc

SEQ ID NO: 3193 - DNA, 36 bp, Artificial Sequence
  Synthetic oligonucleotide
ccctgtccgcaatcgcctcctaacactcctggtgca

SEQ ID NO: 3194 - DNA, 36 bp, Artificial Sequence
  Synthetic oligonucleotide
gccaccccgcctgtttctacttgtacccggatgcta

SEQ ID NO: 3195 - DNA, 36 bp, Artificial Sequence
  Synthetic oligonucleotide
tcccaccctggttgtcatccacgcactgcccactca

SEQ ID NO: 3196 - DNA, 35 bp, Artificial Sequence
  Synthetic oligonucleotide
gtgggcgctgtactgcactctgacttcttttctgc

SEQ ID NO: 3197 - DNA, 35 bp, Artificial Sequence
  Synthetic oligonucleotide
gcctgccccgagctttatattccaccgtccctgtc

SEQ ID NO: 3198 - DNA, 38 bp, Artificial Sequence
  Synthetic oligonucleotide
gtcgaccaacctcacccttctaagtaccctcatcctga

SEQ ID NO: 3199 - DNA, 35 bp, Artificial Sequence
  Synthetic oligonucleotide
gccggtaccgcctatgcttgtcccctccccatttc

SEQ ID NO: 3200 - DNA, 35 bp, Artificial Sequence
  Synthetic oligonucleotide
tctgcacccactatctcgtcatacatccatcgcac

SEQ ID NO: 3201 - DNA, 35 bp, Artificial Sequence
  Synthetic oligonucleotide
tcagcccactaccgaccacccgcgctccacctgga

SEQ ID NO: 3202 - DNA, 36 bp, Artificial Sequence
  Synthetic oligonucleotide
gagtgggagggggacaaaagaagggtgggttatgga

SEQ ID NO: 3203 - DNA, 35 bp, Artificial Sequence
  Synthetic oligonucleotide
tcagcccactgcccccttacgatgcacgccgcctt

SEQ ID NO: 3204 - DNA, 35 bp, Artificial Sequence
  Synthetic oligonucleotide
tagggccacacgacgtctatcaccgcttctcctgc

SEQ ID NO: 3205 - DNA, 36 bp, Artificial Sequence
  Synthetic oligonucleotide
atctccctgcccccgagttccatatgccacctctca

SEQ ID NO: 3206 - DNA, 35 bp, Artificial Sequence
  Synthetic oligonucleotide
gtccccgcctccctctgccgttacacttctttgtg

SEQ ID NO: 3207 - DNA, 35 bp, Artificial Sequence
  Synthetic oligonucleotide
aaccgccaatgcccatgccctccgtaaggtccttt

SEQ ID NO: 3208 - DNA, 37 bp, Artificial Sequence
  Synthetic oligonucleotide
cttgccaccacgtccggcatgcgttatccttagtcga

SEQ ID NO: 3209 - DNA, 35 bp, Artificial Sequence
  Synthetic oligonucleotide
gactcagtacgtcgcccttccttgccacactttca

SEQ ID NO: 3210 - DNA, 37 bp, Artificial Sequence
  Synthetic oligonucleotide
ttccactacgcccggtcgcatatgccccttctctcga

SEQ ID NO: 3211 - DNA, 35 bp, Artificial Sequence
  Synthetic oligonucleotide
tcagcccaaccttatccgcaccaccctaccatggg

SEQ ID NO: 3212 - DNA, 35 bp, Artificial Sequence
  Synthetic oligonucleotide
gacgccaccccactataccttccctggtaaggcac

SEQ ID NO: 3213 - DNA, 37 bp, Artificial Sequence
  Synthetic oligonucleotide
gacgaaggcacgggaaggaaatggtgggggctaaaga

SEQ ID NO: 3214 - DNA, 35 bp, Artificial Sequence
  Synthetic oligonucleotide
tgcccgcgctcctccccctcgtcgtgcgtaggccc

SEQ ID NO: 3215 - DNA, 35 bp, Artificial Sequence
  Synthetic oligonucleotide
gacacccgccgtgttcctttatggtgatccctgct

SEQ ID NO: 3216 - DNA, 35 bp, Artificial Sequence
  Synthetic oligonucleotide
cctcacctccggtcacgttgtctcccgttaggcct

SEQ ID NO: 3217 - DNA, 35 bp, Artificial Sequence
  Synthetic oligonucleotide
ttcgcacgcaatcgccgtccccgcccgaaaccacc

SEQ ID NO: 3218 - DNA, 37 bp, Artificial Sequence
  Synthetic oligonucleotide
acccccgcccccacagctgtaagctttcaatacctga

SEQ ID NO: 3219 - DNA, 35 bp, Artificial Sequence
  Synthetic oligonucleotide
ccacgtccatagccctgtagtgtcttcctgtctgc

SEQ ID NO: 3220 - DNA, 35 bp, Artificial Sequence
  Synthetic oligonucleotide
gctaacccgctagacctgccttgagtggccccccc

SEQ ID NO: 3221 - DNA, 35 bp, Artificial Sequence
  Synthetic oligonucleotide
tcacactgcaccaatccgttcactacaccagctgg

SEQ ID NO: 3222 - DNA, 35 bp, Artificial Sequence
  Synthetic oligonucleotide
accccgtcaacgcacccatgccgtccactccgcac

SEQ ID NO: 3223 - DNA, 35 bp, Artificial Sequence
  Synthetic oligonucleotide
gcaccgtacgcgtgcacacctctgctaccaaaccc

SEQ ID NO: 3224 - DNA, 35 bp, Artificial Sequence
  Synthetic oligonucleotide
tacgtcccgcacacttttgatagccttgtccccgc

SEQ ID NO: 3225 - DNA, 36 bp, Artificial Sequence
  Synthetic oligonucleotide
tgcaccgccgggcccttcacgaccctccgacatgta

SEQ ID NO: 3226 - DNA, 37 bp, Artificial Sequence
  Synthetic oligonucleotide
agtcgccgggcaagcaggagcaaggggaagggcggga

SEQ ID NO: 3227 - DNA, 35 bp, Artificial Sequence
  Synthetic oligonucleotide
acccagccctattcacaatgcactgagtccgcctc

SEQ ID NO: 3228 - DNA, 35 bp, Artificial Sequence
  Synthetic oligonucleotide
tgctacgccccgacgacccgctgaccttcgtaacc

SEQ ID NO: 3229 - DNA, 35 bp, Artificial Sequence
  Synthetic oligonucleotide
gcgcactgccctattcgaccaaccttgcctttgct

SEQ ID NO: 3230 - DNA, 35 bp, Artificial Sequence
  Synthetic oligonucleotide
tcgcgtagcctcacaccgttcctttcgtccagctc

SEQ ID NO: 3231 - DNA, 34 bp, Artificial Sequence
  Synthetic oligonucleotide
tatgccacacaccccgacgcacgttacgagcacc

SEQ ID NO: 3232 - DNA, 35 bp, Artificial Sequence
  Synthetic oligonucleotide
accccgcccccgccctagtatcagactttctgccg

SEQ ID NO: 3233 - DNA, 35 bp, Artificial Sequence
  Synthetic oligonucleotide
tgctccaccgcacctgatagttccttttccccagc

SEQ ID NO: 3234 - DNA, 35 bp, Artificial Sequence
  Synthetic oligonucleotide
cgaccacccggttaggttaggctccacctcaactc

SEQ ID NO: 3235 - DNA, 35 bp, Artificial Sequence
  Synthetic oligonucleotide
tacgcacctcacacccccactgttccatcttcgcg

SEQ ID NO: 3236 - DNA, 35 bp, Artificial Sequence
  Synthetic oligonucleotide
acgtacaccctctcgccttgggccacgaagtcctt

SEQ ID NO: 3237 - DNA, 35 bp, Artificial Sequence
  Synthetic oligonucleotide
tcccgcctacgccagttacgtcccgctgtccactc

SEQ ID NO: 3238 - DNA, 35 bp, Artificial Sequence
  Synthetic oligonucleotide
accacctcgtggccatgccccatccttccattgga

SEQ ID NO: 3239 - DNA, 35 bp, Artificial Sequence
  Synthetic oligonucleotide
gaccgtcgcactatgtgcttagcctctcttaccgc

SEQ ID NO: 3240 - DNA, 38 bp, Artificial Sequence
  Synthetic oligonucleotide
atccacctcactatgttcccgcactgatccctgcctga

SEQ ID NO: 3241 - DNA, 38 bp, Artificial Sequence
  Synthetic oligonucleotide
ttagccccctgccaccatctgtccatacctcgcactga

SEQ ID NO: 3242 - DNA, 37 bp, Artificial Sequence
  Synthetic oligonucleotide
tcccatcccccatactgttgactctgaacctgccgga

SEQ ID NO: 3243 - DNA, 36 bp, Artificial Sequence
  Synthetic oligonucleotide
ggtgaacccccccccgtcatgtcctgacccttcacc

SEQ ID NO: 3244 - DNA, 35 bp, Artificial Sequence
  Synthetic oligonucleotide
tcccgccgctcacagcgcctcccgacctccctgtc

SEQ ID NO: 3245 - DNA, 35 bp, Artificial Sequence
  Synthetic oligonucleotide
ttcgcgcaccacccccattggctctaatactaccg

SEQ ID NO: 3246 - DNA, 35 bp, Artificial Sequence
  Synthetic oligonucleotide
gatggcccttcgcccttgggtctttcgcataccac

SEQ ID NO: 3247 - DNA, 34 bp, Artificial Sequence
  Synthetic oligonucleotide
tcaaccttcgctcacacataccgtcgccgccgcc

SEQ ID NO: 3248 - DNA, 35 bp, Artificial Sequence
  Synthetic oligonucleotide
accacccctgtcctaccagaacgccgcccactgag

SEQ ID NO: 3249 - DNA, 35 bp, Artificial Sequence
  Synthetic oligonucleotide
tagccaacctcacacagacggaacgccccacccac

SEQ ID NO: 3250 - DNA, 37 bp, Artificial Sequence
  Synthetic oligonucleotide
ttgccacccccagccctcgttagtaccctcttgcgga

SEQ ID NO: 3251 - DNA, 37 bp, Artificial Sequence
  Synthetic oligonucleotide
ttgactgccacattctgctcaacacatcttcactcga

SEQ ID NO: 3252 - DNA, 38 bp, Artificial Sequence
  Synthetic oligonucleotide
tgtcaccccacatatgccactgttccatcttcatttga

SEQ ID NO: 3253 - DNA, 35 bp, Artificial Sequence
  Synthetic oligonucleotide
gcctgaaccgttgctctcttgcccaatcccccgga

SEQ ID NO: 3254 - DNA, 35 bp, Artificial Sequence
  Synthetic oligonucleotide
ggtgggcaccccgcctattgtaactcccgatcaac

SEQ ID NO: 3255 - DNA, 35 bp, Artificial Sequence
  Synthetic oligonucleotide
tgcccctactgttctgcttcccatcacggatactc

SEQ ID NO: 3256 - DNA, 35 bp, Artificial Sequence
  Synthetic oligonucleotide
gcccactccccagtacgtttgtcttacggatttac

SEQ ID NO: 3257 - DNA, 35 bp, Artificial Sequence
  Synthetic oligonucleotide
tacgcaccgtcgcgctccaccttcccccgacgacg

SEQ ID NO: 3258 - DNA, 36 bp, Artificial Sequence
  Synthetic oligonucleotide
gagagggggtgggtggggctcgagatggaaagggta

SEQ ID NO: 3259 - DNA, 35 bp, Artificial Sequence
  Synthetic oligonucleotide
atcgccaccctctatgctatatctatgtcacccct

SEQ ID NO: 3260 - DNA, 35 bp, Artificial Sequence
  Synthetic oligonucleotide
ttacgcctttccgacgatctgcctcgaactccctg

SEQ ID NO: 3261 - DNA, 35 bp, Artificial Sequence
  Synthetic oligonucleotide
ctcgacacctggcccggttttgccacccacttctg

SEQ ID NO: 3262 - DNA, 35 bp, Artificial Sequence
  Synthetic oligonucleotide
attgcatccgcaacaatctgttttctactcactgc

SEQ ID NO: 3263 - DNA, 36 bp, Artificial Sequence
  Synthetic oligonucleotide
gggagggcatggtggagtagggcgggagggggtaca

SEQ ID NO: 3264 - DNA, 35 bp, Artificial Sequence
  Synthetic oligonucleotide
acgcactcctaagacgccgccttatgcacgccccc

SEQ ID NO: 3265 - DNA, 35 bp, Artificial Sequence
  Synthetic oligonucleotide
gcacagcctatgtccatccgtacaccttactggcc

SEQ ID NO: 3266 - DNA, 35 bp, Artificial Sequence
  Synthetic oligonucleotide
tccaacgcccttccccgcatcttctgccatctgca

SEQ ID NO: 3267 - DNA, 38 bp, Artificial Sequence
  Synthetic oligonucleotide
tccatcacctgcctgccgtatatccgatcccatattga

SEQ ID NO: 3268 - DNA, 35 bp, Artificial Sequence
  Synthetic oligonucleotide
acgcaacctcgatctacctcccatgctgtcttctt

SEQ ID NO: 3269 - DNA, 35 bp, Artificial Sequence
  Synthetic oligonucleotide
gatgtcgccggtccaccctccatgcaatgcgattc

SEQ ID NO: 3270 - DNA, 35 bp, Artificial Sequence
  Synthetic oligonucleotide
atggacgtcaagtctaccctcccgccacctctccg

SEQ ID NO: 3271 - DNA, 35 bp, Artificial Sequence
  Synthetic oligonucleotide
tccaccccatcactgaactccgggcacctttgtga

SEQ ID NO: 3272 - DNA, 35 bp, Artificial Sequence
  Synthetic oligonucleotide
gaaggaaaggaagggagatacgaagtggagtaggg

SEQ ID NO: 3273 - DNA, 35 bp, Artificial Sequence
  Synthetic oligonucleotide
accccaatcccccgcctctgtgcaggtcctgtgcc

SEQ ID NO: 3274 - DNA, 36 bp, Artificial Sequence
  Synthetic oligonucleotide
agatgggggggcagaaaagaaaggggagggagcgaa

SEQ ID NO: 3275 - DNA, 37 bp, Artificial Sequence
  Synthetic oligonucleotide
atcgacaccccttcattgatactccctctcactagga

SEQ ID NO: 3276 - DNA, 35 bp, Artificial Sequence
  Synthetic oligonucleotide
gaaccgtccgctccgatcactgctattctccttgt

SEQ ID NO: 3277 - DNA, 37 bp, Artificial Sequence
  Synthetic oligonucleotide
gtagggggaggtaggtggagggaggggacaacagaga

SEQ ID NO: 3278 - DNA, 36 bp, Artificial Sequence
  Synthetic oligonucleotide
aatggaccaggagtaaggggggtggacgggagggga

SEQ ID NO: 3279 - DNA, 38 bp, Artificial Sequence
  Synthetic oligonucleotide
tcacccgccccgccccaatcaaaccactgtccgagtga

SEQ ID NO: 3280 - DNA, 35 bp, Artificial Sequence
  Synthetic oligonucleotide
atccgatcgaccattaccctccacgtgcaccctcg

SEQ ID NO: 3281 - DNA, 36 bp, Artificial Sequence
  Synthetic oligonucleotide
atcgcccgttcgtcgcattacacaagccccccgcca

SEQ ID NO: 3282 - DNA, 36 bp, Artificial Sequence
  Synthetic oligonucleotide
agaccgtccatggcgtcctcttcaccgtttctgtca

SEQ ID NO: 3283 - DNA, 32 bp, Artificial Sequence
  Synthetic oligonucleotide
tagtactcccgctgtttccgcaccgacccact

SEQ ID NO: 3284 - DNA, 35 bp, Artificial Sequence
  Synthetic oligonucleotide
tgtcggtgccccgcgtgcgaacctgcccaactgcc

SEQ ID NO: 3285 - DNA, 36 bp, Artificial Sequence
  Synthetic oligonucleotide
ggaccaccccgtctcctctacgtcactgcacgccca

SEQ ID NO: 3286 - DNA, 36 bp, Artificial Sequence
  Synthetic oligonucleotide
atgccacccattggtttcagttacactctttcgcca

SEQ ID NO: 3287 - DNA, 35 bp, Artificial Sequence
  Synthetic oligonucleotide
aatgcacgccgtacccatcgcgcctcctgcttatt

SEQ ID NO: 3288 - DNA, 36 bp, Artificial Sequence
  Synthetic oligonucleotide
gccgcggagagggcgggaagggggaagggggtggaa

SEQ ID NO: 3289 - DNA, 34 bp, Artificial Sequence
  Synthetic oligonucleotide
gagccacgtgctgcttatatcactgcttacctcc

SEQ ID NO: 3290 - DNA, 35 bp, Artificial Sequence
  Synthetic oligonucleotide
acgtccagccgcctcgtttcgcttgcttctacctc

SEQ ID NO: 3291 - DNA, 35 bp, Artificial Sequence
  Synthetic oligonucleotide
acagctgcccacatccgtccgagtctcccgttcct

SEQ ID NO: 3292 - DNA, 35 bp, Artificial Sequence
  Synthetic oligonucleotide
catacccgagcttccgtgttcggccaatttttcct

SEQ ID NO: 3293 - DNA, 35 bp, Artificial Sequence
  Synthetic oligonucleotide
ttgaccccgcctgttctctcctagagtgacctccc

SEQ ID NO: 3294 - DNA, 38 bp, Artificial Sequence
  Synthetic oligonucleotide
gccaactcagcggcatcatcccacttccgccttcgtga

SEQ ID NO: 3295 - DNA, 37 bp, Artificial Sequence
  Synthetic oligonucleotide
tgtggggcttacgtcatggggaacgtttggggtggga

SEQ ID NO: 3296 - DNA, 35 bp, Artificial Sequence
  Synthetic oligonucleotide
gcccgcaccaccacatcacctgtcgctggacacac

SEQ ID NO: 3297 - DNA, 35 bp, Artificial Sequence
  Synthetic oligonucleotide
tccgcgccggcacccactcatcgctccatcggcct

SEQ ID NO: 3298 - DNA, 35 bp, Artificial Sequence
  Synthetic oligonucleotide
tcagcctgcctccgcacactccacatctcgcagtt

SEQ ID NO: 3299 - DNA, 35 bp, Artificial Sequence
  Synthetic oligonucleotide
tcacgcgaacgcccctatggttacccggctcatca

SEQ ID NO: 3300 - DNA, 35 bp, Artificial Sequence
  Synthetic oligonucleotide
tccaccccctcccgatactgcattgtggggttccc

SEQ ID NO: 3301 - DNA, 36 bp, Artificial Sequence
  Synthetic oligonucleotide
tcaggtccccatccattgttttgttttaccgcctca

SEQ ID NO: 3302 - DNA, 35 bp, Artificial Sequence
  Synthetic oligonucleotide
accgacggaccggtctgtcgccacttttttgccta

SEQ ID NO: 3303 - DNA, 36 bp, Artificial Sequence
  Synthetic oligonucleotide
ggagccacccatcttattagcagcctttctcctaca

SEQ ID NO: 3304 - DNA, 36 bp, Artificial Sequence
  Synthetic oligonucleotide
tatccccacctcgatgctgctacccatggcccttta

SEQ ID NO: 3305 - DNA, 37 bp, Artificial Sequence
  Synthetic oligonucleotide
tcccccgatcagtcgcaccttttgctaccgtctccga

SEQ ID NO: 3306 - DNA, 35 bp, Artificial Sequence
  Synthetic oligonucleotide
tgttcactcgctctttcgttatcacaacatcccac

SEQ ID NO: 3307 - DNA, 35 bp, Artificial Sequence
  Synthetic oligonucleotide
tctcgccggccccttgcattcctccaccgtcctgt

SEQ ID NO: 3308 - DNA, 35 bp, Artificial Sequence
  Synthetic oligonucleotide
atccaccccagccaatctgcccctgccaccattgt

SEQ ID NO: 3309 - DNA, 36 bp, Artificial Sequence
  Synthetic oligonucleotide
gccacctccatgccggtatccgtattctcttgctta

SEQ ID NO: 3310 - DNA, 35 bp, Artificial Sequence
  Synthetic oligonucleotide
gttgtgacccctgttggtgcctatccgatccctcc

SEQ ID NO: 3311 - DNA, 35 bp, Artificial Sequence
  Synthetic oligonucleotide
tccacctccctccgatttgcattcgcttggtttca

SEQ ID NO: 3312 - DNA, 35 bp, Artificial Sequence
  Synthetic oligonucleotide
tctccaccctccagtttgttcgactgtgcgccctc

SEQ ID NO: 3313 - DNA, 35 bp, Artificial Sequence
  Synthetic oligonucleotide
tcaacacgtgccggtgttgaacatattgatttctt

SEQ ID NO: 3314 - DNA, 35 bp, Artificial Sequence
  Synthetic oligonucleotide
ttcccaccgccttattacaactgccatcgtgaccg

SEQ ID NO: 3315 - DNA, 35 bp, Artificial Sequence
  Synthetic oligonucleotide
acaagccccgctccctccgtgtcgttttgtctccc

SEQ ID NO: 3316 - DNA, 35 bp, Artificial Sequence
  Synthetic oligonucleotide
aatggccacgctttctcccactgtcctgtagccct

SEQ ID NO: 3317 - DNA, 36 bp, Artificial Sequence
  Synthetic oligonucleotide
ttgcgacccggcgcttttacttccgtttgttcctca

SEQ ID NO: 3318 - DNA, 36 bp, Artificial Sequence
  Synthetic oligonucleotide
tgtccggccccacctgtctcctgtcacataccacga

SEQ ID NO: 3319 - DNA, 38 bp, Artificial Sequence
  Synthetic oligonucleotide
tcactcaccgctgatctcaatcgactacctccctgtga

SEQ ID NO: 3320 - DNA, 36 bp, Artificial Sequence
  Synthetic oligonucleotide
gaagggcgtaggggaggggaacgggaggagtacgga

SEQ ID NO: 3321 - DNA, 36 bp, Artificial Sequence
  Synthetic oligonucleotide
gtgcgccacactgtcgtcgtttgctaccctgcccta

SEQ ID NO: 3322 - DNA, 35 bp, Artificial Sequence
  Synthetic oligonucleotide
tcccagagccaccgctttttgatttgccatttttg

SEQ ID NO: 3323 - DNA, 35 bp, Artificial Sequence
  Synthetic oligonucleotide
tcaatccgcctgtacatgcctcacacactgaattc

SEQ ID NO: 3324 - DNA, 35 bp, Artificial Sequence
  Synthetic oligonucleotide
caccctcgcccctttttgaccttgctgtttattcg

SEQ ID NO: 3325 - DNA, 34 bp, Artificial Sequence
  Synthetic oligonucleotide
gccgtcactcgcacacgcctgggtttcctctcac

SEQ ID NO: 3326 - DNA, 37 bp, Artificial Sequence
  Synthetic oligonucleotide
gattggggctgggaggggttccgattagtcttgggga

SEQ ID NO: 3327 - DNA, 35 bp, Artificial Sequence
  Synthetic oligonucleotide
accgtgccctcacgcctcgtatcccctgaacttgt

SEQ ID NO: 3328 - DNA, 35 bp, Artificial Sequence
  Synthetic oligonucleotide
gtctacgcccgcacgtgctttgctgcccaatctta

SEQ ID NO: 3329 - DNA, 36 bp, Artificial Sequence
  Synthetic oligonucleotide
agtgcctcccgaccgtatttggccgctcttttcaca

SEQ ID NO: 3330 - DNA, 35 bp, Artificial Sequence
  Synthetic oligonucleotide
atccgcccctcctagttcgttttccgggccctacc

SEQ ID NO: 3331 - DNA, 34 bp, Artificial Sequence
  Synthetic oligonucleotide
aacgtcccacccctgtctagtcggttatctgtcc

SEQ ID NO: 3332 - DNA, 35 bp, Artificial Sequence
  Synthetic oligonucleotide
aatgcaaccgcagcctatcgcgtttactttccatc

SEQ ID NO: 3333 - DNA, 37 bp, Artificial Sequence
  Synthetic oligonucleotide
accaccaccacgggcaaccacagtcactcgttcatga

SEQ ID NO: 3334 - DNA, 35 bp, Artificial Sequence
  Synthetic oligonucleotide
gacccacactgcagtgcttcttcgtctcctcttca

SEQ ID NO: 3335 - DNA, 35 bp, Artificial Sequence
  Synthetic oligonucleotide
acatcaacccctcctgaactgcacatgggcaccct

SEQ ID NO: 3336 - DNA, 35 bp, Artificial Sequence
  Synthetic oligonucleotide
accgcccccccctcgtaaagaccatgctggcacct

SEQ ID NO: 3337 - DNA, 37 bp, Artificial Sequence
  Synthetic oligonucleotide
tagacacgccaccgcacccgtattttgcaccacctga

SEQ ID NO: 3338 - DNA, 34 bp, Artificial Sequence
  Synthetic oligonucleotide
gcccaccgcgaggtccgtcgctacacaccaatcc

SEQ ID NO: 3339 - DNA, 35 bp, Artificial Sequence
  Synthetic oligonucleotide
tgtcgccccggtcctttataacccctcctgcgctc

SEQ ID NO: 3340 - DNA, 38 bp, Artificial Sequence
  Synthetic oligonucleotide
tcagtcaccccttgtcgtacgcccgtccatcctcctga

SEQ ID NO: 3341 - DNA, 35 bp, Artificial Sequence
  Synthetic oligonucleotide
acgagcccagtagccaagccgccacccctttatgt

SEQ ID NO: 3342 - DNA, 35 bp, Artificial Sequence
  Synthetic oligonucleotide
atcgtcaacgctgcgtttttcgatcctttccctca

SEQ ID NO: 3343 - DNA, 37 bp, Artificial Sequence
  Synthetic oligonucleotide
taacctgcccccccgcctcatcagccaagtcgcatga

SEQ ID NO: 3344 - DNA, 34 bp, Artificial Sequence
  Synthetic oligonucleotide
gccaacccctttctgttaaccgctacgcattcca

SEQ ID NO: 3345 - DNA, 35 bp, Artificial Sequence
  Synthetic oligonucleotide
gtccccaaagccccgcccccacatctcaatggtcg

SEQ ID NO: 3346 - DNA, 35 bp, Artificial Sequence
  Synthetic oligonucleotide
gatcatcccctggtttggtttcattagcctgtttt

SEQ ID NO: 3347 - DNA, 35 bp, Artificial Sequence
  Synthetic oligonucleotide
tgatgcccctagtgtcccgccatcccatgccgtcc

SEQ ID NO: 3348 - DNA, 35 bp, Artificial Sequence
  Synthetic oligonucleotide
actgccgttcgacgtcgaacccacacctacgcttc

SEQ ID NO: 3349 - DNA, 35 bp, Artificial Sequence
  Synthetic oligonucleotide
aactgtcgcaccagcgatgactcttcgctccccct

SEQ ID NO: 3350 - DNA, 35 bp, Artificial Sequence
  Synthetic oligonucleotide
cattacgatgccttccatgtccgtgagaacctatc

SEQ ID NO: 3351 - DNA, 35 bp, Artificial Sequence
  Synthetic oligonucleotide
gacgccctgatgtacccgccatgtctcacccgttc

SEQ ID NO: 3352 - DNA, 37 bp, Artificial Sequence
  Synthetic oligonucleotide
agtgccagcacaccgagatctaatccaccctgcccga

SEQ ID NO: 3353 - DNA, 35 bp, Artificial Sequence
  Synthetic oligonucleotide
gtgcgcccactggtacccgacgttgcctcatcctc

SEQ ID NO: 3354 - DNA, 37 bp, Artificial Sequence
  Synthetic oligonucleotide
tcaccatgcttggctgtttctgctttatactcttcga

SEQ ID NO: 3355 - DNA, 36 bp, Artificial Sequence
  Synthetic oligonucleotide
tagtgatgccctgccctgtcctatgaaaccaaccca

SEQ ID NO: 3356 - DNA, 36 bp, Artificial Sequence
  Synthetic oligonucleotide
tgcgactgctcgccgtccaatgctaccccgctctta

SEQ ID NO: 3357 - DNA, 37 bp, Artificial Sequence
  Synthetic oligonucleotide
atgactgccaccggtgtctaccatcctgcccacttga

SEQ ID NO: 3358 - DNA, 35 bp, Artificial Sequence
  Synthetic oligonucleotide
gccacatcctccactccggcctccccgagccgtac

SEQ ID NO: 3359 - DNA, 38 bp, Artificial Sequence
  Synthetic oligonucleotide
gcccagccgcccctttccgtaggactgacttcccctga

SEQ ID NO: 3360 - DNA, 35 bp, Artificial Sequence
  Synthetic oligonucleotide
gtgccctgcacgcatgccgtagacccgttcccatc

SEQ ID NO: 3361 - DNA, 36 bp, Artificial Sequence
  Synthetic oligonucleotide
taccaccacacaactgtgcattacttcacctcctga

SEQ ID NO: 3362 - DNA, 35 bp, Artificial Sequence
  Synthetic oligonucleotide
tcaccccgccacttggggccttccagtctttcaac

SEQ ID NO: 3363 - DNA, 35 bp, Artificial Sequence
  Synthetic oligonucleotide
aacgcgcctcgctatccccaaaccgctaacatgtt

SEQ ID NO: 3364 - DNA, 35 bp, Artificial Sequence
  Synthetic oligonucleotide
ttaagccgccgttccccgttctgcgtttgccctat

SEQ ID NO: 3365 - DNA, 36 bp, Artificial Sequence
  Synthetic oligonucleotide
acacgactaacagtcgcttcaggatccccgccttca

SEQ ID NO: 3366 - DNA, 35 bp, Artificial Sequence
  Synthetic oligonucleotide
aagtcaaccgcactccgccaccacgcacaatcgtt

SEQ ID NO: 3367 - DNA, 37 bp, Artificial Sequence
  Synthetic oligonucleotide
gcaacccctgaccgacctccctagccacactgcgcga

SEQ ID NO: 3368 - DNA, 35 bp, Artificial Sequence
  Synthetic oligonucleotide
gatgccccatctcgcctcttcactccatcatttgt

SEQ ID NO: 3369 - DNA, 35 bp, Artificial Sequence
  Synthetic oligonucleotide
gtagcccgtcattcctgtaccgcctgcatctattc

SEQ ID NO: 3370 - DNA, 36 bp, Artificial Sequence
  Synthetic oligonucleotide
tcatcgcccgaccggatcgtccacacccgtcccaca

SEQ ID NO: 3371 - DNA, 35 bp, Artificial Sequence
  Synthetic oligonucleotide
cccgttccgaattaactcccgcctgccatttcacg

SEQ ID NO: 3372 - DNA, 36 bp, Artificial Sequence
  Synthetic oligonucleotide
atgaagggagggaggggtggaaggagagactcggta

SEQ ID NO: 3373 - DNA, 35 bp, Artificial Sequence
  Synthetic oligonucleotide
tgcaatcgtacttctcggttccctgctcctgtgcc

SEQ ID NO: 3374 - DNA, 35 bp, Artificial Sequence
  Synthetic oligonucleotide
gtgacaaccattctgcctctttcctcatgtcgtgc

SEQ ID NO: 3375 - DNA, 35 bp, Artificial Sequence
  Synthetic oligonucleotide
gcctcatccccccacagcctatgtagacccctgct

SEQ ID NO: 3376 - DNA, 36 bp, Artificial Sequence
  Synthetic oligonucleotide
atccccaccgcctgttgatctaacactgtccaacca

SEQ ID NO: 3377 - DNA, 36 bp, Artificial Sequence
  Synthetic oligonucleotide
tatcgctcctccgactctgacttttgatgcctccca

SEQ ID NO: 3378 - DNA, 35 bp, Artificial Sequence
  Synthetic oligonucleotide
accaccactggactgcccatgatcacaccatttca

SEQ ID NO: 3379 - DNA, 37 bp, Artificial Sequence
  Synthetic oligonucleotide
accaccgcccgcggctatcaccctcgtctttccctga

SEQ ID NO: 3380 - DNA, 35 bp, Artificial Sequence
  Synthetic oligonucleotide
gcgagggaataggtgggtctggggtggtggtgggg

SEQ ID NO: 3381 - DNA, 35 bp, Artificial Sequence
  Synthetic oligonucleotide
gggacgctggggacaacacagaggggtcaagaggg

SEQ ID NO: 3382 - DNA, 36 bp, Artificial Sequence
  Synthetic oligonucleotide
aagtcaaccacaccccttcgtttacaggccaccaca

SEQ ID NO: 3383 - DNA, 36 bp, Artificial Sequence
  Synthetic oligonucleotide
ttcaccatccatttgtccccctccccttctgggcga

SEQ ID NO: 3384 - DNA, 37 bp, Artificial Sequence
  Synthetic oligonucleotide
atcgcgggggggaggaaattgagggtgggatatccga

SEQ ID NO: 3385 - DNA, 35 bp, Artificial Sequence
  Synthetic oligonucleotide
tagcaacccacataccatccgttcacatagcttcg

SEQ ID NO: 3386 - DNA, 35 bp, Artificial Sequence
  Synthetic oligonucleotide
tctatccccgacttccgtgtcacctagccaccgcc

SEQ ID NO: 3387 - DNA, 37 bp, Artificial Sequence
  Synthetic oligonucleotide
actgccatcggcccccgccctgatcccttggccatga

SEQ ID NO: 3388 - DNA, 37 bp, Artificial Sequence
  Synthetic oligonucleotide
taacagccgcaccccccctgtattcagctccatccga

SEQ ID NO: 3389 - DNA, 36 bp, Artificial Sequence
  Synthetic oligonucleotide
gcacatctgccgttgcgaaaccttgccttgcatcca

SEQ ID NO: 3390 - DNA, 35 bp, Artificial Sequence
  Synthetic oligonucleotide
accacgcccgttacaattcgccactgtctcactcc

SEQ ID NO: 3391 - DNA, 35 bp, Artificial Sequence
  Synthetic oligonucleotide
tccccacgcgcacattgtttggttctgtcttcgct

SEQ ID NO: 3392 - DNA, 36 bp, Artificial Sequence
  Synthetic oligonucleotide
gtcacgtcgccatgtcgccccttatccttcctcgca

SEQ ID NO: 3393 - DNA, 35 bp, Artificial Sequence
  Synthetic oligonucleotide
ttagcaccaccagttctgcagcgtgaccgcattcc

SEQ ID NO: 3394 - DNA, 36 bp, Artificial Sequence
  Synthetic oligonucleotide
gaaggagagggcgaacgggagggacaggaacgacca

SEQ ID NO: 3395 - DNA, 36 bp, Artificial Sequence
  Synthetic oligonucleotide
gtgcgccccccattgctgtgcccgctccaataccca

SEQ ID NO: 3396 - DNA, 35 bp, Artificial Sequence
  Synthetic oligonucleotide
gcactggtcagtgcttcacattcctgctccctgct

SEQ ID NO: 3397 - DNA, 37 bp, Artificial Sequence
  Synthetic oligonucleotide
gtggggcaacacgcgagacggagggtgggaggggaga

SEQ ID NO: 3398 - DNA, 35 bp, Artificial Sequence
  Synthetic oligonucleotide
atgaccacgccggacggcggtcccttacttcacct

SEQ ID NO: 3399 - DNA, 35 bp, Artificial Sequence
  Synthetic oligonucleotide
atccgccgaggcctaccggtccttctttccactgc

SEQ ID NO: 3400 - DNA, 35 bp, Artificial Sequence
  Synthetic oligonucleotide
gtcacatccagcagtactacgacctgtactttcct

SEQ ID NO: 3401 - DNA, 35 bp, Artificial Sequence
  Synthetic oligonucleotide
gtgggtcgccgtatcgttgtacttctctctcttgt

SEQ ID NO: 3402 - DNA, 35 bp, Artificial Sequence
  Synthetic oligonucleotide
tcgaccatctctactgcactataggccttctctcg

SEQ ID NO: 3403 - DNA, 35 bp, Artificial Sequence
  Synthetic oligonucleotide
aacacgcgcccacgcacgtttccatccgccttccc

SEQ ID NO: 3404 - DNA, 35 bp, Artificial Sequence
  Synthetic oligonucleotide
tgacgcccctgtgccatccagttccggcgtgttcc

SEQ ID NO: 3405 - DNA, 35 bp, Artificial Sequence
  Synthetic oligonucleotide
ggacatcgccgctactcccctctgtctgtcatttc

SEQ ID NO: 3406 - DNA, 35 bp, Artificial Sequence
  Synthetic oligonucleotide
atgtcactgtcctggctaatgcacgctgtacttcc

SEQ ID NO: 3407 - DNA, 37 bp, Artificial Sequence
  Synthetic oligonucleotide
acacccccatgccacgtgcacctatttccagccttga

SEQ ID NO: 3408 - DNA, 35 bp, Artificial Sequence
  Synthetic oligonucleotide
acctccgccgctcgacctgtcttgcctttacctcg

SEQ ID NO: 3409 - DNA, 34 bp, Artificial Sequence
  Synthetic oligonucleotide
tcccccgccgccggcccatcaaagtcacctacac

SEQ ID NO: 3410 - DNA, 35 bp, Artificial Sequence
  Synthetic oligonucleotide
atgcccacacacctgagtgccctcaaaccgcatta

SEQ ID NO: 3411 - DNA, 36 bp, Artificial Sequence
  Synthetic oligonucleotide
gacttgccatcacacagccgcactcagtctactgaa

SEQ ID NO: 3412 - DNA, 38 bp, Artificial Sequence
  Synthetic oligonucleotide
gtcgccgtgacgtacttattacctagccccatctgtga

SEQ ID NO: 3413 - DNA, 36 bp, Artificial Sequence
  Synthetic oligonucleotide
ttggcctcccacctgtgctttgttcgcccacaccca

SEQ ID NO: 3414 - DNA, 35 bp, Artificial Sequence
  Synthetic oligonucleotide
ttagttgaaacgggggtggacgggggggtaggagg

SEQ ID NO: 3415 - DNA, 35 bp, Artificial Sequence
  Synthetic oligonucleotide
gacacacatcctgcaccccgagtttattgcctgcc

SEQ ID NO: 3416 - DNA, 38 bp, Artificial Sequence
  Synthetic oligonucleotide
cacaccttaccggcacatcagaagtacctcccctctga

SEQ ID NO: 3417 - DNA, 35 bp, Artificial Sequence
  Synthetic oligonucleotide
gacatccctagccctgtaaagtacgtgcccggtcc

SEQ ID NO: 3418 - DNA, 35 bp, Artificial Sequence
  Synthetic oligonucleotide
tttacccccgccggttcccccaaggccttgaggcc

SEQ ID NO: 3419 - DNA, 35 bp, Artificial Sequence
  Synthetic oligonucleotide
acaaccgacccgccttcctgccgaactagaccgct

SEQ ID NO: 3420 - DNA, 35 bp, Artificial Sequence
  Synthetic oligonucleotide
tcctccacatccgagaggatgccactatccctgtt

SEQ ID NO: 3421 - DNA, 35 bp, Artificial Sequence
  Synthetic oligonucleotide
tctgcgtgcaccgaccccggccttccttgctaacc

SEQ ID NO: 3422 - DNA, 35 bp, Artificial Sequence
  Synthetic oligonucleotide
gcacaccgtatgacttttaacctctgctggcctcc

SEQ ID NO: 3423 - DNA, 35 bp, Artificial Sequence
  Synthetic oligonucleotide
acgtccgtccgcccccctgtcctagccatgtatgc

SEQ ID NO: 3424 - DNA, 35 bp, Artificial Sequence
  Synthetic oligonucleotide
tcaacaccaactcggacgatagtcgcctgtcccac

SEQ ID NO: 3425 - DNA, 35 bp, Artificial Sequence
  Synthetic oligonucleotide
tgccatccttcttccttacgtgctctgctgtcacc

SEQ ID NO: 3426 - DNA, 36 bp, Artificial Sequence
  Synthetic oligonucleotide
gaccaccatccctgcactacgtacgtgagccctgca

SEQ ID NO: 3427 - DNA, 35 bp, Artificial Sequence
  Synthetic oligonucleotide
tccccaccccgcacgttcgctatcatagctggcct

SEQ ID NO: 3428 - DNA, 35 bp, Artificial Sequence
  Synthetic oligonucleotide
gtgtgaccacgcccttcccatacccgtctcagtcc

SEQ ID NO: 3429 - DNA, 35 bp, Artificial Sequence
  Synthetic oligonucleotide
gacgaaggatacgggttgtagggggggaggtgaga

SEQ ID NO: 3430 - DNA, 35 bp, Artificial Sequence
  Synthetic oligonucleotide
acctcatgtcgacctgctagcatatacactatccc

SEQ ID NO: 3431 - DNA, 38 bp, Artificial Sequence
  Synthetic oligonucleotide
tcgagcgggggagagagggtagtttaggggtgggttga

SEQ ID NO: 3432 - DNA, 35 bp, Artificial Sequence
  Synthetic oligonucleotide
tacacccgacccctttacgctcgttacgtgagtaa

SEQ ID NO: 3433 - DNA, 35 bp, Artificial Sequence
  Synthetic oligonucleotide
gaggacgtgcaagcactcaaccgccctcactcctt

SEQ ID NO: 3434 - DNA, 35 bp, Artificial Sequence
  Synthetic oligonucleotide
gtccgccctgtacctatgccactcgaaacccgttc

SEQ ID NO: 3435 - DNA, 37 bp, Artificial Sequence
  Synthetic oligonucleotide
gacccgccggcaaactgaccgccctcttagttcctga

SEQ ID NO: 3436 - DNA, 35 bp, Artificial Sequence
  Synthetic oligonucleotide
gcccttcccaagatgaggattacccacccttactg

SEQ ID NO: 3437 - DNA, 36 bp, Artificial Sequence
  Synthetic oligonucleotide
tgaccatcccggacgctcgctattgacacatcccca

SEQ ID NO: 3438 - DNA, 34 bp, Artificial Sequence
  Synthetic oligonucleotide
atacgccaccgactcgcccgcccatcacccggaa

SEQ ID NO: 3439 - DNA, 35 bp, Artificial Sequence
  Synthetic oligonucleotide
aacatcctgccccccacgccgacgccgaacgcctg

SEQ ID NO: 3440 - DNA, 36 bp, Artificial Sequence
  Synthetic oligonucleotide
tcccctgcctccccatttagatacacgctgttatca

SEQ ID NO: 3441 - DNA, 35 bp, Artificial Sequence
  Synthetic oligonucleotide
attgtccgccccatcgtttcgtttcggtcttacca

SEQ ID NO: 3442 - DNA, 37 bp, Artificial Sequence
  Synthetic oligonucleotide
aactggcgaccctgcacctctgagccccgactaccga

SEQ ID NO: 3443 - DNA, 35 bp, Artificial Sequence
  Synthetic oligonucleotide
gcataacaccatggcgcgtccctccaccacaccat

SEQ ID NO: 3444 - DNA, 35 bp, Artificial Sequence
  Synthetic oligonucleotide
tacacgtcggatccctctgtgcgttccattccctc

SEQ ID NO: 3445 - DNA, 36 bp, Artificial Sequence
  Synthetic oligonucleotide
ttcacgtagcttgttccacctgcaactcccgttcca

SEQ ID NO: 3446 - DNA, 35 bp, Artificial Sequence
  Synthetic oligonucleotide
ttgacccgaccgcttgcactgttacttcctaattt

SEQ ID NO: 3447 - DNA, 35 bp, Artificial Sequence
  Synthetic oligonucleotide
tgcaaatccagctgccgtcccccccgaccccattc

SEQ ID NO: 3448 - DNA, 35 bp, Artificial Sequence
  Synthetic oligonucleotide
gcctgctctcgccctctagctacggactcctccta

SEQ ID NO: 3449 - DNA, 37 bp, Artificial Sequence
  Synthetic oligonucleotide
gtcctccgccccacccacagcctccaatctcagtgga

SEQ ID NO: 3450 - DNA, 35 bp, Artificial Sequence
  Synthetic oligonucleotide
tgagccacccgttccttgccgtctttttgcccgtt

SEQ ID NO: 3451 - DNA, 35 bp, Artificial Sequence
  Synthetic oligonucleotide
tcccaaccccacgcagttataaacggtttttcatc

SEQ ID NO: 3452 - DNA, 35 bp, Artificial Sequence
  Synthetic oligonucleotide
acaccacctcagtacactcaacctggccaacgtta

SEQ ID NO: 3453 - DNA, 37 bp, Artificial Sequence
  Synthetic oligonucleotide
aacgcccccctctgccctttgttcagtcaggatctga

SEQ ID NO: 3454 - DNA, 35 bp, Artificial Sequence
  Synthetic oligonucleotide
gccctgcctgccgcccttctgggtacatcctcacc

SEQ ID NO: 3455 - DNA, 38 bp, Artificial Sequence
  Synthetic oligonucleotide
atgccacgtcgcctgcctccctggttcacacgctttga

SEQ ID NO: 3456 - DNA, 35 bp, Artificial Sequence
  Synthetic oligonucleotide
tgcgcatcccgacgctggcgcattaaccctccatc

SEQ ID NO: 3457 - DNA, 38 bp, Artificial Sequence
  Synthetic oligonucleotide
tcccgccccctataccacaattagcacgtcatctatga

SEQ ID NO: 3458 - DNA, 36 bp, Artificial Sequence
  Synthetic oligonucleotide
aacaggcgaatgtcacatgcccctccctattcacca

SEQ ID NO: 3459 - DNA, 35 bp, Artificial Sequence
  Synthetic oligonucleotide
cacgtaccaccgcgggcgccacggatcacttcacg

SEQ ID NO: 3460 - DNA, 35 bp, Artificial Sequence
  Synthetic oligonucleotide
tccgtatccgctaactatctgtgcctgtgccgttt

SEQ ID NO: 3461 - DNA, 35 bp, Artificial Sequence
  Synthetic oligonucleotide
atcccaggccgacacatgctcccctgttcacctcc

SEQ ID NO: 3462 - DNA, 35 bp, Artificial Sequence
  Synthetic oligonucleotide
taactcccccaggaagacctgcactctccttcgtc

SEQ ID NO: 3463 - DNA, 38 bp, Artificial Sequence
  Synthetic oligonucleotide
cccgccgtcaccccctacccgcacgcagaaggacctga

SEQ ID NO: 3464 - DNA, 36 bp, Artificial Sequence
  Synthetic oligonucleotide
gcacacccgttcgtttcatatgcctgccctccctca

SEQ ID NO: 3465 - DNA, 37 bp, Artificial Sequence
  Synthetic oligonucleotide
gatctcaatgcctgtgtaccatccccgccctccttga

SEQ ID NO: 3466 - DNA, 35 bp, Artificial Sequence
  Synthetic oligonucleotide
tctccaccccaggactggttaccacctctcaaacg

SEQ ID NO: 3467 - DNA, 35 bp, Artificial Sequence
  Synthetic oligonucleotide
ttggtccaccccgcctatgtgccgttgccgctgcc

SEQ ID NO: 3468 - DNA, 36 bp, Artificial Sequence
  Synthetic oligonucleotide
aaacgcctcgcgtgcccgttcaccccgtccctccca

SEQ ID NO: 3469 - DNA, 35 bp, Artificial Sequence
  Synthetic oligonucleotide
gccaagtaccgccgcatttatgaaccatcctgagt

SEQ ID NO: 3470 - DNA, 36 bp, Artificial Sequence
  Synthetic oligonucleotide
gtacgaatggggtggagtggaaatggggctagggaa

SEQ ID NO: 3471 - DNA, 37 bp, Artificial Sequence
  Synthetic oligonucleotide
acccccgccctccgctatctgtacgatctcttatgga

SEQ ID NO: 3472 - DNA, 35 bp, Artificial Sequence
  Synthetic oligonucleotide
tccaccatccgcgctgacgccgcttattgccccgc

SEQ ID NO: 3473 - DNA, 37 bp, Artificial Sequence
  Synthetic oligonucleotide
ggggcgagtgggtagggtgggttgattactatcatga

SEQ ID NO: 3474 - DNA, 35 bp, Artificial Sequence
  Synthetic oligonucleotide
gcacgacaatctctcccgtagctatgtcctttcac

SEQ ID NO: 3475 - DNA, 35 bp, Artificial Sequence
  Synthetic oligonucleotide
gtacacgcactttttcacacgccacacctgccttg

SEQ ID NO: 3476 - DNA, 35 bp, Artificial Sequence
  Synthetic oligonucleotide
atggtggtgcgccttccgaattctgcctccccgtt

SEQ ID NO: 3477 - DNA, 35 bp, Artificial Sequence
  Synthetic oligonucleotide
accatcgcacaacttatgaatccatcctgccaggc

SEQ ID NO: 3478 - DNA, 38 bp, Artificial Sequence
  Synthetic oligonucleotide
tcatggggtggggaattgtatggggtcaaggggtttga

SEQ ID NO: 3479 - DNA, 35 bp, Artificial Sequence
  Synthetic oligonucleotide
tccaccaccccccattcagaagaaacctgtcatcg

SEQ ID NO: 3480 - DNA, 35 bp, Artificial Sequence
  Synthetic oligonucleotide
gcccacctcaccgcccatgccctccctgtctagag

SEQ ID NO: 3481 - DNA, 35 bp, Artificial Sequence
  Synthetic oligonucleotide
tcgcccctccgcttggttcttgctcctcttggtcg

SEQ ID NO: 3482 - DNA, 35 bp, Artificial Sequence
  Synthetic oligonucleotide
ataccaccgccttgtcacgctatattccccggtcc

SEQ ID NO: 3483 - DNA, 35 bp, Artificial Sequence
  Synthetic oligonucleotide
tcagccttacttgtgcccgttccaccgcctgcgcc

SEQ ID NO: 3484 - DNA, 35 bp, Artificial Sequence
  Synthetic oligonucleotide
tccccatgccctcttctattccgtaaggcacttcc

SEQ ID NO: 3485 - DNA, 35 bp, Artificial Sequence
  Synthetic oligonucleotide
gtagccccatgtggcctcgaccttgcacgcccttc

SEQ ID NO: 3486 - DNA, 35 bp, Artificial Sequence
  Synthetic oligonucleotide
tcgaaccccatctggcccccatcgcactgagttcc

SEQ ID NO: 3487 - DNA, 35 bp, Artificial Sequence
  Synthetic oligonucleotide
acccaatcccacccgtcatgtcttccatgtgcact

SEQ ID NO: 3488 - DNA, 36 bp, Artificial Sequence
  Synthetic oligonucleotide
acttacgcccccatgtcgccttcagtgccccaatta

SEQ ID NO: 3489 - DNA, 36 bp, Artificial Sequence
  Synthetic oligonucleotide
tcacgcacgatgctctttcctgtctcctctttgtta

SEQ ID NO: 3490 - DNA, 34 bp, Artificial Sequence
  Synthetic oligonucleotide
gatgagcgccgaactccgcccgccttcccttcca

SEQ ID NO: 3491 - DNA, 35 bp, Artificial Sequence
  Synthetic oligonucleotide
accaccctcaatggtcctttactctattgcaccca

SEQ ID NO: 3492 - DNA, 35 bp, Artificial Sequence
  Synthetic oligonucleotide
gatcgccaccggcctcaccgactgacctccccccc

SEQ ID NO: 3493 - DNA, 34 bp, Artificial Sequence
  Synthetic oligonucleotide
aacgccaaccatcgcatcgacaccttaccttttg

SEQ ID NO: 3494 - DNA, 36 bp, Artificial Sequence
  Synthetic oligonucleotide
gtccacacctcatgctatgggaccgctcttactcca

SEQ ID NO: 3495 - DNA, 36 bp, Artificial Sequence
  Synthetic oligonucleotide
acacgccactgccatctaaagtcaaacgctcgctca

SEQ ID NO: 3496 - DNA, 35 bp, Artificial Sequence
  Synthetic oligonucleotide
actaccctgacctatggtgtgccagccctgccccc

SEQ ID NO: 3497 - DNA, 35 bp, Artificial Sequence
  Synthetic oligonucleotide
gacaccgtcacacgtcactccacgaccatctccca

SEQ ID NO: 3498 - DNA, 35 bp, Artificial Sequence
  Synthetic oligonucleotide
tctcgccccgaccacctaccattgccttaggaaca

SEQ ID NO: 3499 - DNA, 35 bp, Artificial Sequence
  Synthetic oligonucleotide
ttccgccccatctctgacaccaggacgttcctcat

SEQ ID NO: 3500 - DNA, 36 bp, Artificial Sequence
  Synthetic oligonucleotide
aagaggggcccggacaaggcaacaaggggggtggaa

SEQ ID NO: 3501 - DNA, 35 bp, Artificial Sequence
  Synthetic oligonucleotide
tcaatggcggtggaggggcggttagggtggatcag

SEQ ID NO: 3502 - DNA, 37 bp, Artificial Sequence
  Synthetic oligonucleotide
tgcacccctcagcgctccctcgccaatctttccggga

SEQ ID NO: 3503 - DNA, 35 bp, Artificial Sequence
  Synthetic oligonucleotide
tcgcactcctcaatcacgcatcattctggaccacc

SEQ ID NO: 3504 - DNA, 37 bp, Artificial Sequence
  Synthetic oligonucleotide
tgaccatcctgctggattccacctcccattcattcga

SEQ ID NO: 3505 - DNA, 34 bp, Artificial Sequence
  Synthetic oligonucleotide
tccactatccagatcgctgctccatgccctgtac

SEQ ID NO: 3506 - DNA, 35 bp, Artificial Sequence
  Synthetic oligonucleotide
gccacttaccgcctcttttatgcagggccccacca

SEQ ID NO: 3507 - DNA, 35 bp, Artificial Sequence
  Synthetic oligonucleotide
accgccctgcccgttattttccttgcatttgtttg

SEQ ID NO: 3508 - DNA, 35 bp, Artificial Sequence
  Synthetic oligonucleotide
atcctccccgtcgctccgtttgcactagcctgcct

SEQ ID NO: 3509 - DNA, 35 bp, Artificial Sequence
  Synthetic oligonucleotide
accctacctcgagtgatacacccgccgctgccccc

SEQ ID NO: 3510 - DNA, 35 bp, Artificial Sequence
  Synthetic oligonucleotide
gaccccgactccgcaggtttgccttcgctaccgct

SEQ ID NO: 3511 - DNA, 35 bp, Artificial Sequence
  Synthetic oligonucleotide
aaccaccaacagtctgccctgacccccccgtgctc

SEQ ID NO: 3512 - DNA, 35 bp, Artificial Sequence
  Synthetic oligonucleotide
gcactccacttcacagggacccacttcaccttgcg

SEQ ID NO: 3513 - DNA, 36 bp, Artificial Sequence
  Synthetic oligonucleotide
aacgcgccctcgctgcttgcaacacgttttgttcga

SEQ ID NO: 3514 - DNA, 38 bp, Artificial Sequence
  Synthetic oligonucleotide
aagtcccgcccacatctgtacctagcccctcgcattga

SEQ ID NO: 3515 - DNA, 35 bp, Artificial Sequence
  Synthetic oligonucleotide
tcacccgacccgttgtccactgtctgaccctattt

SEQ ID NO: 3516 - DNA, 35 bp, Artificial Sequence
  Synthetic oligonucleotide
tgccgcagatcgcccgcttaaccccgtgccactcc

SEQ ID NO: 3517 - DNA, 35 bp, Artificial Sequence
  Synthetic oligonucleotide
tcccactcacggctctctgtttcccctgttagtcc

SEQ ID NO: 3518 - DNA, 35 bp, Artificial Sequence
  Synthetic oligonucleotide
gttcactccagtttgccgtacgttatccctgctga

SEQ ID NO: 3519 - DNA, 35 bp, Artificial Sequence
  Synthetic oligonucleotide
tgacacgctgccactcagtatcatgcatgcccctc

SEQ ID NO: 3520 - DNA, 37 bp, Artificial Sequence
  Synthetic oligonucleotide
tgacccacacgctgcgcaacgagcatcctttatccga

SEQ ID NO: 3521 - DNA, 35 bp, Artificial Sequence
  Synthetic oligonucleotide
tttcaccacccaacggcccaacaccacaggtgact

SEQ ID NO: 3522 - DNA, 37 bp, Artificial Sequence
  Synthetic oligonucleotide
gccaccgctgcctaccttccccagtcgctccacttga

SEQ ID NO: 3523 - DNA, 35 bp, Artificial Sequence
  Synthetic oligonucleotide
ttagctacccaccagtccagtggcccccccgccgc

SEQ ID NO: 3524 - DNA, 35 bp, Artificial Sequence
  Synthetic oligonucleotide
tccgctactcacacctggcaagcacccaactcatt

SEQ ID NO: 3525 - DNA, 35 bp, Artificial Sequence
  Synthetic oligonucleotide
gcatcctcacaactgtaccgcctcttggattctca

SEQ ID NO: 3526 - DNA, 37 bp, Artificial Sequence
  Synthetic oligonucleotide
agtcacggaggggaggggaggtacggttggtgtggga

SEQ ID NO: 3527 - DNA, 37 bp, Artificial Sequence
  Synthetic oligonucleotide
gccccatcctgtccacagtacttatgcctgtttccga

SEQ ID NO: 3528 - DNA, 35 bp, Artificial Sequence
  Synthetic oligonucleotide
ttgatctgtcccactgcctatcttgtttacgccac

SEQ ID NO: 3529 - DNA, 35 bp, Artificial Sequence
  Synthetic oligonucleotide
tccgatccgccctctctcattgcctgtacagcttg

SEQ ID NO: 3530 - DNA, 36 bp, Artificial Sequence
  Synthetic oligonucleotide
ttgcacccatgcactccctggccgacctgtcctaca

SEQ ID NO: 3531 - DNA, 35 bp, Artificial Sequence
  Synthetic oligonucleotide
gcaatccaccgtcccgccacgctcctcctagcctc

SEQ ID NO: 3532 - DNA, 35 bp, Artificial Sequence
  Synthetic oligonucleotide
gcccaccatgccggcctatgcctcacccgatactg

SEQ ID NO: 3533 - DNA, 36 bp, Artificial Sequence
  Synthetic oligonucleotide
accgcaccccagccccttcacctcacaggtctttaa

SEQ ID NO: 3534 - DNA, 36 bp, Artificial Sequence
  Synthetic oligonucleotide
gtctccgcccccttgttattctcgtccagccccgta

SEQ ID NO: 3535 - DNA, 36 bp, Artificial Sequence
  Synthetic oligonucleotide
tccccacccccgtttgtcactaccagcctgagacga

SEQ ID NO: 3536 - DNA, 35 bp, Artificial Sequence
  Synthetic oligonucleotide
gcctgggggcgttatgagggtggggcatggggtga

SEQ ID NO: 3537 - DNA, 35 bp, Artificial Sequence
  Synthetic oligonucleotide
atcactgtccacctgttcctaacacagccacttac

SEQ ID NO: 3538 - DNA, 34 bp, Artificial Sequence
  Synthetic oligonucleotide
gaatcacccgtgctgaatccctccttgctctggc

SEQ ID NO: 3539 - DNA, 36 bp, Artificial Sequence
  Synthetic oligonucleotide
gtcacccccgattgcttccctgacctcgtccactca

SEQ ID NO: 3540 - DNA, 38 bp, Artificial Sequence
  Synthetic oligonucleotide
gagggccgggtggtggggactaggtgggaggctgttga

SEQ ID NO: 3541 - DNA, 35 bp, Artificial Sequence
  Synthetic oligonucleotide
tccgccccgtaatattcctcatgatgtctccgctg

SEQ ID NO: 3542 - DNA, 35 bp, Artificial Sequence
  Synthetic oligonucleotide
gtgcctagctcgcctactcgtgttttttctcctct

SEQ ID NO: 3543 - DNA, 35 bp, Artificial Sequence
  Synthetic oligonucleotide
gacacgactgcctctagtatcgatcgtccctttct

SEQ ID NO: 3544 - DNA, 37 bp, Artificial Sequence
  Synthetic oligonucleotide
gacgacaccgccattcacacacctgcccgcaaatcga

SEQ ID NO: 3545 - DNA, 36 bp, Artificial Sequence
  Synthetic oligonucleotide
atgtgggcacatgtgcacttagccacctttcctcca

SEQ ID NO: 3546 - DNA, 35 bp, Artificial Sequence
  Synthetic oligonucleotide
tagtcgcacacacatcctcctttgcctggtgcctt

SEQ ID NO: 3547 - DNA, 35 bp, Artificial Sequence
  Synthetic oligonucleotide
gacgccccggtactatccgcattctaggctttccc

SEQ ID NO: 3548 - DNA, 35 bp, Artificial Sequence
  Synthetic oligonucleotide
tcactcaccctcccgtatgcaccgaacttcagact

SEQ ID NO: 3549 - DNA, 37 bp, Artificial Sequence
  Synthetic oligonucleotide
tgcatggtgccggacgtatgtactctcttctattctg

SEQ ID NO: 3550 - DNA, 35 bp, Artificial Sequence
  Synthetic oligonucleotide
acactccggtacgtacgcccttcactctctagcgc

SEQ ID NO: 3551 - DNA, 37 bp, Artificial Sequence
  Synthetic oligonucleotide
tgcgaccccgcgcgagtgcgatccctccccctgccga

SEQ ID NO: 3552 - DNA, 35 bp, Artificial Sequence
  Synthetic oligonucleotide
gcgatcctacgcccttttgagtttaccatcccgta

SEQ ID NO: 3553 - DNA, 35 bp, Artificial Sequence
  Synthetic oligonucleotide
tcacgtccccgctttccgtctgcttcgttttacct

SEQ ID NO: 3554 - DNA, 35 bp, Artificial Sequence
  Synthetic oligonucleotide
agaggggggagggagttcaggaagggtgatgggat

SEQ ID NO: 3555 - DNA, 35 bp, Artificial Sequence
  Synthetic oligonucleotide
acgccgacccctcgcactgttccttgccccgaacc

SEQ ID NO: 3556 - DNA, 36 bp, Artificial Sequence
  Synthetic oligonucleotide
atcgcacttcgccacattcctatcttctgtgaccaa

SEQ ID NO: 3557 - DNA, 35 bp, Artificial Sequence
  Synthetic oligonucleotide
acgcccccgacatgtctcctgtcagatcccctacc

SEQ ID NO: 3558 - DNA, 35 bp, Artificial Sequence
  Synthetic oligonucleotide
agcacctcccccagaccgtgacacccatctacgcc

SEQ ID NO: 3559 - DNA, 35 bp, Artificial Sequence
  Synthetic oligonucleotide
tcccacattcccgctgcttgtcactatttacgctc

SEQ ID NO: 3560 - DNA, 36 bp, Artificial Sequence
  Synthetic oligonucleotide
aacacccatgttggcaccgatccttgtcctgattca

SEQ ID NO: 3561 - DNA, 35 bp, Artificial Sequence
  Synthetic oligonucleotide
agtgccacaccgcttcccgcccgttttatcgctct

SEQ ID NO: 3562 - DNA, 35 bp, Artificial Sequence
  Synthetic oligonucleotide
tcacgctcccgtcgctcttccgtatttgcctgtcc

SEQ ID NO: 3563 - DNA, 35 bp, Artificial Sequence
  Synthetic oligonucleotide
ggtgaaccgctcccgttttatttttgttgtacttg

SEQ ID NO: 3564 - DNA, 37 bp, Artificial Sequence
  Synthetic oligonucleotide
agccacctgccttgttgtcttacttagcttgttacga

SEQ ID NO: 3565 - DNA, 35 bp, Artificial Sequence
  Synthetic oligonucleotide
actacaccgcggcttctacctcccttgcccctggt

SEQ ID NO: 3566 - DNA, 35 bp, Artificial Sequence
  Synthetic oligonucleotide
ttcacggacgtggaaactgctaccatcacccacac

SEQ ID NO: 3567 - DNA, 37 bp, Artificial Sequence
  Synthetic oligonucleotide
ttcccacccacctggctttcttagacgtagctcccga

SEQ ID NO: 3568 - DNA, 35 bp, Artificial Sequence
  Synthetic oligonucleotide
taaccatgcctcttgctatgccttatggtacatcc

SEQ ID NO: 3569 - DNA, 35 bp, Artificial Sequence
  Synthetic oligonucleotide
caccaagcctcctcgctgtaatacctcgtgttact

SEQ ID NO: 3570 - DNA, 35 bp, Artificial Sequence
  Synthetic oligonucleotide
gacaacgctcgccgccatggaaccacacgctacac

SEQ ID NO: 3571 - DNA, 35 bp, Artificial Sequence
  Synthetic oligonucleotide
tgttgccggcccacagctcattaccttgccttgcc

SEQ ID NO: 3572 - DNA, 37 bp, Artificial Sequence
  Synthetic oligonucleotide
aaccgccaccgcgcaatccgcctttgagttcctacga

SEQ ID NO: 3573 - DNA, 38 bp, Artificial Sequence
  Synthetic oligonucleotide
tctgtggcctggagggggtaatggagtaggaggggtga

SEQ ID NO: 3574 - DNA, 35 bp, Artificial Sequence
  Synthetic oligonucleotide
gcctaccatccgctcaccatccgacactgttcgtg

SEQ ID NO: 3575 - DNA, 35 bp, Artificial Sequence
  Synthetic oligonucleotide
gtgaggacggagagaggaggtatgcggtgtggagg

SEQ ID NO: 3576 - DNA, 35 bp, Artificial Sequence
  Synthetic oligonucleotide
tgcgatccgcccctgtttgtcatctcactatttgt

SEQ ID NO: 3577 - DNA, 35 bp, Artificial Sequence
  Synthetic oligonucleotide
tacgcttgccctgccattgtcacctcatgctcctt

SEQ ID NO: 3578 - DNA, 35 bp, Artificial Sequence
  Synthetic oligonucleotide
gcacatccctgctggaatagcgtaccatctatcct

SEQ ID NO: 3579 - DNA, 35 bp, Artificial Sequence
  Synthetic oligonucleotide
gacacccccaccaagaaagcgcggtcccgatcccc

SEQ ID NO: 3580 - DNA, 35 bp, Artificial Sequence
  Synthetic oligonucleotide
gctaaccagcctcacgcccttgctactaataccac

SEQ ID NO: 3581 - DNA, 36 bp, Artificial Sequence
  Synthetic oligonucleotide
tgcaccacctggacatgcttgacaccgccgacccaa

SEQ ID NO: 3582 - DNA, 37 bp, Artificial Sequence
  Synthetic oligonucleotide
gtgggcgggagggggtattccccactaatcatgggga

SEQ ID NO: 3583 - DNA, 37 bp, Artificial Sequence
  Synthetic oligonucleotide
accgcgcacagcggtcgtactccctactatttcgcga

SEQ ID NO: 3584 - DNA, 35 bp, Artificial Sequence
  Synthetic oligonucleotide
atgtcgcgcaccagtacacctgtctgtcttccttc

SEQ ID NO: 3585 - DNA, 31 bp, Artificial Sequence
  Synthetic oligonucleotide
aaccccacactagtgcgtcacccgctcacgc

SEQ ID NO: 3586 - DNA, 35 bp, Artificial Sequence
  Synthetic oligonucleotide
tcgaccactcgttctgcccgacccaacggataccc

SEQ ID NO: 3587 - DNA, 35 bp, Artificial Sequence
  Synthetic oligonucleotide
tcacgcatggcaccttgccctacgcacaaactttt

SEQ ID NO: 3588 - DNA, 35 bp, Artificial Sequence
  Synthetic oligonucleotide
aactgccactcccactatctcacagcaggtaccca

SEQ ID NO: 3589 - DNA, 35 bp, Artificial Sequence
  Synthetic oligonucleotide
tgacgacacatctatctcgtattgttgcctacttc

SEQ ID NO: 3590 - DNA, 35 bp, Artificial Sequence
  Synthetic oligonucleotide
tgctccagccccgaccctttcttctccagacgttc

SEQ ID NO: 3591 - DNA, 35 bp, Artificial Sequence
  Synthetic oligonucleotide
acactaccggctaatgatttccccaccactgctcc

SEQ ID NO: 3592 - DNA, 35 bp, Artificial Sequence
  Synthetic oligonucleotide
aacggagcctcaacgctgctttgttcgcctgtttc

SEQ ID NO: 3593 - DNA, 36 bp, Artificial Sequence
  Synthetic oligonucleotide
atcccgcacagtaccgccgcttgccccgtccttcca

SEQ ID NO: 3594 - DNA, 36 bp, Artificial Sequence
  Synthetic oligonucleotide
tcacggtccatgataacgcccccttcctcaacgcca

SEQ ID NO: 3595 - DNA, 35 bp, Artificial Sequence
  Synthetic oligonucleotide
gacccaccttctgctggaactaggttcgcacttta

SEQ ID NO: 3596 - DNA, 35 bp, Artificial Sequence
  Synthetic oligonucleotide
gcctcatccgcacatgcctagggctcttcccattt

SEQ ID NO: 3597 - DNA, 36 bp, Artificial Sequence
  Synthetic oligonucleotide
catgggaccggcccacacttgcattcccgacgtaca

SEQ ID NO: 3598 - DNA, 35 bp, Artificial Sequence
  Synthetic oligonucleotide
tgttgcatacggttgctcccctccccccttcgcct

SEQ ID NO: 3599 - DNA, 35 bp, Artificial Sequence
  Synthetic oligonucleotide
gacgtgagtcagcatgtcatccctacccctctctc

SEQ ID NO: 3600 - DNA, 37 bp, Artificial Sequence
  Synthetic oligonucleotide
gaaaggtggagaacgtgggttggggagggagtatgga

SEQ ID NO: 3601 - DNA, 34 bp, Artificial Sequence
  Synthetic oligonucleotide
ggttagcgcagctctccttgcacctgcctctcac

SEQ ID NO: 3602 - DNA, 38 bp, Artificial Sequence
  Synthetic oligonucleotide
gcacctccccgcctctgtacttgtcgtcgccatcgtga

SEQ ID NO: 3603 - DNA, 35 bp, Artificial Sequence
  Synthetic oligonucleotide
gcgtggtcgccatggagttttgctttcgtcctttc

SEQ ID NO: 3604 - DNA, 35 bp, Artificial Sequence
  Synthetic oligonucleotide
tatcggtcgcacccctgccgtgatctccgtgccac

SEQ ID NO: 3605 - DNA, 35 bp, Artificial Sequence
  Synthetic oligonucleotide
tccacaatccgtgccaccataacaaccctgtctcg

SEQ ID NO: 3606 - DNA, 35 bp, Artificial Sequence
  Synthetic oligonucleotide
ttccgcccctagttgacccatccctcgtacgtgcc

SEQ ID NO: 3607 - DNA, 35 bp, Artificial Sequence
  Synthetic oligonucleotide
gaccgccatcaggttacttgccgactctcccacca

SEQ ID NO: 3608 - DNA, 35 bp, Artificial Sequence
  Synthetic oligonucleotide
accgctactgcctgaactcacttgacacccgatac

SEQ ID NO: 3609 - DNA, 35 bp, Artificial Sequence
  Synthetic oligonucleotide
tcatgcccgacgcccactccatcgagcgcccctct

SEQ ID NO: 3610 - DNA, 35 bp, Artificial Sequence
  Synthetic oligonucleotide
ggaccaccactatctcgctaatccgactgactcgc

SEQ ID NO: 3611 - DNA, 35 bp, Artificial Sequence
  Synthetic oligonucleotide
gccaagcctccgttaacatcccgccgccacttggt

SEQ ID NO: 3612 - DNA, 35 bp, Artificial Sequence
  Synthetic oligonucleotide
tactgccccactgaccgcctggtactataccgacc

SEQ ID NO: 3613 - DNA, 36 bp, Artificial Sequence
  Synthetic oligonucleotide
tacgcccatgaacgtatgtcttctgatccaccctca

SEQ ID NO: 3614 - DNA, 36 bp, Artificial Sequence
  Synthetic oligonucleotide
gtagggggggagagaggaaggggtgagcggtataca

SEQ ID NO: 3615 - DNA, 35 bp, Artificial Sequence
  Synthetic oligonucleotide
tttcccgccaccactgttcccgtcaagcatcaacc

SEQ ID NO: 3616 - DNA, 35 bp, Artificial Sequence
  Synthetic oligonucleotide
tgtcacctgtacgcccctgttctgcccctcgcact

SEQ ID NO: 3617 - DNA, 37 bp, Artificial Sequence
  Synthetic oligonucleotide
acctcaccccgctccacattgttaccctgcactggga

SEQ ID NO: 3618 - DNA, 35 bp, Artificial Sequence
  Synthetic oligonucleotide
gccacccacatgatcttgattcgttcacacacccc

SEQ ID NO: 3619 - DNA, 35 bp, Artificial Sequence
  Synthetic oligonucleotide
atgccgatcacatccgattcttctgctgtttttta

SEQ ID NO: 3620 - DNA, 36 bp, Artificial Sequence
  Synthetic oligonucleotide
gccgaacgcctggctggctcttcgatactttcttca

SEQ ID NO: 3621 - DNA, 35 bp, Artificial Sequence
  Synthetic oligonucleotide
gatgcgacactcccccgcatcatcgccatcttccc

SEQ ID NO: 3622 - DNA, 36 bp, Artificial Sequence
  Synthetic oligonucleotide
actccgcgccttcactgcttctctgatctcacggca

SEQ ID NO: 3623 - DNA, 37 bp, Artificial Sequence
  Synthetic oligonucleotide
tcccatccgaccatcactgctctgctcattcttatga

SEQ ID NO: 3624 - DNA, 35 bp, Artificial Sequence
  Synthetic oligonucleotide
acaccgatcgcgcactttgagcttcctatgcaacc

SEQ ID NO: 3625 - DNA, 35 bp, Artificial Sequence
  Synthetic oligonucleotide
tcccatccccagcctccacgttgcattctaatcga

SEQ ID NO: 3626 - DNA, 35 bp, Artificial Sequence
  Synthetic oligonucleotide
gacccgccgtatcattccattgtgcccaactcgct

SEQ ID NO: 3627 - DNA, 38 bp, Artificial Sequence
  Synthetic oligonucleotide
accactgccctgtcgtaacctcatcgttcctttcttga

SEQ ID NO: 3628 - DNA, 38 bp, Artificial Sequence
  Synthetic oligonucleotide
tcaccactcctagacgcgtatttcctcaccctcactga

SEQ ID NO: 3629 - DNA, 37 bp, Artificial Sequence
  Synthetic oligonucleotide
tgcccacatctgccggccctttatttagccactctga

SEQ ID NO: 3630 - DNA, 35 bp, Artificial Sequence
  Synthetic oligonucleotide
atcactccccatacacgtattgacccactggttgc

SEQ ID NO: 3631 - DNA, 35 bp, Artificial Sequence
  Synthetic oligonucleotide
aacctggcgccatctatcctgttcccactatagcc

SEQ ID NO: 3632 - DNA, 38 bp, Artificial Sequence
  Synthetic oligonucleotide
gcacatccactcacactggaaaactgccttattattga

SEQ ID NO: 3633 - DNA, 35 bp, Artificial Sequence
  Synthetic oligonucleotide
tgaaacgcccatgcctctcgtcgacgcactttcca

SEQ ID NO: 3634 - DNA, 36 bp, Artificial Sequence
  Synthetic oligonucleotide
ttccagcacgcctacacgctatttcgcacacctcca

SEQ ID NO: 3635 - DNA, 36 bp, Artificial Sequence
  Synthetic oligonucleotide
agaccaggcgcgctatcttaccggccacctttcgta

SEQ ID NO: 3636 - DNA, 35 bp, Artificial Sequence
  Synthetic oligonucleotide
gccacactccccccactcttgtattcagcctggcc

SEQ ID NO: 3637 - DNA, 36 bp, Artificial Sequence
  Synthetic oligonucleotide
tgcccgatccaccatgcgccccaattgctactcgta

SEQ ID NO: 3638 - DNA, 35 bp, Artificial Sequence
  Synthetic oligonucleotide
gccattcctgcctatccctgtgcttgtaagccccc

SEQ ID NO: 3639 - DNA, 35 bp, Artificial Sequence
  Synthetic oligonucleotide
agagatcagcccgttataccccatgcctgcttttc

SEQ ID NO: 3640 - DNA, 35 bp, Artificial Sequence
  Synthetic oligonucleotide
attgcctgcctttccgttctgcctcttgcgcctag

SEQ ID NO: 3641 - DNA, 35 bp, Artificial Sequence
  Synthetic oligonucleotide
tactgcctcccgccttcctgcgatataatatcgct

SEQ ID NO: 3642 - DNA, 35 bp, Artificial Sequence
  Synthetic oligonucleotide
gcgatacgcctcggtttttttagcctcacgccact

SEQ ID NO: 3643 - DNA, 35 bp, Artificial Sequence
  Synthetic oligonucleotide
attgccaccgccgccttccaagtccgcccctcgaa

SEQ ID NO: 3644 - DNA, 35 bp, Artificial Sequence
  Synthetic oligonucleotide
gtccaccgatctatctccgagccacctcttttcgt

SEQ ID NO: 3645 - DNA, 36 bp, Artificial Sequence
  Synthetic oligonucleotide
gacaactcgccccatcggaccccacgccctgcctga

SEQ ID NO: 3646 - DNA, 35 bp, Artificial Sequence
  Synthetic oligonucleotide
gagccaccacccccccgtctatggtgaagccccca

SEQ ID NO: 3647 - DNA, 35 bp, Artificial Sequence
  Synthetic oligonucleotide
gttcgcccccaagcactagctctggttcctacact

SEQ ID NO: 3648 - DNA, 35 bp, Artificial Sequence
  Synthetic oligonucleotide
acacccgtgcgtcgccgaccctgcatacacaacca

SEQ ID NO: 3649 - DNA, 36 bp, Artificial Sequence
  Synthetic oligonucleotide
gcaccaccaccgcgaaacttgcctcatcgtcccgca

SEQ ID NO: 3650 - DNA, 35 bp, Artificial Sequence
  Synthetic oligonucleotide
gtgtgccacctctcgggcctgagccttgtccctgt

SEQ ID NO: 3651 - DNA, 36 bp, Artificial Sequence
  Synthetic oligonucleotide
tacgccgaccgagcgtacatacattacatcacacca

SEQ ID NO: 3652 - DNA, 35 bp, Artificial Sequence
  Synthetic oligonucleotide
gcactccactgcctgaccttcaagcgccgcatact

SEQ ID NO: 3653 - DNA, 35 bp, Artificial Sequence
  Synthetic oligonucleotide
tcatccaggttaccctttgttatgcccgcctgtcc

SEQ ID NO: 3654 - DNA, 36 bp, Artificial Sequence
  Synthetic oligonucleotide
acgtgctcccgtaccatctttaccttgtgacctcaa

SEQ ID NO: 3655 - DNA, 32 bp, Artificial Sequence
  Synthetic oligonucleotide
acccgatcgccctacaacgcccccccttgtga

SEQ ID NO: 3656 - DNA, 35 bp, Artificial Sequence
  Synthetic oligonucleotide
ggatccgccaccacgcaggccacccgttgcaccat

SEQ ID NO: 3657 - DNA, 35 bp, Artificial Sequence
  Synthetic oligonucleotide
tcaacccactcccgccttgcatgctagctgttaca

SEQ ID NO: 3658 - DNA, 35 bp, Artificial Sequence
  Synthetic oligonucleotide
atgacccacctctctgttgagttaaacccgcctgc

SEQ ID NO: 3659 - DNA, 36 bp, Artificial Sequence
  Synthetic oligonucleotide
tacccacccgtccgctttacccccccggccagttca

SEQ ID NO: 3660 - DNA, 38 bp, Artificial Sequence
  Synthetic oligonucleotide
gatcgacaccactgccctcgtactatagccaaccatga

SEQ ID NO: 3661 - DNA, 36 bp, Artificial Sequence
  Synthetic oligonucleotide
acccatccacctcttatgctttcgctatccagttta

SEQ ID NO: 3662 - DNA, 33 bp, Artificial Sequence
  Synthetic oligonucleotide
gatctctgccaaacacgtggttaaacatctttc

SEQ ID NO: 3663 - DNA, 37 bp, Artificial Sequence
  Synthetic oligonucleotide
ttggagggggtgatgggtggtgggtgggtaaggtgga

SEQ ID NO: 3664 - DNA, 36 bp, Artificial Sequence
  Synthetic oligonucleotide
gttcaccgcagtagcgtatctgtccgcctctctcaa

SEQ ID NO: 3665 - DNA, 35 bp, Artificial Sequence
  Synthetic oligonucleotide
gtccgcctcactggcattcctgtgcttccacgcct

SEQ ID NO: 3666 - DNA, 35 bp, Artificial Sequence
  Synthetic oligonucleotide
accacctgccctaactgtcccgtatagcccatgca

SEQ ID NO: 3667 - DNA, 37 bp, Artificial Sequence
  Synthetic oligonucleotide
ggagggggagggcgaagggcgggcaaacggggtcgga

SEQ ID NO: 3668 - DNA, 35 bp, Artificial Sequence
  Synthetic oligonucleotide
taccggcaccaccctgttattttgctacctctcct

SEQ ID NO: 3669 - DNA, 34 bp, Artificial Sequence
  Synthetic oligonucleotide
gcccccaaccaccatgttctttcgagtacgtatt

SEQ ID NO: 3670 - DNA, 35 bp, Artificial Sequence
  Synthetic oligonucleotide
gattatcccgctctctgcctgttgctttatgcccc

SEQ ID NO: 3671 - DNA, 35 bp, Artificial Sequence
  Synthetic oligonucleotide
gaccgacctgatactcccttaccgacacagcagcc

SEQ ID NO: 3672 - DNA, 36 bp, Artificial Sequence
  Synthetic oligonucleotide
gttactgccacgccgtattttgtctccttggtctca

SEQ ID NO: 3673 - DNA, 35 bp, Artificial Sequence
  Synthetic oligonucleotide
ataccgacgcgcacctgaacgtaccgtcctgccct

SEQ ID NO: 3674 - DNA, 38 bp, Artificial Sequence
  Synthetic oligonucleotide
accgcccgcatcgcgctatctcactccacctttagtga

SEQ ID NO: 3675 - DNA, 35 bp, Artificial Sequence
  Synthetic oligonucleotide
gaagcccatgcacgtcgcccccagcccctttagct

SEQ ID NO: 3676 - DNA, 35 bp, Artificial Sequence
  Synthetic oligonucleotide
acccacttgcagttgaaaggccctccccatgtctc

SEQ ID NO: 3677 - DNA, 35 bp, Artificial Sequence
  Synthetic oligonucleotide
tccttcgcccccatgttccctttacgacattccac

SEQ ID NO: 3678 - DNA, 35 bp, Artificial Sequence
  Synthetic oligonucleotide
attgcccctcaccgaccatgtattcatgcccccgc

SEQ ID NO: 3679 - DNA, 35 bp, Artificial Sequence
  Synthetic oligonucleotide
gcaatcctcacataacgttccgccctatctacgcg

SEQ ID NO: 3680 - DNA, 36 bp, Artificial Sequence
  Synthetic oligonucleotide
tcgccctcgcccctgccaccagctccgtacaccata

SEQ ID NO: 3681 - DNA, 34 bp, Artificial Sequence
  Synthetic oligonucleotide
atcgtgccgaccgttttcctcctcatctgccctt

SEQ ID NO: 3682 - DNA, 35 bp, Artificial Sequence
  Synthetic oligonucleotide
aactgcatgccccctccagtgactcacacaccctg

SEQ ID NO: 3683 - DNA, 37 bp, Artificial Sequence
  Synthetic oligonucleotide
acccacgccagacataccacacgtgccgccatactga

SEQ ID NO: 3684 - DNA, 35 bp, Artificial Sequence
  Synthetic oligonucleotide
gttgcgccgtactctcttttgtccattgctttctc

SEQ ID NO: 3685 - DNA, 35 bp, Artificial Sequence
  Synthetic oligonucleotide
acatccgctcgatccccttcgctcattgcctttga

SEQ ID NO: 3686 - DNA, 35 bp, Artificial Sequence
  Synthetic oligonucleotide
tacaccactgtccgtctccccttccaagcccggcc

SEQ ID NO: 3687 - DNA, 35 bp, Artificial Sequence
  Synthetic oligonucleotide
gaccccccggcctccatgaattgcttttccgctga

SEQ ID NO: 3688 - DNA, 36 bp, Artificial Sequence
  Synthetic oligonucleotide
accagcaacatcctgttgttcgatcatctctccgca

SEQ ID NO: 3689 - DNA, 36 bp, Artificial Sequence
  Synthetic oligonucleotide
gtggtgggtagcaaggagggaggagaggaaggcgta

SEQ ID NO: 3690 - DNA, 35 bp, Artificial Sequence
  Synthetic oligonucleotide
gatgggtgggttggggaggggttgatataacttgg

SEQ ID NO: 3691 - DNA, 36 bp, Artificial Sequence
  Synthetic oligonucleotide
atacgccgtgccccgcccatcacagtcacatctgaa

SEQ ID NO: 3692 - DNA, 38 bp, Artificial Sequence
  Synthetic oligonucleotide
tcattcaccgctcgcctccaccatgtgcctggcactga

SEQ ID NO: 3693 - DNA, 36 bp, Artificial Sequence
  Synthetic oligonucleotide
tgtgacggctcctcggcccctttcactgtgatccca

SEQ ID NO: 3694 - DNA, 35 bp, Artificial Sequence
  Synthetic oligonucleotide
gcctgagcacgtccgttcgtctccttgcttgtgcc

SEQ ID NO: 3695 - DNA, 35 bp, Artificial Sequence
  Synthetic oligonucleotide
accccagcccatcgcaagcttacccggctgaccct

SEQ ID NO: 3696 - DNA, 35 bp, Artificial Sequence
  Synthetic oligonucleotide
gtcgcaatcactcgcagtttaaccgttcacctcgc

SEQ ID NO: 3697 - DNA, 35 bp, Artificial Sequence
  Synthetic oligonucleotide
aacacatgcccggatccgcctattacaacgtttcc

SEQ ID NO: 3698 - DNA, 35 bp, Artificial Sequence
  Synthetic oligonucleotide
gacgagagagggaacggggagggcttattatgcgg

SEQ ID NO: 3699 - DNA, 37 bp, Artificial Sequence
  Synthetic oligonucleotide
tttatccgcggcggtggtggtggtcggaaggcggtga

SEQ ID NO: 3700 - DNA, 35 bp, Artificial Sequence
  Synthetic oligonucleotide
tccaccgacgtggtcagtccgcttcctacccgtcc

SEQ ID NO: 3701 - DNA, 35 bp, Artificial Sequence
  Synthetic oligonucleotide
tacacccccccccactctcggagtgccgcgcatac

SEQ ID NO: 3702 - DNA, 33 bp, Artificial Sequence
  Synthetic oligonucleotide
taccaccgcatccgacgccttcacaaccatcga

SEQ ID NO: 3703 - DNA, 35 bp, Artificial Sequence
  Synthetic oligonucleotide
gtctccctcacgttcctcgcgaactgcgccctgcc

SEQ ID NO: 3704 - DNA, 33 bp, Artificial Sequence
  Synthetic oligonucleotide
gtacacgccacaggctcgtgccctcactatccc

SEQ ID NO: 3705 - DNA, 35 bp, Artificial Sequence
  Synthetic oligonucleotide
tcgcacctccaccttgttcgcgttaccgttgtcct

SEQ ID NO: 3706 - DNA, 35 bp, Artificial Sequence
  Synthetic oligonucleotide
acctacatcaacgggtccccggcctcgctgcccca

SEQ ID NO: 3707 - DNA, 35 bp, Artificial Sequence
  Synthetic oligonucleotide
tgtacacaccaccgaaagtcacctggccatcatgc

SEQ ID NO: 3708 - DNA, 35 bp, Artificial Sequence
  Synthetic oligonucleotide
tgagctcagaccgtttgccttgcactatcctcccc

SEQ ID NO: 3709 - DNA, 35 bp, Artificial Sequence
  Synthetic oligonucleotide
acgttccatcaatgcttgctacttagtccctgaac

SEQ ID NO: 3710 - DNA, 38 bp, Artificial Sequence
  Synthetic oligonucleotide
gtgcaacggggtggtggagtgggagggggagtatctga

SEQ ID NO: 3711 - DNA, 35 bp, Artificial Sequence
  Synthetic oligonucleotide
actgtccccccccacattcggttttagacctccat

SEQ ID NO: 3712 - DNA, 36 bp, Artificial Sequence
  Synthetic oligonucleotide
atcgacgacgacagctcgcgcgcccctcctctgcca

SEQ ID NO: 3713 - DNA, 32 bp, Artificial Sequence
  Synthetic oligonucleotide
gactggccccctatcgcactttctgaacacat

SEQ ID NO: 3714 - DNA, 35 bp, Artificial Sequence
  Synthetic oligonucleotide
gtcgacgcagactttgcattcggcgccctcccccc

SEQ ID NO: 3715 - DNA, 35 bp, Artificial Sequence
  Synthetic oligonucleotide
tgcagaagcacctgtctccctggcaccctttacaa

SEQ ID NO: 3716 - DNA, 36 bp, Artificial Sequence
  Synthetic oligonucleotide
tgttgccatccatgttacgaagtctctatctctgca

SEQ ID NO: 3717 - DNA, 35 bp, Artificial Sequence
  Synthetic oligonucleotide
gaatcgctcacagcctgttctgcttaccgttttac

SEQ ID NO: 3718 - DNA, 35 bp, Artificial Sequence
  Synthetic oligonucleotide
aagccaatcctcggtcccgtatcccgccactgcct

SEQ ID NO: 3719 - DNA, 35 bp, Artificial Sequence
  Synthetic oligonucleotide
ttgcacccagctcaccccagtaggtcaccacgctc

SEQ ID NO: 3720 - DNA, 35 bp, Artificial Sequence
  Synthetic oligonucleotide
tacgacctccattcacgtatgcctgctagaccgcc

SEQ ID NO: 3721 - DNA, 36 bp, Artificial Sequence
  Synthetic oligonucleotide
acccaccccagcacagtttaggtaccatcgtcgaaa

SEQ ID NO: 3722 - DNA, 35 bp, Artificial Sequence
  Synthetic oligonucleotide
tcgaccccccgttcccgattgcatggcctgttacc

SEQ ID NO: 3723 - DNA, 36 bp, Artificial Sequence
  Synthetic oligonucleotide
acaccccggagcgttctcaccctgcctgcaaattga

SEQ ID NO: 3724 - DNA, 36 bp, Artificial Sequence
  Synthetic oligonucleotide
tccgtacctcccatgacaatacctcctgttgacaca

SEQ ID NO: 3725 - DNA, 36 bp, Artificial Sequence
  Synthetic oligonucleotide
ttgggccccagcttacttgtagtcgttcctcctagc

SEQ ID NO: 3726 - DNA, 38 bp, Artificial Sequence
  Synthetic oligonucleotide
tccgggacgaatgaggaagggggaggggaggaacttga

SEQ ID NO: 3727 - DNA, 35 bp, Artificial Sequence
  Synthetic oligonucleotide
acaccccgcgccgtcccgcacctcagttattttgc

SEQ ID NO: 3728 - DNA, 36 bp, Artificial Sequence
  Synthetic oligonucleotide
gccgcaccctcctttgggctatcctaccgctctcta

SEQ ID NO: 3729 - DNA, 36 bp, Artificial Sequence
  Synthetic oligonucleotide
gtcgccgaaccacctgtcatttccagtactatgcta

SEQ ID NO: 3730 - DNA, 35 bp, Artificial Sequence
  Synthetic oligonucleotide
tggacacccagtccaccctcctccgctggcttcct

SEQ ID NO: 3731 - DNA, 35 bp, Artificial Sequence
  Synthetic oligonucleotide
gtccatgccattctatattggtccgcacccttgct

SEQ ID NO: 3732 - DNA, 35 bp, Artificial Sequence
  Synthetic oligonucleotide
gtttccccgcccccagatctaatggttgctcccac

SEQ ID NO: 3733 - DNA, 35 bp, Artificial Sequence
  Synthetic oligonucleotide
tagtcaagcctcgcctgaatccgactcccttgtgc

SEQ ID NO: 3734 - DNA, 35 bp, Artificial Sequence
  Synthetic oligonucleotide
gcgcaccttctgtgaccatgccagccccctcacct

SEQ ID NO: 3735 - DNA, 35 bp, Artificial Sequence
  Synthetic oligonucleotide
ttgtcagtcgcagcactgcctttccctgtttgtac

SEQ ID NO: 3736 - DNA, 35 bp, Artificial Sequence
  Synthetic oligonucleotide
tccatgccccattttctgtatcaccttggttcaca

SEQ ID NO: 3737 - DNA, 35 bp, Artificial Sequence
  Synthetic oligonucleotide
tgccagacccacatgccatttccgccgccttacgt

SEQ ID NO: 3738 - DNA, 35 bp, Artificial Sequence
  Synthetic oligonucleotide
tcaaccccccgtccatcgacacatttttagacgtg

SEQ ID NO: 3739 - DNA, 35 bp, Artificial Sequence
  Synthetic oligonucleotide
gtgcaacccctgtatgtcgccaaaccttgtacaac

SEQ ID NO: 3740 - DNA, 35 bp, Artificial Sequence
  Synthetic oligonucleotide
tcctcccaccccggtatcttgctacctttagcttg

SEQ ID NO: 3741 - DNA, 35 bp, Artificial Sequence
  Synthetic oligonucleotide
tcaggcctcctcgaaccccccctacacagcacaag

SEQ ID NO: 3742 - DNA, 36 bp, Artificial Sequence
  Synthetic oligonucleotide
tctaacccccgctgccatctccaccaatgtgactca

SEQ ID NO: 3743 - DNA, 36 bp, Artificial Sequence
  Synthetic oligonucleotide
gattgggtcgttgattaggggcatagtgggggggtt

SEQ ID NO: 3744 - DNA, 35 bp, Artificial Sequence
  Synthetic oligonucleotide
taagcaccccctacacatgccgttgccttcgttat

SEQ ID NO: 3745 - DNA, 35 bp, Artificial Sequence
  Synthetic oligonucleotide
tcgtaacctctgtctgtcgtagctcacccgcaccc

SEQ ID NO: 3746 - DNA, 35 bp, Artificial Sequence
  Synthetic oligonucleotide
gtggggggacgggcgggggtggcaagaatgggtag

SEQ ID NO: 3747 - DNA, 35 bp, Artificial Sequence
  Synthetic oligonucleotide
atccccggccaatgtgcacccgctatccaccccct

SEQ ID NO: 3748 - DNA, 35 bp, Artificial Sequence
  Synthetic oligonucleotide
gaaacgcgatgtacggacgtctgcctcccctcccc

SEQ ID NO: 3749 - DNA, 38 bp, Artificial Sequence
  Synthetic oligonucleotide
atgcacgggagggcgaaacacaggggggctaggaatga

SEQ ID NO: 3750 - DNA, 35 bp, Artificial Sequence
  Synthetic oligonucleotide
tccgacggacgcaccatccagtaccgctctccgct

SEQ ID NO: 3751 - DNA, 34 bp, Artificial Sequence
  Synthetic oligonucleotide
gcttgcaccccgtctccctctgcctatggccacc

SEQ ID NO: 3752 - DNA, 36 bp, Artificial Sequence
  Synthetic oligonucleotide
gacccgcacccccccaccaggactgtctatgctcaa

SEQ ID NO: 3753 - DNA, 36 bp, Artificial Sequence
  Synthetic oligonucleotide
actccagccctttccatgtcccctgtcgcttatgaa

SEQ ID NO: 3754 - DNA, 36 bp, Artificial Sequence
  Synthetic oligonucleotide
gccagcccgccttgctatttggcctcttatatcgta

SEQ ID NO: 3755 - DNA, 35 bp, Artificial Sequence
  Synthetic oligonucleotide
gcacaaccccgccacacggaaccccgccacgcacc

SEQ ID NO: 3756 - DNA, 38 bp, Artificial Sequence
  Synthetic oligonucleotide
tactcgccagagttaccacattgattcctgccccatga

SEQ ID NO: 3757 - DNA, 35 bp, Artificial Sequence
  Synthetic oligonucleotide
tcttgaccactgcactgcatacctgaaggctccac

SEQ ID NO: 3758 - DNA, 35 bp, Artificial Sequence
  Synthetic oligonucleotide
gcgcgagcaacgtcgtaccaccctgcccttctacc

SEQ ID NO: 3759 - DNA, 35 bp, Artificial Sequence
  Synthetic oligonucleotide
gacaccccgttgttcattctccctgctgtgcttta

SEQ ID NO: 3760 - DNA, 35 bp, Artificial Sequence
  Synthetic oligonucleotide
accacatgtcctgtcacgccttctctccagcactg

SEQ ID NO: 3761 - DNA, 36 bp, Artificial Sequence
  Synthetic oligonucleotide
ttcccccaccggcactgcgcacttccaacacaccga

SEQ ID NO: 3762 - DNA, 37 bp, Artificial Sequence
  Synthetic oligonucleotide
tcaccgaccctggcgtaactgttccatctctcattga

SEQ ID NO: 3763 - DNA, 36 bp, Artificial Sequence
  Synthetic oligonucleotide
agacataacggaggaaggagggtggtgggcaatgga

SEQ ID NO: 3764 - DNA, 35 bp, Artificial Sequence
  Synthetic oligonucleotide
gccaacatagctgaggcacgtacgccccatcaccg

SEQ ID NO: 3765 - DNA, 35 bp, Artificial Sequence
  Synthetic oligonucleotide
gaccagccgctgctctactggcacgtacaccaccc

SEQ ID NO: 3766 - DNA, 35 bp, Artificial Sequence
  Synthetic oligonucleotide
gctgggctgaaggggaggggggggcaagaattagg

SEQ ID NO: 3767 - DNA, 37 bp, Artificial Sequence
  Synthetic oligonucleotide
gaggggggtagggaaaggggaattgtaagcccgggga

SEQ ID NO: 3768 - DNA, 36 bp, Artificial Sequence
  Synthetic oligonucleotide
tctgccctgagcctacaccgcgacacctttctcaaa

SEQ ID NO: 3769 - DNA, 35 bp, Artificial Sequence
  Synthetic oligonucleotide
tagactcaccgcatcccctttggtttcctcgccac

SEQ ID NO: 3770 - DNA, 35 bp, Artificial Sequence
  Synthetic oligonucleotide
tgtttagaccctgccccccgccattcacatgtact

SEQ ID NO: 3771 - DNA, 35 bp, Artificial Sequence
  Synthetic oligonucleotide
tacccacacactacatctcaagcctacgttgccca

SEQ ID NO: 3772 - DNA, 34 bp, Artificial Sequence
  Synthetic oligonucleotide
acctaccctcgccccatgctatgagccccacgcg

SEQ ID NO: 3773 - DNA, 35 bp, Artificial Sequence
  Synthetic oligonucleotide
gcgagcaccgcgcctgtccctcttccatctctggt

SEQ ID NO: 3774 - DNA, 38 bp, Artificial Sequence
  Synthetic oligonucleotide
tggagcctctgccctgaccgcgccatcaaccaccctga

SEQ ID NO: 3775 - DNA, 35 bp, Artificial Sequence
  Synthetic oligonucleotide
aacgcctaaccccaggcctcacgccgctgtttcct

SEQ ID NO: 3776 - DNA, 37 bp, Artificial Sequence
  Synthetic oligonucleotide
acacgccctctattccgcacatagcctcgtcccctga

SEQ ID NO: 3777 - DNA, 35 bp, Artificial Sequence
  Synthetic oligonucleotide
atccccccatgagcccacctcgtctgcgctaggtc

SEQ ID NO: 3778 - DNA, 35 bp, Artificial Sequence
  Synthetic oligonucleotide
tcgatccggccacgtactcgcattgaccccctgca

SEQ ID NO: 3779 - DNA, 35 bp, Artificial Sequence
  Synthetic oligonucleotide
tgccaacacgtgtcccgcggtttttcttgtttttc

SEQ ID NO: 3780 - DNA, 36 bp, Artificial Sequence
  Synthetic oligonucleotide
acccatcaccgtttgacctgttttgactctgccaca

SEQ ID NO: 3781 - DNA, 35 bp, Artificial Sequence
  Synthetic oligonucleotide
ttcgcccagcaacatcactccctatgcagcttaat

SEQ ID NO: 3782 - DNA, 35 bp, Artificial Sequence
  Synthetic oligonucleotide
tttacctcacccgcccatctaccagacccatgttg

SEQ ID NO: 3783 - DNA, 35 bp, Artificial Sequence
  Synthetic oligonucleotide
acttctagccacaccattgttacgtcactgccgcc

SEQ ID NO: 3784 - DNA, 35 bp, Artificial Sequence
  Synthetic oligonucleotide
gatcctcacccaccgtttttcttgtagacgtacgt

SEQ ID NO: 3785 - DNA, 35 bp, Artificial Sequence
  Synthetic oligonucleotide
tacctcgctcccgtgcccagttcccatgactatcc

SEQ ID NO: 3786 - DNA, 35 bp, Artificial Sequence
  Synthetic oligonucleotide
gtgacaccccgccgtcaaggccaatccatcaatcc

SEQ ID NO: 3787 - DNA, 35 bp, Artificial Sequence
  Synthetic oligonucleotide
accccacccctcattgccgacatcgctgaagcggg

SEQ ID NO: 3788 - DNA, 35 bp, Artificial Sequence
  Synthetic oligonucleotide
actcgcccgccctgctgcccttgggacgaaacctc

SEQ ID NO: 3789 - DNA, 36 bp, Artificial Sequence
  Synthetic oligonucleotide
acaccgacaccattccattggcacaagttctttcca

SEQ ID NO: 3790 - DNA, 35 bp, Artificial Sequence
  Synthetic oligonucleotide
gagggacgactgggagggttcgggagggcgaattg

SEQ ID NO: 3791 - DNA, 36 bp, Artificial Sequence
  Synthetic oligonucleotide
ttacccccaccgagttttgcaaacaccacagttgaa

SEQ ID NO: 3792 - DNA, 35 bp, Artificial Sequence
  Synthetic oligonucleotide
tgtgcccgcctactccactccgtcaaagcctcggc

SEQ ID NO: 3793 - DNA, 35 bp, Artificial Sequence
  Synthetic oligonucleotide
accctcagccgcctcctgtcccgcacccactcgcg

SEQ ID NO: 3794 - DNA, 35 bp, Artificial Sequence
  Synthetic oligonucleotide
aactgcggccaacaccacccccacacgtaccctga

SEQ ID NO: 3795 - DNA, 36 bp, Artificial Sequence
  Synthetic oligonucleotide
gcaccgcactactgcttgatcaactcctcgctcgca

SEQ ID NO: 3796 - DNA, 36 bp, Artificial Sequence
  Synthetic oligonucleotide
atgcccagcctggttgccctttatccgttccgttta

SEQ ID NO: 3797 - DNA, 36 bp, Artificial Sequence
  Synthetic oligonucleotide
gcaggccaccatctgttttcgccagctcaacctcca

SEQ ID NO: 3798 - DNA, 37 bp, Artificial Sequence
  Synthetic oligonucleotide
ttccctcgcccagctggctttcctttacgctcaccga

SEQ ID NO: 3799 - DNA, 37 bp, Artificial Sequence
  Synthetic oligonucleotide
ttccccatccctcgtttcgtctcagccctgtaccaga

SEQ ID NO: 3800 - DNA, 37 bp, Artificial Sequence
  Synthetic oligonucleotide
gatgggagggaaggggagggcacctgcgcaagtacga

SEQ ID NO: 3801 - DNA, 35 bp, Artificial Sequence
  Synthetic oligonucleotide
agtccactcccactgccgctctggtcgcaaccctg

SEQ ID NO: 3802 - DNA, 35 bp, Artificial Sequence
  Synthetic oligonucleotide
actcatccgccacccgctcaggccccgcactcgca

SEQ ID NO: 3803 - DNA, 35 bp, Artificial Sequence
  Synthetic oligonucleotide
gactcagccgtcggtcccctactccccaacgtatc

SEQ ID NO: 3804 - DNA, 35 bp, Artificial Sequence
  Synthetic oligonucleotide
tcacccctcttgcccgtcttccatcccacggtgct

SEQ ID NO: 3805 - DNA, 35 bp, Artificial Sequence
  Synthetic oligonucleotide
acacgacccgctgatatcaatgcgcctcttcccta

SEQ ID NO: 3806 - DNA, 35 bp, Artificial Sequence
  Synthetic oligonucleotide
atcccgcactctcccacacccctacccgtagtgaa

SEQ ID NO: 3807 - DNA, 35 bp, Artificial Sequence
  Synthetic oligonucleotide
ttcaccgccccatccactcgccactgtatcaatgc

SEQ ID NO: 3808 - DNA, 36 bp, Artificial Sequence
  Synthetic oligonucleotide
tttcgccgtgcaccctgtattcatttgtcctcttca

SEQ ID NO: 3809 - DNA, 35 bp, Artificial Sequence
  Synthetic oligonucleotide
acagacacccctgacacaccggatttagcacccct

SEQ ID NO: 3810 - DNA, 35 bp, Artificial Sequence
  Synthetic oligonucleotide
accgcaacccttcttcctatctggcctatgaccca

SEQ ID NO: 3811 - DNA, 35 bp, Artificial Sequence
  Synthetic oligonucleotide
gaagccaccatgctgacgtactctccggatctgcc

SEQ ID NO: 3812 - DNA, 35 bp, Artificial Sequence
  Synthetic oligonucleotide
tgaaacccgctccctgtcctacactgtccatcaca

SEQ ID NO: 3813 - DNA, 35 bp, Artificial Sequence
  Synthetic oligonucleotide
taggaccacgcatctgcctgagctgcccttttttt

SEQ ID NO: 3814 - DNA, 35 bp, Artificial Sequence
  Synthetic oligonucleotide
gaacatcccactgtgccccgctccacgctccgacc

SEQ ID NO: 3815 - DNA, 35 bp, Artificial Sequence
  Synthetic oligonucleotide
gccacccgtgccgccggtaagccactttctcatcc

SEQ ID NO: 3816 - DNA, 36 bp, Artificial Sequence
  Synthetic oligonucleotide
tcctgcctaccgccgccgccatttgaggcccactca

SEQ ID NO: 3817 - DNA, 36 bp, Artificial Sequence
  Synthetic oligonucleotide
tatgggatggacgaaatggaggaagggcggatagta

SEQ ID NO: 3818 - DNA, 35 bp, Artificial Sequence
  Synthetic oligonucleotide
gtccacagccagtcgtaccgaacgcattattccac

SEQ ID NO: 3819 - DNA, 35 bp, Artificial Sequence
  Synthetic oligonucleotide
gtccgtcgatcggctccctactcctgcatatacac

SEQ ID NO: 3820 - DNA, 35 bp, Artificial Sequence
  Synthetic oligonucleotide
gacgttgcccggttcccctgattgttccgttccat

SEQ ID NO: 3821 - DNA, 38 bp, Artificial Sequence
  Synthetic oligonucleotide
gtgacacaccacatgactatagcgtacaacctctctga

SEQ ID NO: 3822 - DNA, 35 bp, Artificial Sequence
  Synthetic oligonucleotide
aaccaccatgcccggcaccgagcctctacctcatt

SEQ ID NO: 3823 - DNA, 35 bp, Artificial Sequence
  Synthetic oligonucleotide
aatcgcaccacccgcacatttctattacctagccg

SEQ ID NO: 3824 - DNA, 35 bp, Artificial Sequence
  Synthetic oligonucleotide
tccacacctacgcactgtgcaccgatacacgttcc

SEQ ID NO: 3825 - DNA, 36 bp, Artificial Sequence
  Synthetic oligonucleotide
gacgacggccttccacccatacgctactgtatccca

SEQ ID NO: 3826 - DNA, 35 bp, Artificial Sequence
  Synthetic oligonucleotide
gtgagcgccatttgcccccctgaaccgtgtactcc

SEQ ID NO: 3827 - DNA, 36 bp, Artificial Sequence
  Synthetic oligonucleotide
atccatccgctcgcccgtacaagcacgcacacccca

SEQ ID NO: 3828 - DNA, 35 bp, Artificial Sequence
  Synthetic oligonucleotide
ttacgcgccacgcctgcaaattgccgccttcatcc

SEQ ID NO: 3829 - DNA, 35 bp, Artificial Sequence
  Synthetic oligonucleotide
gaaccgcaagtaggggtggacggggaaagggatat

SEQ ID NO: 3830 - DNA, 35 bp, Artificial Sequence
  Synthetic oligonucleotide
gaccgaagacgaagaggtgggaaggggaacgggtg

SEQ ID NO: 3831 - DNA, 35 bp, Artificial Sequence
  Synthetic oligonucleotide
tagatcccatctctgtttttgtagttggttccctc

SEQ ID NO: 3832 - DNA, 35 bp, Artificial Sequence
  Synthetic oligonucleotide
acctcatcctggtgcctctgacaccggctccttac

SEQ ID NO: 3833 - DNA, 35 bp, Artificial Sequence
  Synthetic oligonucleotide
tttgacacctcacttgggatacctgccacgatcct

SEQ ID NO: 3834 - DNA, 37 bp, Artificial Sequence
  Synthetic oligonucleotide
gagggggggcgggcggaatttagaaggatggggagga

SEQ ID NO: 3835 - DNA, 38 bp, Artificial Sequence
  Synthetic oligonucleotide
gtggtcgcctcctactgcaccctgtgtcctcctgttga

SEQ ID NO: 3836 - DNA, 35 bp, Artificial Sequence
  Synthetic oligonucleotide
acattcaccgctcattccacccacagtacgtatgc

SEQ ID NO: 3837 - DNA, 35 bp, Artificial Sequence
  Synthetic oligonucleotide
ttccgacgctgtagccctttccccgcatgtacctt

SEQ ID NO: 3838 - DNA, 35 bp, Artificial Sequence
  Synthetic oligonucleotide
ttacacgcactctcattaccgtccccagaccacgt

SEQ ID NO: 3839 - DNA, 35 bp, Artificial Sequence
  Synthetic oligonucleotide
gaaacccagcacgccactcagccctcacccatggt

SEQ ID NO: 3840 - DNA, 35 bp, Artificial Sequence
  Synthetic oligonucleotide
gaaagccgagcctggtcccttttgcccgttctatc

SEQ ID NO: 3841 - DNA, 35 bp, Artificial Sequence
  Synthetic oligonucleotide
tgtagcccagcatactctgtttcacactgtccccc

SEQ ID NO: 3842 - DNA, 35 bp, Artificial Sequence
  Synthetic oligonucleotide
gaagccgcaaattcgtctgaacctcagcccccctc

SEQ ID NO: 3843 - DNA, 35 bp, Artificial Sequence
  Synthetic oligonucleotide
tgctcctgcaccaatctctttgttccatgctacgc

SEQ ID NO: 3844 - DNA, 36 bp, Artificial Sequence
  Synthetic oligonucleotide
tgccacacgcgacactgttctcgccccgccactgca

SEQ ID NO: 3845 - DNA, 36 bp, Artificial Sequence
  Synthetic oligonucleotide
gtccagccacaaccgactgtttcacgcgcctttcca

SEQ ID NO: 3846 - DNA, 35 bp, Artificial Sequence
  Synthetic oligonucleotide
tttgtccccgtgctgcccgcctgactacctcattg

SEQ ID NO: 3847 - DNA, 35 bp, Artificial Sequence
  Synthetic oligonucleotide
ttgcatgcccgccccacatcatcggttcatttgtc

SEQ ID NO: 3848 - DNA, 35 bp, Artificial Sequence
  Synthetic oligonucleotide
aaacccgcgcgcattatcgtgctctttctctccat

SEQ ID NO: 3849 - DNA, 37 bp, Artificial Sequence
  Synthetic oligonucleotide
tagggctcgctcaccacggctactgatccacctccga

SEQ ID NO: 3850 - DNA, 36 bp, Artificial Sequence
  Synthetic oligonucleotide
ttgatacgccagccttgtctcttgccttgcccacca

SEQ ID NO: 3851 - DNA, 35 bp, Artificial Sequence
  Synthetic oligonucleotide
ttgaaggtggaggaggggtcggtgatggaggcttg

SEQ ID NO: 3852 - DNA, 35 bp, Artificial Sequence
  Synthetic oligonucleotide
atgcccatccaccccacgctcgcccctcattgacg

SEQ ID NO: 3853 - DNA, 35 bp, Artificial Sequence
  Synthetic oligonucleotide
acccccatctcacatgggcattaaccccgctttcc

SEQ ID NO: 3854 - DNA, 35 bp, Artificial Sequence
  Synthetic oligonucleotide
tcaagcacacacgcctcacgccctcgccttgcccc

SEQ ID NO: 3855 - DNA, 35 bp, Artificial Sequence
  Synthetic oligonucleotide
tacgatgtctctgctctccttgtttgccgtggtgg

SEQ ID NO: 3856 - DNA, 36 bp, Artificial Sequence
  Synthetic oligonucleotide
acacccaccacagacgagtttatcctccttgtctaa

SEQ ID NO: 3857 - DNA, 35 bp, Artificial Sequence
  Synthetic oligonucleotide
tgttctcccccgcttgttctgttcctcgaaaggtc

SEQ ID NO: 3858 - DNA, 35 bp, Artificial Sequence
  Synthetic oligonucleotide
tcgcccacgcctgcccttaccaagacgtttcttgc

SEQ ID NO: 3859 - DNA, 35 bp, Artificial Sequence
  Synthetic oligonucleotide
gtcccgcctgctcgtttctgcctgcccttacttgt

SEQ ID NO: 3860 - DNA, 37 bp, Artificial Sequence
  Synthetic oligonucleotide
taagaccgccaccgccgtttatcccttaccgactgga

SEQ ID NO: 3861 - DNA, 35 bp, Artificial Sequence
  Synthetic oligonucleotide
atcgtggcacctgttccctctgtttttgcatcata

SEQ ID NO: 3862 - DNA, 35 bp, Artificial Sequence
  Synthetic oligonucleotide
acgacccctcacctggtagcaacgccctaaccacc

SEQ ID NO: 3863 - DNA, 35 bp, Artificial Sequence
  Synthetic oligonucleotide
gagcccacgtgcgcacacatttccctccggaccca

SEQ ID NO: 3864 - DNA, 35 bp, Artificial Sequence
  Synthetic oligonucleotide
accccccccaaccgatttgcctgcagccataaccg

SEQ ID NO: 3865 - DNA, 35 bp, Artificial Sequence
  Synthetic oligonucleotide
acacctgggccaacactgactttcgcttgtcctgc

SEQ ID NO: 3866 - DNA, 35 bp, Artificial Sequence
  Synthetic oligonucleotide
gcatccccctgttctgtcggacacctcgctcgcac

SEQ ID NO: 3867 - DNA, 35 bp, Artificial Sequence
  Synthetic oligonucleotide
accgccactgtttcctctgagccctctgccccttg

SEQ ID NO: 3868 - DNA, 35 bp, Artificial Sequence
  Synthetic oligonucleotide
gcaccgacctttcgcgtcttgacccctctttattg

SEQ ID NO: 3869 - DNA, 37 bp, Artificial Sequence
  Synthetic oligonucleotide
accgtgaggggagtggtggggaatatatctggtggga

SEQ ID NO: 3870 - DNA, 35 bp, Artificial Sequence
  Synthetic oligonucleotide
gaaggggtgggtagggggtgggggtacacatgctc

SEQ ID NO: 3871 - DNA, 36 bp, Artificial Sequence
  Synthetic oligonucleotide
gcacgcggtccctgggcttactgattgccgctcccc

SEQ ID NO: 3872 - DNA, 35 bp, Artificial Sequence
  Synthetic oligonucleotide
actcatgtccggtgctccttctttacgtcctgctg

SEQ ID NO: 3873 - DNA, 37 bp, Artificial Sequence
  Synthetic oligonucleotide
tctgcctcccacctgcccatcgtacgtcattaagcga

SEQ ID NO: 3874 - DNA, 36 bp, Artificial Sequence
  Synthetic oligonucleotide
tcatggccccgaacacctggtgtcctccacccttta

SEQ ID NO: 3875 - DNA, 36 bp, Artificial Sequence
  Synthetic oligonucleotide
gtcaccctccgcccacctacggcagtcccacgctaa

SEQ ID NO: 3876 - DNA, 35 bp, Artificial Sequence
  Synthetic oligonucleotide
tgccccctccgcgtccctatcgcgacacatcccaa

SEQ ID NO: 3877 - DNA, 35 bp, Artificial Sequence
  Synthetic oligonucleotide
agccattcgccactccgcatccagaccttgaccac

SEQ ID NO: 3878 - DNA, 35 bp, Artificial Sequence
  Synthetic oligonucleotide
tccgaccaaccacttgacctgccatctcaagagaa

SEQ ID NO: 3879 - DNA, 35 bp, Artificial Sequence
  Synthetic oligonucleotide
atccgacgtcctgctcgttccagctaacgcttctg

SEQ ID NO: 3880 - DNA, 36 bp, Artificial Sequence
  Synthetic oligonucleotide
acccacccgctgtactatctgagcctctacgaaaaa

SEQ ID NO: 3881 - DNA, 35 bp, Artificial Sequence
  Synthetic oligonucleotide
tgttcacccgccctccgtccgtcctgctactcagt

SEQ ID NO: 3882 - DNA, 35 bp, Artificial Sequence
  Synthetic oligonucleotide
gcactccacaatcgctactaggttccgtactttgt

SEQ ID NO: 3883 - DNA, 35 bp, Artificial Sequence
  Synthetic oligonucleotide
atgtgtacctgcccctcttcgcccacccgacgatc

SEQ ID NO: 3884 - DNA, 35 bp, Artificial Sequence
  Synthetic oligonucleotide
gacgtactgcctcagtcttctatccatgtgccgtc

SEQ ID NO: 3885 - DNA, 36 bp, Artificial Sequence
  Synthetic oligonucleotide
gaccatccactcgacgttatagcccaatatctcgca

SEQ ID NO: 3886 - DNA, 35 bp, Artificial Sequence
  Synthetic oligonucleotide
aaccccaccacatctgtccccagcgctctgctctc

SEQ ID NO: 3887 - DNA, 35 bp, Artificial Sequence
  Synthetic oligonucleotide
tggactgagacctcctatatgtaccatcccgcctc

SEQ ID NO: 3888 - DNA, 36 bp, Artificial Sequence
  Synthetic oligonucleotide
tcaaccatcgctgcctgggcctaacgcaaaaaatca

SEQ ID NO: 3889 - DNA, 35 bp, Artificial Sequence
  Synthetic oligonucleotide
gctgctgagcaagcacgtctccggttacatcctcc

SEQ ID NO: 3890 - DNA, 36 bp, Artificial Sequence
  Synthetic oligonucleotide
gtgacgcacatgtctctttatatcgccttccctata

SEQ ID NO: 3891 - DNA, 33 bp, Artificial Sequence
  Synthetic oligonucleotide
gaccccctaccgctagtcccgccacgacccttc

SEQ ID NO: 3892 - DNA, 35 bp, Artificial Sequence
  Synthetic oligonucleotide
tgtgactggaccgctccctccgttgccgtatcaaa

SEQ ID NO: 3893 - DNA, 35 bp, Artificial Sequence
  Synthetic oligonucleotide
aaacaccccactatggccataatcgtttacatcac

SEQ ID NO: 3894 - DNA, 36 bp, Artificial Sequence
  Synthetic oligonucleotide
ggacccgccgaatctcttctacactgggcaccccta

SEQ ID NO: 3895 - DNA, 38 bp, Artificial Sequence
  Synthetic oligonucleotide
ttcacccacacacgggcataaacgcacacttgaactga

SEQ ID NO: 3896 - DNA, 36 bp, Artificial Sequence
  Synthetic oligonucleotide
accatgcccgggtaactttctagtccagccctccca

SEQ ID NO: 3897 - DNA, 38 bp, Artificial Sequence
  Synthetic oligonucleotide
gtctgacgccgcactgcttttagctcattcctttctga

SEQ ID NO: 3898 - DNA, 35 bp, Artificial Sequence
  Synthetic oligonucleotide
aaaacccaacgcccgctctgtactgcactcgcctc

SEQ ID NO: 3899 - DNA, 35 bp, Artificial Sequence
  Synthetic oligonucleotide
tctgacaccgccgccctgtagtacatcgtttcgtt

SEQ ID NO: 3900 - DNA, 35 bp, Artificial Sequence
  Synthetic oligonucleotide
gtagccaccacctggcctcagtaaccactccccca

SEQ ID NO: 3901 - DNA, 35 bp, Artificial Sequence
  Synthetic oligonucleotide
tccgcgtgaccctctcgttcgtcgcccccattgga

SEQ ID NO: 3902 - DNA, 35 bp, Artificial Sequence
  Synthetic oligonucleotide
tccccctgcacccggttgacgcccctgagacatgg

SEQ ID NO: 3903 - DNA, 35 bp, Artificial Sequence
  Synthetic oligonucleotide
ttacctgcaatccgtctgtccctctgtcccattcc

SEQ ID NO: 3904 - DNA, 35 bp, Artificial Sequence
  Synthetic oligonucleotide
tgcgccccgcgcgccccctagctacacactatcgc

SEQ ID NO: 3905 - DNA, 35 bp, Artificial Sequence
  Synthetic oligonucleotide
tcccccactaccgagcccagttctgcccccgagat

SEQ ID NO: 3906 - DNA, 37 bp, Artificial Sequence
  Synthetic oligonucleotide
gttgcaccatccacacgccatagtcttcccaccggga

SEQ ID NO: 3907 - DNA, 35 bp, Artificial Sequence
  Synthetic oligonucleotide
tttggagccgctgcaacctcaccatttggaccaca

SEQ ID NO: 3908 - DNA, 37 bp, Artificial Sequence
  Synthetic oligonucleotide
gaactgaccctcatcgtggtttcctaaatgcccttga

SEQ ID NO: 3909 - DNA, 35 bp, Artificial Sequence
  Synthetic oligonucleotide
gtgcaccctcatacacacacccttactgttgtctc

SEQ ID NO: 3910 - DNA, 35 bp, Artificial Sequence
  Synthetic oligonucleotide
gtccccttgcatgccctacctggcttctgacttcc

SEQ ID NO: 3911 - DNA, 35 bp, Artificial Sequence
  Synthetic oligonucleotide
gcatactccgccgactggtttcctccgttcttttc

SEQ ID NO: 3912 - DNA, 36 bp, Artificial Sequence
  Synthetic oligonucleotide
gcacaccccctctgtcctgtcggaaatcctgttcta

SEQ ID NO: 3913 - DNA, 35 bp, Artificial Sequence
  Synthetic oligonucleotide
ttgctccccgtcaccacaaacggcctgtcatatcc

SEQ ID NO: 3914 - DNA, 35 bp, Artificial Sequence
  Synthetic oligonucleotide
gcagatccggcctcgaccccacgcccaagtctctc

SEQ ID NO: 3915 - DNA, 35 bp, Artificial Sequence
  Synthetic oligonucleotide
ggtcgccgtcctacgtctcgattccgtctacctca

SEQ ID NO: 3916 - DNA, 35 bp, Artificial Sequence
  Synthetic oligonucleotide
gccgatgcatctgagcgcaccatccccgtattcac

SEQ ID NO: 3917 - DNA, 36 bp, Artificial Sequence
  Synthetic oligonucleotide
gcccaaccctccgctccattggactgttctactgga

SEQ ID NO: 3918 - DNA, 35 bp, Artificial Sequence
  Synthetic oligonucleotide
acacctccccacctgacgcctgtcatagcttgccg

SEQ ID NO: 3919 - DNA, 38 bp, Artificial Sequence
  Synthetic oligonucleotide
ttgatccaccttcccgattcgtgcttattgcctgctga

SEQ ID NO: 3920 - DNA, 36 bp, Artificial Sequence
  Synthetic oligonucleotide
tcatcggtcgctagcctgttttccccgccccaccta

SEQ ID NO: 3921 - DNA, 36 bp, Artificial Sequence
  Synthetic oligonucleotide
acacagccgacgaagtcattgcgcctgcctttccca

SEQ ID NO: 3922 - DNA, 35 bp, Artificial Sequence
  Synthetic oligonucleotide
atgacaccacgttgagtcaactctgctctcttttg

SEQ ID NO: 3923 - DNA, 35 bp, Artificial Sequence
  Synthetic oligonucleotide
tcacctgtccccccgtttaccgctcataacgagtg

SEQ ID NO: 3924 - DNA, 35 bp, Artificial Sequence
  Synthetic oligonucleotide
actcccaccctgttctagttctagttgctctggcc

SEQ ID NO: 3925 - DNA, 35 bp, Artificial Sequence
  Synthetic oligonucleotide
atcgtagccgctccttcctacattgtctttttggt

SEQ ID NO: 3926 - DNA, 35 bp, Artificial Sequence
  Synthetic oligonucleotide
tgcgatccagccactctaacgttacacagcctcca

SEQ ID NO: 3927 - DNA, 37 bp, Artificial Sequence
  Synthetic oligonucleotide
tgcggggggggcgaagatgatgcaggggcgatcgtga

SEQ ID NO: 3928 - DNA, 38 bp, Artificial Sequence
  Synthetic oligonucleotide
tgtagctgccctccccttgcctttgtgccttcgtttga

SEQ ID NO: 3929 - DNA, 35 bp, Artificial Sequence
  Synthetic oligonucleotide
gtctgccccaagatcctgctctactccccaaagcc

SEQ ID NO: 3930 - DNA, 35 bp, Artificial Sequence
  Synthetic oligonucleotide
atgccaccacacctccatctgcttagcttgagtta

SEQ ID NO: 3931 - DNA, 36 bp, Artificial Sequence
  Synthetic oligonucleotide
gacccgtgcccgactcgaccctcgacccttttccga

SEQ ID NO: 3932 - DNA, 35 bp, Artificial Sequence
  Synthetic oligonucleotide
tccgtgcccccaactcatatgttatttatctgcca

SEQ ID NO: 3933 - DNA, 35 bp, Artificial Sequence
  Synthetic oligonucleotide
accaccaccaacacgatcgctcatgatatcacacg

SEQ ID NO: 3934 - DNA, 37 bp, Artificial Sequence
  Synthetic oligonucleotide
aactcgtccttccctgcatctccacctgtcccaccga

SEQ ID NO: 3935 - DNA, 36 bp, Artificial Sequence
  Synthetic oligonucleotide
tgtcgacgccgctcacgtatcctgtccactgctgca

SEQ ID NO: 3936 - DNA, 35 bp, Artificial Sequence
  Synthetic oligonucleotide
taccggctcagcccccgcatattcatgtcccttgc

SEQ ID NO: 3937 - DNA, 36 bp, Artificial Sequence
  Synthetic oligonucleotide
tgatccaccgaccgcctgtactttgtctcgtcaata

SEQ ID NO: 3938 - DNA, 35 bp, Artificial Sequence
  Synthetic oligonucleotide
acacgcgccccctttactgtttcaattcgaccctg

SEQ ID NO: 3939 - DNA, 35 bp, Artificial Sequence
  Synthetic oligonucleotide
gacatgttccgctctgttctcacctggcccttgca

SEQ ID NO: 3940 - DNA, 36 bp, Artificial Sequence
  Synthetic oligonucleotide
gagcacatccccgccctcagcacctgactgccctca

SEQ ID NO: 3941 - DNA, 37 bp, Artificial Sequence
  Synthetic oligonucleotide
gagggtgctgagcaggggggaaggattgggtgggtga

SEQ ID NO: 3942 - DNA, 35 bp, Artificial Sequence
  Synthetic oligonucleotide
ttggccctcaatgccattatatcgtaccccctgtt

SEQ ID NO: 3943 - DNA, 35 bp, Artificial Sequence
  Synthetic oligonucleotide
atcccaccctcccgagtcattccagcaatacccag

SEQ ID NO: 3944 - DNA, 36 bp, Artificial Sequence
  Synthetic oligonucleotide
gcacccgaaatgacactctgacgccaccctgccgaa

SEQ ID NO: 3945 - DNA, 35 bp, Artificial Sequence
  Synthetic oligonucleotide
gcccgcctccctcatgcgctttttatgaaactaca

SEQ ID NO: 3946 - DNA, 37 bp, Artificial Sequence
  Synthetic oligonucleotide
tgacaccatctgacctcgccttaacactcctccatga

SEQ ID NO: 3947 - DNA, 35 bp, Artificial Sequence
  Synthetic oligonucleotide
tttgcaccatcacgcaccttgacgtcagtccctgt

SEQ ID NO: 3948 - DNA, 35 bp, Artificial Sequence
  Synthetic oligonucleotide
gtgcactactgctttgccaccatcctgtgactcac

SEQ ID NO: 3949 - DNA, 35 bp, Artificial Sequence
  Synthetic oligonucleotide
tccacgcaagcaccattcattccgtcctcgccatt

SEQ ID NO: 3950 - DNA, 36 bp, Artificial Sequence
  Synthetic oligonucleotide
tcctggccccgcagaacgcgccccacccgtctacca

SEQ ID NO: 3951 - DNA, 35 bp, Artificial Sequence
  Synthetic oligonucleotide
tacaccccattgattccaaatgacactgcccatcc

SEQ ID NO: 3952 - DNA, 38 bp, Artificial Sequence
  Synthetic oligonucleotide
tcccgaccatgccggcctgatcactcccccctgcgtga

SEQ ID NO: 3953 - DNA, 35 bp, Artificial Sequence
  Synthetic oligonucleotide
acccgtcaccaccgatccgtggcatgctactcccg

SEQ ID NO: 3954 - DNA, 35 bp, Artificial Sequence
  Synthetic oligonucleotide
aatctgtaccagtacacgtgctcccacatctcctt

SEQ ID NO: 3955 - DNA, 38 bp, Artificial Sequence
  Synthetic oligonucleotide
gacgcgctgtaggactacacgctctatatcatttctga

SEQ ID NO: 3956 - DNA, 35 bp, Artificial Sequence
  Synthetic oligonucleotide
gctaggaggaggaagggggtgggtaaaggacggct

SEQ ID NO: 3957 - DNA, 35 bp, Artificial Sequence
  Synthetic oligonucleotide
gaaccgctgccccactccttgcatggaccatttgc

SEQ ID NO: 3958 - DNA, 37 bp, Artificial Sequence
  Synthetic oligonucleotide
gccgaatcgccgaattcgtttattaccacattactga

SEQ ID NO: 3959 - DNA, 35 bp, Artificial Sequence
  Synthetic oligonucleotide
accacccgcctgcttatatctcatgtcagacctat

SEQ ID NO: 3960 - DNA, 36 bp, Artificial Sequence
  Synthetic oligonucleotide
tccgattgcccctttctgtgatggccccccgtatta

SEQ ID NO: 3961 - DNA, 37 bp, Artificial Sequence
  Synthetic oligonucleotide
accgatcgtgcgcctgttccatccaccgccccgttga

SEQ ID NO: 3962 - DNA, 35 bp, Artificial Sequence
  Synthetic oligonucleotide
tgctcgctctcggctcctgttccttgccatacaac

SEQ ID NO: 3963 - DNA, 36 bp, Artificial Sequence
  Synthetic oligonucleotide
gatggggcgtggatgtcaattcagggggaggtggga

SEQ ID NO: 3964 - DNA, 35 bp, Artificial Sequence
  Synthetic oligonucleotide
tgtgcacgttcgcttgtcccttcgcatttgtccgc

SEQ ID NO: 3965 - DNA, 35 bp, Artificial Sequence
  Synthetic oligonucleotide
acagccacaaccgaccccacaactgccccagagca

SEQ ID NO: 3966 - DNA, 35 bp, Artificial Sequence
  Synthetic oligonucleotide
gccgtccaacgtgagtctgtccaaccttcacctcc

SEQ ID NO: 3967 - DNA, 35 bp, Artificial Sequence
  Synthetic oligonucleotide
gtcgccgccgcacatgtacacaccgcgccaaaaac

SEQ ID NO: 3968 - DNA, 35 bp, Artificial Sequence
  Synthetic oligonucleotide
gccgacacggcccatctagtctcagtcttggcccc

SEQ ID NO: 3969 - DNA, 35 bp, Artificial Sequence
  Synthetic oligonucleotide
tacgtactcggctcatatctgttctcccaaccgtc

SEQ ID NO: 3970 - DNA, 35 bp, Artificial Sequence
  Synthetic oligonucleotide
acttgcgcatcgcacgactattcacctgcacgccc

SEQ ID NO: 3971 - DNA, 36 bp, Artificial Sequence
  Synthetic oligonucleotide
ttccgcccccgcacctgctcttaggcatcaaccttg

SEQ ID NO: 3972 - DNA, 37 bp, Artificial Sequence
  Synthetic oligonucleotide
tgcacccatcacccctgcctaactgcgctcccgccga

SEQ ID NO: 3973 - DNA, 35 bp, Artificial Sequence
  Synthetic oligonucleotide
tacgcccactcatctggatggacctcgctactacc

SEQ ID NO: 3974 - DNA, 35 bp, Artificial Sequence
  Synthetic oligonucleotide
gtgcccacctatcacataaccaccgaacgacctcg

SEQ ID NO: 3975 - DNA, 35 bp, Artificial Sequence
  Synthetic oligonucleotide
accgcccagcaccgcttgctatgccgaactttacc

SEQ ID NO: 3976 - DNA, 35 bp, Artificial Sequence
  Synthetic oligonucleotide
acacagccgcacacactgcattcaacccgcgcctg

SEQ ID NO: 3977 - DNA, 36 bp, Artificial Sequence
  Synthetic oligonucleotide
tgcacgcagtgagatccgaccaccacatcacacgca

SEQ ID NO: 3978 - DNA, 35 bp, Artificial Sequence
  Synthetic oligonucleotide
tccagacgttcacaacacccgctttgcttccaact

SEQ ID NO: 3979 - DNA, 35 bp, Artificial Sequence
  Synthetic oligonucleotide
ttgcacatggtggggtaggaaggggaggaaacggg

SEQ ID NO: 3980 - DNA, 35 bp, Artificial Sequence
  Synthetic oligonucleotide
gcgggtggggtggggaggggatccatcgaatagtc

SEQ ID NO: 3981 - DNA, 35 bp, Artificial Sequence
  Synthetic oligonucleotide
gaactgcctcagccgcccctcccgcccgcgttgca

SEQ ID NO: 3982 - DNA, 34 bp, Artificial Sequence
  Synthetic oligonucleotide
attgccccgacccacgatctaccctgatgccact

SEQ ID NO: 3983 - DNA, 35 bp, Artificial Sequence
  Synthetic oligonucleotide
tggggagggtggataatctgggtagggaagggtag

SEQ ID NO: 3984 - DNA, 35 bp, Artificial Sequence
  Synthetic oligonucleotide
tcccgcgtgcgcctttaaccctccatggtcctgtc

SEQ ID NO: 3985 - DNA, 35 bp, Artificial Sequence
  Synthetic oligonucleotide
tgacctccatcccgatccatgcctcaggcacaatt

SEQ ID NO: 3986 - DNA, 35 bp, Artificial Sequence
  Synthetic oligonucleotide
actccaccctcgacaaccagcaacctgacggttct

SEQ ID NO: 3987 - DNA, 35 bp, Artificial Sequence
  Synthetic oligonucleotide
acatgccctctgtcgtccgccatttcgctgccctg

SEQ ID NO: 3988 - DNA, 35 bp, Artificial Sequence
  Synthetic oligonucleotide
tacctcgccacaatccttttaaccctcgaactgag

SEQ ID NO: 3989 - DNA, 35 bp, Artificial Sequence
  Synthetic oligonucleotide
acacccgcaggcccatcaatctagagtcctccgtc

SEQ ID NO: 3990 - DNA, 38 bp, Artificial Sequence
  Synthetic oligonucleotide
actgcccccttctgttgcttttttgtacactgtggtga

SEQ ID NO: 3991 - DNA, 37 bp, Artificial Sequence
  Synthetic oligonucleotide
gagagggtaatggggggggcaaggagtgggactagga

SEQ ID NO: 3992 - DNA, 35 bp, Artificial Sequence
  Synthetic oligonucleotide
accctcagcgcggccatcggttcagtacaccgctc

SEQ ID NO: 3993 - DNA, 36 bp, Artificial Sequence
  Synthetic oligonucleotide
gaaccacaccaactgcacttatcctccacgagggca

SEQ ID NO: 3994 - DNA, 35 bp, Artificial Sequence
  Synthetic oligonucleotide
tccctccgccgccgctacactaatcctgacttcga

SEQ ID NO: 3995 - DNA, 35 bp, Artificial Sequence
  Synthetic oligonucleotide
gcccatgccactcttattctgggacttttctccgt

SEQ ID NO: 3996 - DNA, 35 bp, Artificial Sequence
  Synthetic oligonucleotide
tgatcgccagtgcttttcattcgtagtcaccgctc

SEQ ID NO: 3997 - DNA, 35 bp, Artificial Sequence
  Synthetic oligonucleotide
gcacctccgccctgatctacgttttttagtcccca

SEQ ID NO: 3998 - DNA, 35 bp, Artificial Sequence
  Synthetic oligonucleotide
atagacctgcccagcccctctttctcgtttctacg

SEQ ID NO: 3999 - DNA, 37 bp, Artificial Sequence
  Synthetic oligonucleotide
atgccaccgcactttttgacttccaccgttcttcaga

SEQ ID NO: 4000 - DNA, 38 bp, Artificial Sequence
  Synthetic oligonucleotide
ttgcacgggtcgggtgggtggtaggggctgggtactga

SEQ ID NO: 4001 - DNA, 36 bp, Artificial Sequence
  Synthetic oligonucleotide
gacacgacggcgggggggattcagctggggctatca

SEQ ID NO: 4002 - DNA, 35 bp, Artificial Sequence
  Synthetic oligonucleotide
gacgcacccgccttaatgctcgctgcatgtcaccc

SEQ ID NO: 4003 - DNA, 35 bp, Artificial Sequence
  Synthetic oligonucleotide
acaaccaccgactcaggcctcgtattacccactga

SEQ ID NO: 4004 - DNA, 35 bp, Artificial Sequence
  Synthetic oligonucleotide
tcatcatgcccctgctgctttcaacgacacccgaa

SEQ ID NO: 4005 - DNA, 35 bp, Artificial Sequence
  Synthetic oligonucleotide
aagacacatccctcgttcctgaatgcgctgtattt

SEQ ID NO: 4006 - DNA, 35 bp, Artificial Sequence
  Synthetic oligonucleotide
tgatgcgtgggccatcgttggtttcgttttcttcc

SEQ ID NO: 4007 - DNA, 35 bp, Artificial Sequence
  Synthetic oligonucleotide
accaccgcgttgcgccgcaccttcatcccctactc

SEQ ID NO: 4008 - DNA, 35 bp, Artificial Sequence
  Synthetic oligonucleotide
tctggcccgatcagactcatcccgaccgtcatgcc

SEQ ID NO: 4009 - DNA, 35 bp, Artificial Sequence
  Synthetic oligonucleotide
agctacacccggccctcgcaccttccccctgtatc

SEQ ID NO: 4010 - DNA, 36 bp, Artificial Sequence
  Synthetic oligonucleotide
gcctgtccatctggtcctcgccatgtcccctgtaca

SEQ ID NO: 4011 - DNA, 35 bp, Artificial Sequence
  Synthetic oligonucleotide
caatcagcacggtcatttaatcgggcactccacac

SEQ ID NO: 4012 - DNA, 36 bp, Artificial Sequence
  Synthetic oligonucleotide
actccaaccgctacatgtgattgctgcttcccctta

SEQ ID NO: 4013 - DNA, 37 bp, Artificial Sequence
  Synthetic oligonucleotide
actgcggtggagggtggaaatggggtgaaggtgatga

SEQ ID NO: 4014 - DNA, 36 bp, Artificial Sequence
  Synthetic oligonucleotide
gtgcccctcttccgttcctgcctgcctttaatttga

SEQ ID NO: 4015 - DNA, 35 bp, Artificial Sequence
  Synthetic oligonucleotide
ttgatcgcagtgtgaccgcccgtttcctcccgtat

SEQ ID NO: 4016 - DNA, 36 bp, Artificial Sequence
  Synthetic oligonucleotide
tgcaagtgcctgccccccttgcattatcctgttcga

SEQ ID NO: 4017 - DNA, 38 bp, Artificial Sequence
  Synthetic oligonucleotide
tgcaccgcacccctgcatcctgtatactgccccaatga

SEQ ID NO: 4018 - DNA, 35 bp, Artificial Sequence
  Synthetic oligonucleotide
ggtgcacccggtccgcaagctctatcactgctctc

SEQ ID NO: 4019 - DNA, 36 bp, Artificial Sequence
  Synthetic oligonucleotide
tatcgccgccccatcgctccctatcctgtcattcga

SEQ ID NO: 4020 - DNA, 35 bp, Artificial Sequence
  Synthetic oligonucleotide
agatccaccacccatgtcaacgaccctgttgatcc

SEQ ID NO: 4021 - DNA, 35 bp, Artificial Sequence
  Synthetic oligonucleotide
gaacgaaccacccgccgcctacgcgatcacatctc

SEQ ID NO: 4022 - DNA, 35 bp, Artificial Sequence
  Synthetic oligonucleotide
aacacgacaccaccactatgttctctgccccacgc

SEQ ID NO: 4023 - DNA, 36 bp, Artificial Sequence
  Synthetic oligonucleotide
tcacaatgcagcccccacatctcccaatgcgatcca

SEQ ID NO: 4024 - DNA, 36 bp, Artificial Sequence
  Synthetic oligonucleotide
gacatgggaggaggggaagggtcgggagtaagcgga

SEQ ID NO: 4025 - DNA, 38 bp, Artificial Sequence
  Synthetic oligonucleotide
tgggggggggggcgaagatgatgcaggggcgatcgtga

SEQ ID NO: 4026 - DNA, 35 bp, Artificial Sequence
  Synthetic oligonucleotide
actagcaccgccatccacagtaccccgccgtcatc

SEQ ID NO: 4027 - DNA, 35 bp, Artificial Sequence
  Synthetic oligonucleotide
tcaacgcatgcgatataatcgtcccctcgtcgccc

SEQ ID NO: 4028 - DNA, 35 bp, Artificial Sequence
  Synthetic oligonucleotide
tgtgccccagttaccatacacccggacccttcgcg

SEQ ID NO: 4029 - DNA, 35 bp, Artificial Sequence
  Synthetic oligonucleotide
accgcgcccacggcgtgtttccatcctggtctcca

SEQ ID NO: 4030 - DNA, 35 bp, Artificial Sequence
  Synthetic oligonucleotide
tcacgactcactcttgcctatgggcacccgtatcc

SEQ ID NO: 4031 - DNA, 37 bp, Artificial Sequence
  Synthetic oligonucleotide
atgaaacggagggtgggtaattgtcgggttggaagga

SEQ ID NO: 4032 - DNA, 35 bp, Artificial Sequence
  Synthetic oligonucleotide
atcccactcagccgtcctctttaggcgtcctcttt

SEQ ID NO: 4033 - DNA, 35 bp, Artificial Sequence
  Synthetic oligonucleotide
actgcggccctccgttgttttttatcgcctcatga

SEQ ID NO: 4034 - DNA, 36 bp, Artificial Sequence
  Synthetic oligonucleotide
tcgatcgccacacctaagggctcccattttatccga

SEQ ID NO: 4035 - DNA, 35 bp, Artificial Sequence
  Synthetic oligonucleotide
tccctcgccccaccaacacactgcaggacaccagc

SEQ ID NO: 4036 - DNA, 37 bp, Artificial Sequence
  Synthetic oligonucleotide
gtccatgccccactgcctaccgcgccactttggcgga

SEQ ID NO: 4037 - DNA, 35 bp, Artificial Sequence
  Synthetic oligonucleotide
gtggacaagtgggtaggggggaaagggatggtagt

SEQ ID NO: 4038 - DNA, 36 bp, Artificial Sequence
  Synthetic oligonucleotide
cccactgcctacgctattagatcttcctgtgcacca

SEQ ID NO: 4039 - DNA, 35 bp, Artificial Sequence
  Synthetic oligonucleotide
acaacacctgcgcattgagcaccgttattccccct

SEQ ID NO: 4040 - DNA, 38 bp, Artificial Sequence
  Synthetic oligonucleotide
acagatcctgccccaatgccgccacacgagacccttga

SEQ ID NO: 4041 - DNA, 38 bp, Artificial Sequence
  Synthetic oligonucleotide
atacgcaggcgcctggctctatctacgacccctcctga

SEQ ID NO: 4042 - DNA, 35 bp, Artificial Sequence
  Synthetic oligonucleotide
gccaccccgcccaccatgtgatcgcaaactggttt

SEQ ID NO: 4043 - DNA, 35 bp, Artificial Sequence
  Synthetic oligonucleotide
taccctgcctccaggcccacgttcactaccgcatt

SEQ ID NO: 4044 - DNA, 35 bp, Artificial Sequence
  Synthetic oligonucleotide
ggatggacgtagtggggcgggttgaagggggggcg

SEQ ID NO: 4045 - DNA, 38 bp, Artificial Sequence
  Synthetic oligonucleotide
accacgtcgccgccgtacacctcaacctttcgtattga

SEQ ID NO: 4046 - DNA, 36 bp, Artificial Sequence
  Synthetic oligonucleotide
gattgcggccagacaccctgctgcctgttctccaca

SEQ ID NO: 4047 - DNA, 35 bp, Artificial Sequence
  Synthetic oligonucleotide
gaccccccccgtctccccttgtacctgcgctccat

SEQ ID NO: 4048 - DNA, 35 bp, Artificial Sequence
  Synthetic oligonucleotide
tcaacacccacaatgcgttactcgttccgttcaat

SEQ ID NO: 4049 - DNA, 35 bp, Artificial Sequence
  Synthetic oligonucleotide
taggatggaaggagagtgtgggcgggcgggaggtg

SEQ ID NO: 4050 - DNA, 35 bp, Artificial Sequence
  Synthetic oligonucleotide
gtgcaaccactgaaccacctgacctagacagctcc

SEQ ID NO: 4051 - DNA, 38 bp, Artificial Sequence
  Synthetic oligonucleotide
atgccaccgtccacggtgctcccatgcctcccccttga

SEQ ID NO: 4052 - DNA, 35 bp, Artificial Sequence
  Synthetic oligonucleotide
atcccatcagcctagccctatccccgttttacggg

SEQ ID NO: 4053 - DNA, 35 bp, Artificial Sequence
  Synthetic oligonucleotide
actccacactgaactctcgtgtcaacactcaccat

SEQ ID NO: 4054 - DNA, 36 bp, Artificial Sequence
  Synthetic oligonucleotide
tgtgcaaggcgcctgtctccccgctgtcctaccata

SEQ ID NO: 4055 - DNA, 35 bp, Artificial Sequence
  Synthetic oligonucleotide
cacgatcgcgccaacgcgtgaacccgcccttccaa

SEQ ID NO: 4056 - DNA, 36 bp, Artificial Sequence
  Synthetic oligonucleotide
atcacccgcccccgcaaccctgcttaacggtcctaa

SEQ ID NO: 4057 - DNA, 35 bp, Artificial Sequence
  Synthetic oligonucleotide
gaagtggacgggggggaaggagaggcgcggcgctg

SEQ ID NO: 4058 - DNA, 37 bp, Artificial Sequence
  Synthetic oligonucleotide
gtaccacactcgatcgatatgcccaccgtttgcccga

SEQ ID NO: 4059 - DNA, 35 bp, Artificial Sequence
  Synthetic oligonucleotide
tcaccctcccgccactactgtccgaagaccccgtg

SEQ ID NO: 4060 - DNA, 36 bp, Artificial Sequence
  Synthetic oligonucleotide
acacgtctgcctctaatgtcttcttatcgcccatca

SEQ ID NO: 4061 - DNA, 36 bp, Artificial Sequence
  Synthetic oligonucleotide
gagccatcatcgcacccgcccttgcaaccgagccca

SEQ ID NO: 4062 - DNA, 32 bp, Artificial Sequence
  Synthetic oligonucleotide
gccagggcaatcttacccaacacagcccatcc

SEQ ID NO: 4063 - DNA, 35 bp, Artificial Sequence
  Synthetic oligonucleotide
tcaacctcctcaaattgtaccaccgtccgtactgc

SEQ ID NO: 4064 - DNA, 35 bp, Artificial Sequence
  Synthetic oligonucleotide
acgagcgctgtactgtccttcgttcctactttgtc

SEQ ID NO: 4065 - DNA, 35 bp, Artificial Sequence
  Synthetic oligonucleotide
tctgccccacaacacaacggtccagactcacattt

SEQ ID NO: 4066 - DNA, 35 bp, Artificial Sequence
  Synthetic oligonucleotide
gagccccacccgaccctgtctcatgtccgagtatt

SEQ ID NO: 4067 - DNA, 36 bp, Artificial Sequence
  Synthetic oligonucleotide
ggaatccgtcgcatgtcttgcctgcccttcccccca

SEQ ID NO: 4068 - DNA, 37 bp, Artificial Sequence
  Synthetic oligonucleotide
gtgaccccccgatatcgacctaacgacctgttccgga

SEQ ID NO: 4069 - DNA, 35 bp, Artificial Sequence
  Synthetic oligonucleotide
gcacccacacgatatccacctacgaatcttctgca

SEQ ID NO: 4070 - DNA, 35 bp, Artificial Sequence
  Synthetic oligonucleotide
attctccgccccatgccgcatgtgcctcttacttg

SEQ ID NO: 4071 - DNA, 36 bp, Artificial Sequence
  Synthetic oligonucleotide
tcaagccgctggctgctatacgtacctcccctgcaa

SEQ ID NO: 4072 - DNA, 35 bp, Artificial Sequence
  Synthetic oligonucleotide
tttgccctaacgccctgcacatgactgccttgatt

SEQ ID NO: 4073 - DNA, 35 bp, Artificial Sequence
  Synthetic oligonucleotide
tccaaaccatcttatgcctgccatcactgcccctg

SEQ ID NO: 4074 - DNA, 37 bp, Artificial Sequence
  Synthetic oligonucleotide
tctgcagacgcaccccatctgttttatgccttgttga

SEQ ID NO: 4075 - DNA, 35 bp, Artificial Sequence
  Synthetic oligonucleotide
tccacctccacataaccgtcgtttcgaccgggcct

SEQ ID NO: 4076 - DNA, 35 bp, Artificial Sequence
  Synthetic oligonucleotide
ggatcccgcctactttctgcaggtttttgcctatt

SEQ ID NO: 4077 - DNA, 35 bp, Artificial Sequence
  Synthetic oligonucleotide
acccttgcccacggaccctcgagtaccccaattgc

SEQ ID NO: 4078 - DNA, 35 bp, Artificial Sequence
  Synthetic oligonucleotide
tacgtgcacatcacggcacttccgctccccccgca

SEQ ID NO: 4079 - DNA, 35 bp, Artificial Sequence
  Synthetic oligonucleotide
tacacgccagccacttatttcctgttcccatgccg

SEQ ID NO: 4080 - DNA, 37 bp, Artificial Sequence
  Synthetic oligonucleotide
tgcatgccccctacccggtatttgcacgatgccttga

SEQ ID NO: 4081 - DNA, 37 bp, Artificial Sequence
  Synthetic oligonucleotide
acaccctgcctcccctgaatcatcattacccgtagga

SEQ ID NO: 4082 - DNA, 35 bp, Artificial Sequence
  Synthetic oligonucleotide
gccggtccacatttcactgcctctaatagtccgcc

SEQ ID NO: 4083 - DNA, 35 bp, Artificial Sequence
  Synthetic oligonucleotide
aacatgctccccctccacttcaggctgtttttgtc

SEQ ID NO: 4084 - DNA, 35 bp, Artificial Sequence
  Synthetic oligonucleotide
taccttgcgcgctccacctagttatcaccgctcca

SEQ ID NO: 4085 - DNA, 35 bp, Artificial Sequence
  Synthetic oligonucleotide
accgggccgacactacccctgatcccgcctgtatc

SEQ ID NO: 4086 - DNA, 35 bp, Artificial Sequence
  Synthetic oligonucleotide
gccggacgcctcattgcgccatgctcttcactatc

SEQ ID NO: 4087 - DNA, 35 bp, Artificial Sequence
  Synthetic oligonucleotide
ttgacccggtctccattgccatacgcgcccacttt

SEQ ID NO: 4088 - DNA, 35 bp, Artificial Sequence
  Synthetic oligonucleotide
gagtgcaccacattctgctgccttctagaactttc

SEQ ID NO: 4089 - DNA, 35 bp, Artificial Sequence
  Synthetic oligonucleotide
gacaacaagcctgccgtgcaagcccctctctcgtt

SEQ ID NO: 4090 - DNA, 35 bp, Artificial Sequence
  Synthetic oligonucleotide
actgcgccccctttccgcaccgtcattccctgttt

SEQ ID NO: 4091 - DNA, 35 bp, Artificial Sequence
  Synthetic oligonucleotide
gtgccactcgactctcaccgcccctaggctttgct

SEQ ID NO: 4092 - DNA, 35 bp, Artificial Sequence
  Synthetic oligonucleotide
tacaacccacatcacaccacgcgctctagcgcgac

SEQ ID NO: 4093 - DNA, 38 bp, Artificial Sequence
  Synthetic oligonucleotide
aaccctccgctcctggtttctatacacactccacatga

SEQ ID NO: 4094 - DNA, 36 bp, Artificial Sequence
  Synthetic oligonucleotide
tcgaaccccaatcctcccccaacggtacgctagtaa

SEQ ID NO: 4095 - DNA, 35 bp, Artificial Sequence
  Synthetic oligonucleotide
acaaagccgcagacaatcgaaccaccgccgcctta

SEQ ID NO: 4096 - DNA, 35 bp, Artificial Sequence
  Synthetic oligonucleotide
tcaaggctcagtctcggcccctttactgtcactcc

SEQ ID NO: 4097 - DNA, 35 bp, Artificial Sequence
  Synthetic oligonucleotide
ttgcctactcaactcgcgtctcgatccctcgctcc

SEQ ID NO: 4098 - DNA, 35 bp, Artificial Sequence
  Synthetic oligonucleotide
gccgacgccgctcattgttcgcttcttgcccctgt

SEQ ID NO: 4099 - DNA, 35 bp, Artificial Sequence
  Synthetic oligonucleotide
actacacctgcacccgccgtgtaccgccacctttt

SEQ ID NO: 4100 - DNA, 35 bp, Artificial Sequence
  Synthetic oligonucleotide
gtccacaccctctctctctgtctttggcagaactt

SEQ ID NO: 4101 - DNA, 35 bp, Artificial Sequence
  Synthetic oligonucleotide
accacacggttgtcatcctccatcgctgccttaat

SEQ ID NO: 4102 - DNA, 36 bp, Artificial Sequence
  Synthetic oligonucleotide
tccgcccgcatcttctcgtttcattcggtgatccta

SEQ ID NO: 4103 - DNA, 35 bp, Artificial Sequence
  Synthetic oligonucleotide
gacaatcacgccactactgcgtgcctccactacat

SEQ ID NO: 4104 - DNA, 35 bp, Artificial Sequence
  Synthetic oligonucleotide
taagccccccgctccgtatttttctgtcccatgct

SEQ ID NO: 4105 - DNA, 35 bp, Artificial Sequence
  Synthetic oligonucleotide
tgatacgcaatgcgagtccactgttctttctttcg

SEQ ID NO: 4106 - DNA, 36 bp, Artificial Sequence
  Synthetic oligonucleotide
ttagacccgccgcacatccgctctggccccccgaaa

SEQ ID NO: 4107 - DNA, 35 bp, Artificial Sequence
  Synthetic oligonucleotide
acttcaccaccagtccctaaccacgggccaccgac

SEQ ID NO: 4108 - DNA, 36 bp, Artificial Sequence
  Synthetic oligonucleotide
attgatcgcccaatgctatttctacctggtaccaca

SEQ ID NO: 4109 - DNA, 35 bp, Artificial Sequence
  Synthetic oligonucleotide
gacatcaccaccccggcgccgcacccctagcactc

SEQ ID NO: 4110 - DNA, 35 bp, Artificial Sequence
  Synthetic oligonucleotide
tagcaccttgttacctgcaaaagccacatgccctc

SEQ ID NO: 4111 - DNA, 36 bp, Artificial Sequence
  Synthetic oligonucleotide
tctacgccctcgcactacatcttccagttttgggaa

SEQ ID NO: 4112 - DNA, 36 bp, Artificial Sequence
  Synthetic oligonucleotide
tgcctgccaccactgctgccaaacatccagttccaa

SEQ ID NO: 4113 - DNA, 37 bp, Artificial Sequence
  Synthetic oligonucleotide
tagagaagggcggtacaggggagggggcgaaagggga

SEQ ID NO: 4114 - DNA, 35 bp, Artificial Sequence
  Synthetic oligonucleotide
gccatgccattctgtaagcctctggtcccttcaca

SEQ ID NO: 4115 - DNA, 35 bp, Artificial Sequence
  Synthetic oligonucleotide
cagatagctccagcgttgcccctcccgttcacgcc

SEQ ID NO: 4116 - DNA, 38 bp, Artificial Sequence
  Synthetic oligonucleotide
aacccaccccacccgatagtccgtagtgacatcgttga

SEQ ID NO: 4117 - DNA, 35 bp, Artificial Sequence
  Synthetic oligonucleotide
tccagctgtcacttctcgccgcagtacatcctttc

SEQ ID NO: 4118 - DNA, 35 bp, Artificial Sequence
  Synthetic oligonucleotide
gcaatcgccctctctcctgacacaccccggccgtt

SEQ ID NO: 4119 - DNA, 35 bp, Artificial Sequence
  Synthetic oligonucleotide
actgacacccctcctccgcacgcttaggctgttcc

SEQ ID NO: 4120 - DNA, 36 bp, Artificial Sequence
  Synthetic oligonucleotide
gatgccgcctggctctttacatccgcccccctggta

SEQ ID NO: 4121 - DNA, 35 bp, Artificial Sequence
  Synthetic oligonucleotide
ttcgccccatagtagtgacctagcactgctcccct

SEQ ID NO: 4122 - DNA, 35 bp, Artificial Sequence
  Synthetic oligonucleotide
acttcccaccctcgttgtccttactctgtgacgca

SEQ ID NO: 4123 - DNA, 35 bp, Artificial Sequence
  Synthetic oligonucleotide
tacatcgagccacacccccacttgccacccgcttg

SEQ ID NO: 4124 - DNA, 35 bp, Artificial Sequence
  Synthetic oligonucleotide
acacatcacccgcactcgagttcttacctggcttc

SEQ ID NO: 4125 - DNA, 35 bp, Artificial Sequence
  Synthetic oligonucleotide
tcccagcccacacctcaccccaacatacaggactg

SEQ ID NO: 4126 - DNA, 35 bp, Artificial Sequence
  Synthetic oligonucleotide
gacaggtccagcattatttgccctctcctcgaacg

SEQ ID NO: 4127 - DNA, 37 bp, Artificial Sequence
  Synthetic oligonucleotide
gcacgaggtgaaggggaatactgtgaaggatggaaga

SEQ ID NO: 4128 - DNA, 35 bp, Artificial Sequence
  Synthetic oligonucleotide
ggaccatacacagaagtataccctacttaccctcg

SEQ ID NO: 4129 - DNA, 38 bp, Artificial Sequence
  Synthetic oligonucleotide
tcactcgccatggtcgaatagaccgctgacccacctga

SEQ ID NO: 4130 - DNA, 36 bp, Artificial Sequence
  Synthetic oligonucleotide
tccttgcctccgacgcgctcctgagcctattaacta

SEQ ID NO: 4131 - DNA, 35 bp, Artificial Sequence
  Synthetic oligonucleotide
gccaccccgcataccctgcatcaactagccatact

SEQ ID NO: 4132 - DNA, 35 bp, Artificial Sequence
  Synthetic oligonucleotide
atcccgcatcaccttatacctgcctgtggccctgc

SEQ ID NO: 4133 - DNA, 35 bp, Artificial Sequence
  Synthetic oligonucleotide
atcgcaacgcacacccatgctttttccgataccac

SEQ ID NO: 4134 - DNA, 36 bp, Artificial Sequence
  Synthetic oligonucleotide
accaccacccgggacacaaccctgacggatttccga

SEQ ID NO: 4135 - DNA, 34 bp, Artificial Sequence
  Synthetic oligonucleotide
tagcacgcacccctccccagcgcgctcccatctg

SEQ ID NO: 4136 - DNA, 34 bp, Artificial Sequence
  Synthetic oligonucleotide
acccgccgataggcccctctccgccatccgccta

SEQ ID NO: 4137 - DNA, 35 bp, Artificial Sequence
  Synthetic oligonucleotide
atgcacgacacactttcctgtaggcccagctttat

SEQ ID NO: 4138 - DNA, 35 bp, Artificial Sequence
  Synthetic oligonucleotide
aacccgcacctccacggctgtaacatgtttgccat

SEQ ID NO: 4139 - DNA, 35 bp, Artificial Sequence
  Synthetic oligonucleotide
aagtgccgctacacttccatcgtatcactctgtcc

SEQ ID NO: 4140 - DNA, 35 bp, Artificial Sequence
  Synthetic oligonucleotide
acccccactccagaccgcccatctcgcccagtaga

SEQ ID NO: 4141 - DNA, 35 bp, Artificial Sequence
  Synthetic oligonucleotide
gaccaccctggttcgtgtacccgcttgtgcctact

SEQ ID NO: 4142 - DNA, 35 bp, Artificial Sequence
  Synthetic oligonucleotide
gtcatccccactcctgaagtctgttcctgctgtac

SEQ ID NO: 4143 - DNA, 38 bp, Artificial Sequence
  Synthetic oligonucleotide
gacaccaccctgctgccgcctcctcacctatgacgtga

SEQ ID NO: 4144 - DNA, 35 bp, Artificial Sequence
  Synthetic oligonucleotide
accccactaccatgcacgtattacggcgcctactc

SEQ ID NO: 4145 - DNA, 38 bp, Artificial Sequence
  Synthetic oligonucleotide
aactgccacactcactggtttcgatccctcctctatga

SEQ ID NO: 4146 - DNA, 35 bp, Artificial Sequence
  Synthetic oligonucleotide
tccgcactccttcgttgtcttccttaggtccaagc

SEQ ID NO: 4147 - DNA, 35 bp, Artificial Sequence
  Synthetic oligonucleotide
tacccgcccctccatcgcacactcctgtttacgca

SEQ ID NO: 4148 - DNA, 35 bp, Artificial Sequence
  Synthetic oligonucleotide
gagccatgatacacgatctgccctcataaccactt

SEQ ID NO: 4149 - DNA, 35 bp, Artificial Sequence
  Synthetic oligonucleotide
gcatcaacacaccgctgccacgcctagccaccttt

SEQ ID NO: 4150 - DNA, 35 bp, Artificial Sequence
  Synthetic oligonucleotide
tgcgacaccacacgggtcttaatgcaacacaccct

SEQ ID NO: 4151 - DNA, 36 bp, Artificial Sequence
  Synthetic oligonucleotide
gcctcaccgcgcgtcgtaaacctgttcgtccctcta

SEQ ID NO: 4152 - DNA, 36 bp, Artificial Sequence
  Synthetic oligonucleotide
acaggaccgactgcccatactaactgacctccgcca

SEQ ID NO: 4153 - DNA, 36 bp, Artificial Sequence
  Synthetic oligonucleotide
tcactagcgccctctaaacctgcagctgccccccca

SEQ ID NO: 4154 - DNA, 37 bp, Artificial Sequence
  Synthetic oligonucleotide
gaatcgcagtcgtcgccacgtccgcaccacactctga

SEQ ID NO: 4155 - DNA, 35 bp, Artificial Sequence
  Synthetic oligonucleotide
tgcaatacccgctctgtctgtcgtccaacttcccg

SEQ ID NO: 4156 - DNA, 36 bp, Artificial Sequence
  Synthetic oligonucleotide
agccaccaccctctgcctttgcacatactcgtttca

SEQ ID NO: 4157 - DNA, 35 bp, Artificial Sequence
  Synthetic oligonucleotide
gccaccgtacaccgcctaccgtcaggaagtccctc

SEQ ID NO: 4158 - DNA, 38 bp, Artificial Sequence
  Synthetic oligonucleotide
tcgcaccccacgaggtccagctcccagcactcctttga

SEQ ID NO: 4159 - DNA, 35 bp, Artificial Sequence
  Synthetic oligonucleotide
atgtcaacccacggactggccttgatcccctactc

SEQ ID NO: 4160 - DNA, 35 bp, Artificial Sequence
  Synthetic oligonucleotide
gaacccaacacctgtatgtcatgtcccgccttagc

SEQ ID NO: 4161 - DNA, 36 bp, Artificial Sequence
  Synthetic oligonucleotide
gccacctccatttgtctccgcccacttgagaaccaa

SEQ ID NO: 4162 - DNA, 37 bp, Artificial Sequence
  Synthetic oligonucleotide
gtagtcgggaaggggctaacaaagaagggggcggaga

SEQ ID NO: 4163 - DNA, 35 bp, Artificial Sequence
  Synthetic oligonucleotide
tgctccgtacacggttcactgccccttcctactgt

SEQ ID NO: 4164 - DNA, 35 bp, Artificial Sequence
  Synthetic oligonucleotide
tccgcccactccggttatattggttcatgtccatt

SEQ ID NO: 4165 - DNA, 35 bp, Artificial Sequence
  Synthetic oligonucleotide
atgcccggccacctactttgatccagccacacgct

SEQ ID NO: 4166 - DNA, 33 bp, Artificial Sequence
  Synthetic oligonucleotide
ttcgacgacgacttcgttctatgcccactttgt

SEQ ID NO: 4167 - DNA, 35 bp, Artificial Sequence
  Synthetic oligonucleotide
gacccactgtgtctgccttaactcacggagcttac

SEQ ID NO: 4168 - DNA, 35 bp, Artificial Sequence
  Synthetic oligonucleotide
gcactcctgccacgatgcctcctcccaccgaatgt

SEQ ID NO: 4169 - DNA, 35 bp, Artificial Sequence
  Synthetic oligonucleotide
ataggatccgcccgttgccctgtacttcctcgcta

SEQ ID NO: 4170 - DNA, 36 bp, Artificial Sequence
  Synthetic oligonucleotide
tgctctcacccgccattatccccagcctgacctcga

SEQ ID NO: 4171 - DNA, 35 bp, Artificial Sequence
  Synthetic oligonucleotide
tacaatcagccaccccacctgccgtcatcgcgaac

SEQ ID NO: 4172 - DNA, 37 bp, Artificial Sequence
  Synthetic oligonucleotide
acatctcgcaaacgtgcacacgccactgtctcctcga

SEQ ID NO: 4173 - DNA, 35 bp, Artificial Sequence
  Synthetic oligonucleotide
tgccatgagcctctcatgttgaaccgcactttccc

SEQ ID NO: 4174 - DNA, 35 bp, Artificial Sequence
  Synthetic oligonucleotide
gatgcaccacgtgccttacctcactggattaacct

SEQ ID NO: 4175 - DNA, 37 bp, Artificial Sequence
  Synthetic oligonucleotide
gccccctgcacccgccctgtaccaccaccgtaatgga

SEQ ID NO: 4176 - DNA, 35 bp, Artificial Sequence
  Synthetic oligonucleotide
gacaacgcctccattcgcattcgactaccactaac

SEQ ID NO: 4177 - DNA, 35 bp, Artificial Sequence
  Synthetic oligonucleotide
aactgaggccggaacctacttcgagccacccttgc

SEQ ID NO: 4178 - DNA, 37 bp, Artificial Sequence
  Synthetic oligonucleotide
gttgaggggactcgtgggggcgggcgggtaggaccga

SEQ ID NO: 4179 - DNA, 31 bp, Artificial Sequence
  Synthetic oligonucleotide
gcaccaccctttggctctagtacttttggaa

SEQ ID NO: 4180 - DNA, 35 bp, Artificial Sequence
  Synthetic oligonucleotide
agtgcccttctatctcgttcctgcaactgttccgc

SEQ ID NO: 4181 - DNA, 37 bp, Artificial Sequence
  Synthetic oligonucleotide
acactcgcaaccccaggcccaccaccaggcacgatga

SEQ ID NO: 4182 - DNA, 37 bp, Artificial Sequence
  Synthetic oligonucleotide
aactcccaccgcctcgcatcgtgcactagtagcccga

SEQ ID NO: 4183 - DNA, 37 bp, Artificial Sequence
  Synthetic oligonucleotide
gtcaagctgcaaccgctatttcccgtgccatccctga

SEQ ID NO: 4184 - DNA, 35 bp, Artificial Sequence
  Synthetic oligonucleotide
ccgctccccgtagctatacgcaatttccggtatcc

SEQ ID NO: 4185 - DNA, 36 bp, Artificial Sequence
  Synthetic oligonucleotide
gtcgccccctgcccggtacacactcaccctatgtca

SEQ ID NO: 4186 - DNA, 35 bp, Artificial Sequence
  Synthetic oligonucleotide
gacacctcaaccgtccctaagcctttcactcctcg

SEQ ID NO: 4187 - DNA, 37 bp, Artificial Sequence
  Synthetic oligonucleotide
gcagggaggatagggtggagggaaggggggctcaaga

SEQ ID NO: 4188 - DNA, 35 bp, Artificial Sequence
  Synthetic oligonucleotide
gtcgcgtgcctaacgcgtatccttgccacatctac

SEQ ID NO: 4189 - DNA, 35 bp, Artificial Sequence
  Synthetic oligonucleotide
tcctcactcggtccttgcactctgtctatctgccc

SEQ ID NO: 4190 - DNA, 35 bp, Artificial Sequence
  Synthetic oligonucleotide
tccacctgtgccatggttagttcctgtggtcccct

SEQ ID NO: 4191 - DNA, 36 bp, Artificial Sequence
  Synthetic oligonucleotide
gtttgccgctgtgtcccgtcgcctcgtccgttccaa

SEQ ID NO: 4192 - DNA, 38 bp, Artificial Sequence
  Synthetic oligonucleotide
aacatccatctgccgtgcaagcttgaccccatacatga

SEQ ID NO: 4193 - DNA, 35 bp, Artificial Sequence
  Synthetic oligonucleotide
gcacgttcatcgctcgtacgcaccgtgttgccctt

SEQ ID NO: 4194 - DNA, 35 bp, Artificial Sequence
  Synthetic oligonucleotide
gattgcctcccatcattcaagcaggcctaccctgt

SEQ ID NO: 4195 - DNA, 35 bp, Artificial Sequence
  Synthetic oligonucleotide
tgctcacgtgccggccttctatatatcacgattcc

SEQ ID NO: 4196 - DNA, 35 bp, Artificial Sequence
  Synthetic oligonucleotide
acatccctgcccttccgctgagcactgttgcctgt

SEQ ID NO: 4197 - DNA, 35 bp, Artificial Sequence
  Synthetic oligonucleotide
gccggtcccgcctcctgccttgcctgcatgacaaa

SEQ ID NO: 4198 - DNA, 35 bp, Artificial Sequence
  Synthetic oligonucleotide
tccgcctgctagccgatatctttgcgccttcacac

SEQ ID NO: 4199 - DNA, 36 bp, Artificial Sequence
  Synthetic oligonucleotide
tccaccgtacaacatgatactactccgcctggctca

SEQ ID NO: 4200 - DNA, 36 bp, Artificial Sequence
  Synthetic oligonucleotide
ttggcccctgttctgttctcgttttcaaagcctgca

SEQ ID NO: 4201 - DNA, 36 bp, Artificial Sequence
  Synthetic oligonucleotide
tcagatgccctaccgtcctctgccatgtctcacaca

SEQ ID NO: 4202 - DNA, 36 bp, Artificial Sequence
  Synthetic oligonucleotide
tgctctgcccttgcccttgccctcgcgccggttcca

SEQ ID NO: 4203 - DNA, 35 bp, Artificial Sequence
  Synthetic oligonucleotide
gcaatccacccgccgaatgttcgcttaaacttttt

SEQ ID NO: 4204 - DNA, 35 bp, Artificial Sequence
  Synthetic oligonucleotide
gcgacgcctcggtcgaccccacctatatcacgccc

SEQ ID NO: 4205 - DNA, 36 bp, Artificial Sequence
  Synthetic oligonucleotide
gccacatcacctggaaaacgcctgatcatcctttga

SEQ ID NO: 4206 - DNA, 36 bp, Artificial Sequence
  Synthetic oligonucleotide
tccactcgctcaccgtactctgtctagcctcccgga

SEQ ID NO: 4207 - DNA, 35 bp, Artificial Sequence
  Synthetic oligonucleotide
gaaagccgcactcatcgccccagtcacactcgaca

SEQ ID NO: 4208 - DNA, 35 bp, Artificial Sequence
  Synthetic oligonucleotide
gcgacccatgcctccttatgtctgatctctcatct

SEQ ID NO: 4209 - DNA, 35 bp, Artificial Sequence
  Synthetic oligonucleotide
actccatccgatctgtttttaacttgctgttgtct

SEQ ID NO: 4210 - DNA, 35 bp, Artificial Sequence
  Synthetic oligonucleotide
accctcgtgcccagtttagccccctgatccatccg

SEQ ID NO: 4211 - DNA, 35 bp, Artificial Sequence
  Synthetic oligonucleotide
ggtgctcatcagcctctatcatccagcctgcaacc

SEQ ID NO: 4212 - DNA, 36 bp, Artificial Sequence
  Synthetic oligonucleotide
atcacgcatccctgcctgccacagtggaacgcccca

SEQ ID NO: 4213 - DNA, 35 bp, Artificial Sequence
  Synthetic oligonucleotide
gccaaccccaggcagtgcttcttcgtagttcccca

SEQ ID NO: 4214 - DNA, 35 bp, Artificial Sequence
  Synthetic oligonucleotide
gacctgtcgtgcgccctgctactggcccatttcca

SEQ ID NO: 4215 - DNA, 35 bp, Artificial Sequence
  Synthetic oligonucleotide
tacgcccctccctgtgtgaccctaacgcattctat

SEQ ID NO: 4216 - DNA, 35 bp, Artificial Sequence
  Synthetic oligonucleotide
gaacaacgacggcatgcgcgaccgcccccacgtac

SEQ ID NO: 4217 - DNA, 35 bp, Artificial Sequence
  Synthetic oligonucleotide
atcatcaccatcctgctcacctagttacacctggg

SEQ ID NO: 4218 - DNA, 35 bp, Artificial Sequence
  Synthetic oligonucleotide
gccatccccgccgtcgttttggacgtcttctgcct

SEQ ID NO: 4219 - DNA, 35 bp, Artificial Sequence
  Synthetic oligonucleotide
gcaccagtcgcttcatctacattggtctcgctcac

SEQ ID NO: 4220 - DNA, 35 bp, Artificial Sequence
  Synthetic oligonucleotide
atgcccgtcccttaccatccgggagtagttccacc

SEQ ID NO: 4221 - DNA, 37 bp, Artificial Sequence
  Synthetic oligonucleotide
acagccccaccgcacacagatttcgaccccgccttga

SEQ ID NO: 4222 - DNA, 36 bp, Artificial Sequence
  Synthetic oligonucleotide
acacctcgcacgatggactcatattgcccctccgta

SEQ ID NO: 4223 - DNA, 37 bp, Artificial Sequence
  Synthetic oligonucleotide
tgaacccccttccgccacttgatcaaggccaccctga

SEQ ID NO: 4224 - DNA, 35 bp, Artificial Sequence
  Synthetic oligonucleotide
atgcgacgcaacgtttactcccgctacaccttgta

SEQ ID NO: 4225 - DNA, 35 bp, Artificial Sequence
  Synthetic oligonucleotide
taggaggcgctgccctgcactccattacctacatc

SEQ ID NO: 4226 - DNA, 37 bp, Artificial Sequence
  Synthetic oligonucleotide
aagcttgcccacccaatcgccgcccggaactccttga

SEQ ID NO: 4227 - DNA, 35 bp, Artificial Sequence
  Synthetic oligonucleotide
gagccacagcgaatgcgactatctcctgttccgta

SEQ ID NO: 4228 - DNA, 35 bp, Artificial Sequence
  Synthetic oligonucleotide
gcctgcccaccccttgtctacgcttcccccgtgta

SEQ ID NO: 4229 - DNA, 38 bp, Artificial Sequence
  Synthetic oligonucleotide
accgcccgcggtgcgttcccagcctccctattcgatga

SEQ ID NO: 4230 - DNA, 35 bp, Artificial Sequence
  Synthetic oligonucleotide
ggtcacgccacatttctctcttgcaactcgcccgt

SEQ ID NO: 4231 - DNA, 35 bp, Artificial Sequence
  Synthetic oligonucleotide
gacgacgggtgtttggtggtttgggcggagggggt

SEQ ID NO: 4232 - DNA, 35 bp, Artificial Sequence
  Synthetic oligonucleotide
attgaccccgtatctgtcatcttgccataaacctc

SEQ ID NO: 4233 - DNA, 35 bp, Artificial Sequence
  Synthetic oligonucleotide
ggatggtgggagttgtggggtaagggtgttatcgg

SEQ ID NO: 4234 - DNA, 34 bp, Artificial Sequence
  Synthetic oligonucleotide
tagaatgcgcccgctccgcccaatctagcccctt

SEQ ID NO: 4235 - DNA, 35 bp, Artificial Sequence
  Synthetic oligonucleotide
tacgccaccctgcccacctaacgccggtccctaaa

SEQ ID NO: 4236 - DNA, 35 bp, Artificial Sequence
  Synthetic oligonucleotide
gctcaccgcactcggacatcacctccgacatctgc

SEQ ID NO: 4237 - DNA, 35 bp, Artificial Sequence
  Synthetic oligonucleotide
gcactccgcccggcctccataacgttaccgaaggt

SEQ ID NO: 4238 - DNA, 35 bp, Artificial Sequence
  Synthetic oligonucleotide
accgcaacatggcactcgcgaagccttagttaccc

SEQ ID NO: 4239 - DNA, 37 bp, Artificial Sequence
  Synthetic oligonucleotide
tccgcccgcctcatctcgacctccctgcttatcgtga

SEQ ID NO: 4240 - DNA, 35 bp, Artificial Sequence
  Synthetic oligonucleotide
tcacgtctacgtcacgtaactcttgtcccaccatc

SEQ ID NO: 4241 - DNA, 37 bp, Artificial Sequence
  Synthetic oligonucleotide
gttaacgccgctgcctacctcgttccactcccgacga

SEQ ID NO: 4242 - DNA, 35 bp, Artificial Sequence
  Synthetic oligonucleotide
cccgctcccgacaccaccagaaccgcaaggaatcg

SEQ ID NO: 4243 - DNA, 35 bp, Artificial Sequence
  Synthetic oligonucleotide
ggtaccaccacacatgctcctcacatgcctacact

SEQ ID NO: 4244 - DNA, 36 bp, Artificial Sequence
  Synthetic oligonucleotide
atacaaccgcctcatccgtatccctatgtccgaaga

SEQ ID NO: 4245 - DNA, 35 bp, Artificial Sequence
  Synthetic oligonucleotide
tactgctggccacacgcatattacgtcctcctgcc

SEQ ID NO: 4246 - DNA, 34 bp, Artificial Sequence
  Synthetic oligonucleotide
ttggggccacacttgttctacctcacctaatgta

SEQ ID NO: 4247 - DNA, 35 bp, Artificial Sequence
  Synthetic oligonucleotide
accatgccaccactcaatcgtcctcgcaagatcct

SEQ ID NO: 4248 - DNA, 35 bp, Artificial Sequence
  Synthetic oligonucleotide
atcccgaccctggcctgacaccgaccatacatgtc

SEQ ID NO: 4249 - DNA, 38 bp, Artificial Sequence
  Synthetic oligonucleotide
gacatgaggagaaggggtaggggtggtcagaccggtga

SEQ ID NO: 4250 - DNA, 34 bp, Artificial Sequence
  Synthetic oligonucleotide
gtcacgcctggcccacacacgattgtaccacctc

SEQ ID NO: 4251 - DNA, 35 bp, Artificial Sequence
  Synthetic oligonucleotide
ttcaccatctgcaacaactggggctgcttgccctc

SEQ ID NO: 4252 - DNA, 35 bp, Artificial Sequence
  Synthetic oligonucleotide
gccacgccgctcctgcaccgagttacgccttacgc

SEQ ID NO: 4253 - DNA, 35 bp, Artificial Sequence
  Synthetic oligonucleotide
gtcgtacacatctgttgcctatgcccatccagacc

SEQ ID NO: 4254 - DNA, 34 bp, Artificial Sequence
  Synthetic oligonucleotide
actgggcgaggagggaaaggtggagggggtcaca

SEQ ID NO: 4255 - DNA, 35 bp, Artificial Sequence
  Synthetic oligonucleotide
tcatcactcccccgcttcatgccattttgactaca

SEQ ID NO: 4256 - DNA, 35 bp, Artificial Sequence
  Synthetic oligonucleotide
actcccattcccggtacctctcacatgtttgctct

SEQ ID NO: 4257 - DNA, 35 bp, Artificial Sequence
  Synthetic oligonucleotide
tcacgcccgcagaccccactgcatctagtatcaac

SEQ ID NO: 4258 - DNA, 35 bp, Artificial Sequence
  Synthetic oligonucleotide
tcctcccccagatctccggcccctgacaggttagc

SEQ ID NO: 4259 - DNA, 35 bp, Artificial Sequence
  Synthetic oligonucleotide
tcccgaaccagccttaaggagcgttccttcctgtc

SEQ ID NO: 4260 - DNA, 35 bp, Artificial Sequence
  Synthetic oligonucleotide
gatcacccgccgcctggactccctccttcgccgta

SEQ ID NO: 4261 - DNA, 35 bp, Artificial Sequence
  Synthetic oligonucleotide
gtgggtggaaagggggatgacatggttaagggcag

SEQ ID NO: 4262 - DNA, 36 bp, Artificial Sequence
  Synthetic oligonucleotide
ttcagagggagggtgggtagggtagtacgggatcaa

SEQ ID NO: 4263 - DNA, 37 bp, Artificial Sequence
  Synthetic oligonucleotide
gatgtaaggggggaggaagggtacgtaggtgagaaga

SEQ ID NO: 4264 - DNA, 35 bp, Artificial Sequence
  Synthetic oligonucleotide
ttatgccgccatcccgtaactggtcgttcctcttt

SEQ ID NO: 4265 - DNA, 36 bp, Artificial Sequence
  Synthetic oligonucleotide
gagcaaggctaaagtggggggggatggaggagggga

SEQ ID NO: 4266 - DNA, 35 bp, Artificial Sequence
  Synthetic oligonucleotide
tccgcccctgcctatggttcggtcatcgccccatt

SEQ ID NO: 4267 - DNA, 38 bp, Artificial Sequence
  Synthetic oligonucleotide
tgtcggaccaggggggaacggggacggttggggggtga

SEQ ID NO: 4268 - DNA, 38 bp, Artificial Sequence
  Synthetic oligonucleotide
atgaccagccctaccatgcctcagtcgtaccatcctga

SEQ ID NO: 4269 - DNA, 35 bp, Artificial Sequence
  Synthetic oligonucleotide
gatggcctggtgggccctcttatttccctctatgt

SEQ ID NO: 4270 - DNA, 35 bp, Artificial Sequence
  Synthetic oligonucleotide
tcccccatacagccccctggtgcatgtactgtacc

SEQ ID NO: 4271 - DNA, 35 bp, Artificial Sequence
  Synthetic oligonucleotide
gcgcaccatgccaaccctagccactaccaccgtgc

SEQ ID NO: 4272 - DNA, 36 bp, Artificial Sequence
  Synthetic oligonucleotide
gcaaccgccgcaagcgttacgccatcccccatcgca

SEQ ID NO: 4273 - DNA, 37 bp, Artificial Sequence
  Synthetic oligonucleotide
gccaatccgaccctcaccctcccgagtgtaacgagga

SEQ ID NO: 4274 - DNA, 35 bp, Artificial Sequence
  Synthetic oligonucleotide
acccacctcaccctagcctattacggacggaccga

SEQ ID NO: 4275 - DNA, 35 bp, Artificial Sequence
  Synthetic oligonucleotide
tgtacaccctccaaccataaagcctctcgttctcg

SEQ ID NO: 4276 - DNA, 35 bp, Artificial Sequence
  Synthetic oligonucleotide
gccaacggcatttggtgacttctctctttctctcc

SEQ ID NO: 4277 - DNA, 36 bp, Artificial Sequence
  Synthetic oligonucleotide
gcgaaagagggggaaggaataggatgggcgatgtga

SEQ ID NO: 4278 - DNA, 35 bp, Artificial Sequence
  Synthetic oligonucleotide
cacacgcccgctcactttgtctttaccatcagttt

SEQ ID NO: 4279 - DNA, 36 bp, Artificial Sequence
  Synthetic oligonucleotide
tcacatgcactgagctttattggttccttcttgtca

SEQ ID NO: 4280 - DNA, 35 bp, Artificial Sequence
  Synthetic oligonucleotide
gctgtttgctcggcgccaccatcttgcctatcgct

SEQ ID NO: 4281 - DNA, 35 bp, Artificial Sequence
  Synthetic oligonucleotide
gcacccaccgcggtgaacttaacccgatttctttc

SEQ ID NO: 4282 - DNA, 35 bp, Artificial Sequence
  Synthetic oligonucleotide
actggggggggaacgtgtggaggcgggtggtgtag

SEQ ID NO: 4283 - DNA, 35 bp, Artificial Sequence
  Synthetic oligonucleotide
gaccatcatccgtccctccatcgttcatatgccat

SEQ ID NO: 4284 - DNA, 37 bp, Artificial Sequence
  Synthetic oligonucleotide
gccaggggggagggacgcttttggggctattcgggga

SEQ ID NO: 4285 - DNA, 35 bp, Artificial Sequence
  Synthetic oligonucleotide
gccacccttcattctgaccatctggctttattcac

SEQ ID NO: 4286 - DNA, 35 bp, Artificial Sequence
  Synthetic oligonucleotide
tacacccgcccgagaggacgatcaatcataccatc

SEQ ID NO: 4287 - DNA, 36 bp, Artificial Sequence
  Synthetic oligonucleotide
acctcgcccggactccgtatgttttcgcacccccga

SEQ ID NO: 4288 - DNA, 35 bp, Artificial Sequence
  Synthetic oligonucleotide
tagcacaacctacaaggatcccaccctgcctctgc

SEQ ID NO: 4289 - DNA, 35 bp, Artificial Sequence
  Synthetic oligonucleotide
gcattaagcacgctctttctgctatgccactacct

SEQ ID NO: 4290 - DNA, 35 bp, Artificial Sequence
  Synthetic oligonucleotide
tcacaccccccctcctgtcaatgaatgatcatgcg

SEQ ID NO: 4291 - DNA, 35 bp, Artificial Sequence
  Synthetic oligonucleotide
acaccgcaccattggctactcaacagcacgacctc

SEQ ID NO: 4292 - DNA, 36 bp, Artificial Sequence
  Synthetic oligonucleotide
tgatcactcacagaagctgcccaccccagtgcgtta

SEQ ID NO: 4293 - DNA, 35 bp, Artificial Sequence
  Synthetic oligonucleotide
tcaccttactccgcctgactcgcatgggactacca

SEQ ID NO: 4294 - DNA, 35 bp, Artificial Sequence
  Synthetic oligonucleotide
tcatcgcccccgtgattcatcctttgtgcatttct

SEQ ID NO: 4295 - DNA, 35 bp, Artificial Sequence
  Synthetic oligonucleotide
tccatctccgaagcctatacatgtcttctgcttac

SEQ ID NO: 4296 - DNA, 36 bp, Artificial Sequence
  Synthetic oligonucleotide
tcatccgttccccatcgttctatgaccttccctaca

SEQ ID NO: 4297 - DNA, 35 bp, Artificial Sequence
  Synthetic oligonucleotide
tgcaccacctatgtcgaatctttaccccaccacgg

SEQ ID NO: 4298 - DNA, 35 bp, Artificial Sequence
  Synthetic oligonucleotide
accgaacgccacccatcatatacaccgtccatggc

SEQ ID NO: 4299 - DNA, 36 bp, Artificial Sequence
  Synthetic oligonucleotide
gttgcactcaccatccgcggcccacaccctgcgaaa

SEQ ID NO: 4300 - DNA, 35 bp, Artificial Sequence
  Synthetic oligonucleotide
gatgggtgggtgggctataggctagacgctctggg

SEQ ID NO: 4301 - DNA, 36 bp, Artificial Sequence
  Synthetic oligonucleotide
tccctgcgcaaacgctattagccccccttcaccgga

SEQ ID NO: 4302 - DNA, 35 bp, Artificial Sequence
  Synthetic oligonucleotide
gcaccgtgcacaccgtatcaacactctcttgtcta

SEQ ID NO: 4303 - DNA, 35 bp, Artificial Sequence
  Synthetic oligonucleotide
tcaaccgcaaacgtgacttagccgctttgtttccc

SEQ ID NO: 4304 - DNA, 35 bp, Artificial Sequence
  Synthetic oligonucleotide
attgccccttccagcccctaggtacgagctaatac

SEQ ID NO: 4305 - DNA, 35 bp, Artificial Sequence
  Synthetic oligonucleotide
tattgccaacgccccgtacccctcaccgcgtacct

SEQ ID NO: 4306 - DNA, 35 bp, Artificial Sequence
  Synthetic oligonucleotide
attccactccgaccagcccttctttgggtccctcg

SEQ ID NO: 4307 - DNA, 37 bp, Artificial Sequence
  Synthetic oligonucleotide
gccccgctgtcccgtcccgcgtctaagccactctcga

SEQ ID NO: 4308 - DNA, 35 bp, Artificial Sequence
  Synthetic oligonucleotide
gatgctgactcccgcgccgtcgatacaccgccccg

SEQ ID NO: 4309 - DNA, 35 bp, Artificial Sequence
  Synthetic oligonucleotide
tagtaccccactgcctgcgagccgaccatcatttt

SEQ ID NO: 4310 - DNA, 35 bp, Artificial Sequence
  Synthetic oligonucleotide
acaccctgccctgctctccactatgttgtaacctt

SEQ ID NO: 4311 - DNA, 35 bp, Artificial Sequence
  Synthetic oligonucleotide
acgacgagccacatctcaaagttatctgtcttcgc

SEQ ID NO: 4312 - DNA, 35 bp, Artificial Sequence
  Synthetic oligonucleotide
ttcatggccccttcagctacgttcccctgtttcct

SEQ ID NO: 4313 - DNA, 38 bp, Artificial Sequence
  Synthetic oligonucleotide
gtgcccgttcagcctggatcccgcgcgcacaccactga

SEQ ID NO: 4314 - DNA, 35 bp, Artificial Sequence
  Synthetic oligonucleotide
tccgccccaggctttctatcatcattgtttgctcc

SEQ ID NO: 4315 - DNA, 35 bp, Artificial Sequence
  Synthetic oligonucleotide
tcccacgagccttgacaccgatacgccttctacgc

SEQ ID NO: 4316 - DNA, 35 bp, Artificial Sequence
  Synthetic oligonucleotide
gactagccccagccccacgttgacgttcgaccgtt

SEQ ID NO: 4317 - DNA, 35 bp, Artificial Sequence
  Synthetic oligonucleotide
cccaacccaaaaaaactttattgtcccagacctgc

SEQ ID NO: 4318 - DNA, 35 bp, Artificial Sequence
  Synthetic oligonucleotide
tgccatcccctggtctccctgctaatgtctgcctg

SEQ ID NO: 4319 - DNA, 35 bp, Artificial Sequence
  Synthetic oligonucleotide
acccgcaccaccccgattctccatcctttagtgtg

SEQ ID NO: 4320 - DNA, 35 bp, Artificial Sequence
  Synthetic oligonucleotide
atggagggaagggacggaactaaggcaagggaagg

SEQ ID NO: 4321 - DNA, 35 bp, Artificial Sequence
  Synthetic oligonucleotide
gactgagcgcctgctctgttgccaggttccctttt

SEQ ID NO: 4322 - DNA, 35 bp, Artificial Sequence
  Synthetic oligonucleotide
gcatgccatctgcccgttcacgactcatgcacctc

SEQ ID NO: 4323 - DNA, 36 bp, Artificial Sequence
  Synthetic oligonucleotide
gtgccatgctcagacagtccgctacctgcccttcct

SEQ ID NO: 4324 - DNA, 35 bp, Artificial Sequence
  Synthetic oligonucleotide
tgagccccccgctccgactatccgctttgttgaat

SEQ ID NO: 4325 - DNA, 36 bp, Artificial Sequence
  Synthetic oligonucleotide
tcactcacattgataaccacccctcgtagctccgca

SEQ ID NO: 4326 - DNA, 35 bp, Artificial Sequence
  Synthetic oligonucleotide
tgcacgtgccaatcccgccgcgcttgcccccttga

SEQ ID NO: 4327 - DNA, 37 bp, Artificial Sequence
  Synthetic oligonucleotide
tccacccgtaccatcgttctcttgctgctccggagga

SEQ ID NO: 4328 - DNA, 35 bp, Artificial Sequence
  Synthetic oligonucleotide
ttccgaacgcctcctgggattcaagccctacactt

SEQ ID NO: 4329 - DNA, 38 bp, Artificial Sequence
  Synthetic oligonucleotide
tcatcccggcgccattacacccattcagctctctgtga

SEQ ID NO: 4330 - DNA, 35 bp, Artificial Sequence
  Synthetic oligonucleotide
tcagccatccataactgatatgctgtctctcgttt

SEQ ID NO: 4331 - DNA, 37 bp, Artificial Sequence
  Synthetic oligonucleotide
accctttgccccaacgtattactgcctctcctcgcga

SEQ ID NO: 4332 - DNA, 35 bp, Artificial Sequence
  Synthetic oligonucleotide
gatcctgctccccaattggaatgacccgcgcaccc

SEQ ID NO: 4333 - DNA, 35 bp, Artificial Sequence
  Synthetic oligonucleotide
tacacatagccgacccccctgctgtcttcttagtc

SEQ ID NO: 4334 - DNA, 35 bp, Artificial Sequence
  Synthetic oligonucleotide
tgatcccgcaaaccgctgtcaagccaccgcatccc

SEQ ID NO: 4335 - DNA, 36 bp, Artificial Sequence
  Synthetic oligonucleotide
atccctgtccgcctacttcacgaactgttttgccta

SEQ ID NO: 4336 - DNA, 37 bp, Artificial Sequence
  Synthetic oligonucleotide
gtcacccctgcccgttatgcactctcagtcttaatga

SEQ ID NO: 4337 - DNA, 36 bp, Artificial Sequence
  Synthetic oligonucleotide
aagactcaccactctccaatccaccccgtgcacgta

SEQ ID NO: 4338 - DNA, 36 bp, Artificial Sequence
  Synthetic oligonucleotide
tcccattcgcccatctcgatatcaccaggttataca

SEQ ID NO: 4339 - DNA, 35 bp, Artificial Sequence
  Synthetic oligonucleotide
accgcccacgtacgaacgcgaacacatccgaccat

SEQ ID NO: 4340 - DNA, 36 bp, Artificial Sequence
  Synthetic oligonucleotide
gtcgatgcccgacgatctctgctccacctcactaga

SEQ ID NO: 4341 - DNA, 37 bp, Artificial Sequence
  Synthetic oligonucleotide
gctcgccgccaaccatgactttttaactgccactcga

SEQ ID NO: 4342 - DNA, 38 bp, Artificial Sequence
  Synthetic oligonucleotide
acgcacccactggttactacactctctcacccccgtga

SEQ ID NO: 4343 - DNA, 36 bp, Artificial Sequence
  Synthetic oligonucleotide
accacccgcccaccagcttgtttcacaactccataa

SEQ ID NO: 4344 - DNA, 35 bp, Artificial Sequence
  Synthetic oligonucleotide
ttcgccccatccatatgttaccggctgtatatcac

SEQ ID NO: 4345 - DNA, 35 bp, Artificial Sequence
  Synthetic oligonucleotide
atcaccacctgcacccactggctcgtacttcggta

SEQ ID NO: 4346 - DNA, 35 bp, Artificial Sequence
  Synthetic oligonucleotide
ttgtcacccgcagccgacctcgcgatcacactggg

SEQ ID NO: 4347 - DNA, 35 bp, Artificial Sequence
  Synthetic oligonucleotide
gtgtgctccaattgttttcctgatcctgtttacct

SEQ ID NO: 4348 - DNA, 37 bp, Artificial Sequence
  Synthetic oligonucleotide
gaccagacgcatttgccaacccccatccctttcagga

SEQ ID NO: 4349 - DNA, 35 bp, Artificial Sequence
  Synthetic oligonucleotide
gtccacattccttgacattgtctctaccttagtac

SEQ ID NO: 4350 - DNA, 35 bp, Artificial Sequence
  Synthetic oligonucleotide
gtacgactcgacggttctcgaattctgtttgcctc

SEQ ID NO: 4351 - DNA, 35 bp, Artificial Sequence
  Synthetic oligonucleotide
gtcaccaaccgcaagcccgttccatgccatcccgt

SEQ ID NO: 4352 - DNA, 35 bp, Artificial Sequence
  Synthetic oligonucleotide
gtccgaccccgcactgcccacgttctgctacccaa

SEQ ID NO: 4353 - DNA, 38 bp, Artificial Sequence
  Synthetic oligonucleotide
gatccgtcacggcctctgcactttctccaccacagtga

SEQ ID NO: 4354 - DNA, 35 bp, Artificial Sequence
  Synthetic oligonucleotide
atgccacggctacaccggatctcacgccctttcca

SEQ ID NO: 4355 - DNA, 35 bp, Artificial Sequence
  Synthetic oligonucleotide
accacccatgtcgagcgggtcgccccctcccctgc

SEQ ID NO: 4356 - DNA, 35 bp, Artificial Sequence
  Synthetic oligonucleotide
gcatacaccgcaaatggtttgccctttctttggcc

SEQ ID NO: 4357 - DNA, 35 bp, Artificial Sequence
  Synthetic oligonucleotide
gtacgcgctgcctggactttagcttttatcaccac

SEQ ID NO: 4358 - DNA, 35 bp, Artificial Sequence
  Synthetic oligonucleotide
cactatgtccgaagggcgtaccatgctccatacaa

SEQ ID NO: 4359 - DNA, 37 bp, Artificial Sequence
  Synthetic oligonucleotide
gtatgcgcccgctttttacgaacctctctcttcatga

SEQ ID NO: 4360 - DNA, 35 bp, Artificial Sequence
  Synthetic oligonucleotide
tacaactcccgcctcccctggcgctagccacatgt

SEQ ID NO: 4361 - DNA, 35 bp, Artificial Sequence
  Synthetic oligonucleotide
gcccacacatcgttccgtcggtaacacaccctgcc

SEQ ID NO: 4362 - DNA, 35 bp, Artificial Sequence
  Synthetic oligonucleotide
taagcccacctcggttcgcccgtttcccagtttct

SEQ ID NO: 4363 - DNA, 35 bp, Artificial Sequence
  Synthetic oligonucleotide
gacactccgttcagatctctacctcctcattgttt

SEQ ID NO: 4364 - DNA, 37 bp, Artificial Sequence
  Synthetic oligonucleotide
gacgagccggtctccatcctgtacttttctcccttga

SEQ ID NO: 4365 - DNA, 35 bp, Artificial Sequence
  Synthetic oligonucleotide
acactcaccgaccgaattttaaccccctgccttca

SEQ ID NO: 4366 - DNA, 35 bp, Artificial Sequence
  Synthetic oligonucleotide
gcccactcgccccgtacgccctaactcgttgtgaa

SEQ ID NO: 4367 - DNA, 35 bp, Artificial Sequence
  Synthetic oligonucleotide
tacccaccgttacctatcgcgccatgccacttttc

SEQ ID NO: 4368 - DNA, 35 bp, Artificial Sequence
  Synthetic oligonucleotide
gaccatccgttgccctcgtttaatcctggaatctc

SEQ ID NO: 4369 - DNA, 35 bp, Artificial Sequence
  Synthetic oligonucleotide
aactgaacccgcgcctacatctgctctggcctgcc

SEQ ID NO: 4370 - DNA, 37 bp, Artificial Sequence
  Synthetic oligonucleotide
accaccctccgacatgcgcattactaatcactcttga

SEQ ID NO: 4371 - DNA, 35 bp, Artificial Sequence
  Synthetic oligonucleotide
agtgcacccctcatcggtcggtcccatctatcggt

SEQ ID NO: 4372 - DNA, 36 bp, Artificial Sequence
  Synthetic oligonucleotide
gatcgccctgttcgccgcatacccatcctttcggta

SEQ ID NO: 4373 - DNA, 35 bp, Artificial Sequence
  Synthetic oligonucleotide
taacaggccgcccctcctgatcatcgtcacgctcc

SEQ ID NO: 4374 - DNA, 35 bp, Artificial Sequence
  Synthetic oligonucleotide
gcactccacactgtactgtgccccctgttgatcta

SEQ ID NO: 4375 - DNA, 36 bp, Artificial Sequence
  Synthetic oligonucleotide
agcacctccccatgatgctaccacttcctcactgta

SEQ ID NO: 4376 - DNA, 35 bp, Artificial Sequence
  Synthetic oligonucleotide
gaacgtcgtcacctggactatccctgcaccttaca

SEQ ID NO: 4377 - DNA, 35 bp, Artificial Sequence
  Synthetic oligonucleotide
agatgcgccgctcgggcccagtttgcatgtccacc

SEQ ID NO: 4378 - DNA, 35 bp, Artificial Sequence
  Synthetic oligonucleotide
gagtgcgcattgcctgcaccttctcccacttctca

SEQ ID NO: 4379 - DNA, 36 bp, Artificial Sequence
  Synthetic oligonucleotide
taacactgagttacttgtgcacctgctccatttcta

SEQ ID NO: 4380 - DNA, 34 bp, Artificial Sequence
  Synthetic oligonucleotide
tcctcgcccccgcctgctgttttgtttggcccga

SEQ ID NO: 4381 - DNA, 35 bp, Artificial Sequence
  Synthetic oligonucleotide
tgaacaccgcatcagcgactctaggcctccattcc

SEQ ID NO: 4382 - DNA, 35 bp, Artificial Sequence
  Synthetic oligonucleotide
acaccatccgaccgcttttgtttcgatttcctatt

SEQ ID NO: 4383 - DNA, 35 bp, Artificial Sequence
  Synthetic oligonucleotide
aaccaccccattcccactgtatttgtacgctacgc

SEQ ID NO: 4384 - DNA, 35 bp, Artificial Sequence
  Synthetic oligonucleotide
gccgtgcactgcccctgtccctccgcatcctcagt

SEQ ID NO: 4385 - DNA, 35 bp, Artificial Sequence
  Synthetic oligonucleotide
gccgccccacacttgcgactggttttccaatctct

SEQ ID NO: 4386 - DNA, 35 bp, Artificial Sequence
  Synthetic oligonucleotide
attgccgtgcagatcactctgtcgctccgttttca

SEQ ID NO: 4387 - DNA, 37 bp, Artificial Sequence
  Synthetic oligonucleotide
tacatcacgcgctacttctcctgccctgccgcctgga

SEQ ID NO: 4388 - DNA, 35 bp, Artificial Sequence
  Synthetic oligonucleotide
atcccatcactgccacactcgtgtcatcgataata

SEQ ID NO: 4389 - DNA, 36 bp, Artificial Sequence
  Synthetic oligonucleotide
aattcaccctccatgcttaacgtcgccgcattctta

SEQ ID NO: 4390 - DNA, 38 bp, Artificial Sequence
  Synthetic oligonucleotide
gcccaacgccttaaatctgattcgccccagccccgtga

SEQ ID NO: 4391 - DNA, 36 bp, Artificial Sequence
  Synthetic oligonucleotide
tccgaccggcgccatgtcgctcatcatcctctccaa

SEQ ID NO: 4392 - DNA, 35 bp, Artificial Sequence
  Synthetic oligonucleotide
tccgcactctccgcattctcacgcacgaccggaca

SEQ ID NO: 4393 - DNA, 38 bp, Artificial Sequence
  Synthetic oligonucleotide
acgattccaggcgtcattgaacaccacctgcctcctga

SEQ ID NO: 4394 - DNA, 35 bp, Artificial Sequence
  Synthetic oligonucleotide
gccacatcgatgattttcccccgcacaccttccgc

SEQ ID NO: 4395 - DNA, 36 bp, Artificial Sequence
  Synthetic oligonucleotide
gagacacccatcaatgccgatcgcgaactcttccca

SEQ ID NO: 4396 - DNA, 35 bp, Artificial Sequence
  Synthetic oligonucleotide
gacacgactgcctctttttagctcgtttcctacgc

SEQ ID NO: 4397 - DNA, 35 bp, Artificial Sequence
  Synthetic oligonucleotide
tgttccaccccatttgactgcaacgatgcagcccc

SEQ ID NO: 4398 - DNA, 35 bp, Artificial Sequence
  Synthetic oligonucleotide
tactgacccaagtgtggcaccccgaccttctaaca

SEQ ID NO: 4399 - DNA, 35 bp, Artificial Sequence
  Synthetic oligonucleotide
gcctgaccagcagtctacttcacctcttcatgcgc

SEQ ID NO: 4400 - DNA, 37 bp, Artificial Sequence
  Synthetic oligonucleotide
atcgccacaattcccctacgtgacttcctgccattga

SEQ ID NO: 4401 - DNA, 37 bp, Artificial Sequence
  Synthetic oligonucleotide
gggggtggtgggtgggtgtggagggaggagaatgaga

SEQ ID NO: 4402 - DNA, 38 bp, Artificial Sequence
  Synthetic oligonucleotide
acacaccacacgcccagatcgccctggcccactcctga

SEQ ID NO: 4403 - DNA, 38 bp, Artificial Sequence
  Synthetic oligonucleotide
gacactccacctgatgccttgaccaacacgaccattga

SEQ ID NO: 4404 - DNA, 35 bp, Artificial Sequence
  Synthetic oligonucleotide
gcctacgtccgcccctcgacgtcccccacaccctg

SEQ ID NO: 4405 - DNA, 35 bp, Artificial Sequence
  Synthetic oligonucleotide
tcaacgtctccctatctgcacccccctgtcccagg

SEQ ID NO: 4406 - DNA, 35 bp, Artificial Sequence
  Synthetic oligonucleotide
gttacgcccacctattccgttttaagcactagcgc

SEQ ID NO: 4407 - DNA, 37 bp, Artificial Sequence
  Synthetic oligonucleotide
gacctccaccggcagtcctccttccatcccttcgcga

SEQ ID NO: 4408 - DNA, 35 bp, Artificial Sequence
  Synthetic oligonucleotide
atgcaccctgtgacgtttccgctacaccaattccg

SEQ ID NO: 4409 - DNA, 35 bp, Artificial Sequence
  Synthetic oligonucleotide
ccaaccgccacacatgcacccctcacactcggtct

SEQ ID NO: 4410 - DNA, 35 bp, Artificial Sequence
  Synthetic oligonucleotide
tgcaaccacggttccatgtactctccaccgctcta

SEQ ID NO: 4411 - DNA, 35 bp, Artificial Sequence
  Synthetic oligonucleotide
ttgcggtctggtcccgcgcgcattatacatctcca

SEQ ID NO: 4412 - DNA, 35 bp, Artificial Sequence
  Synthetic oligonucleotide
gaccgccccactgcctgtacaacgacgtagttgct

SEQ ID NO: 4413 - DNA, 35 bp, Artificial Sequence
  Synthetic oligonucleotide
accatgacgacacatactcttcgccccccgtgtct

SEQ ID NO: 4414 - DNA, 36 bp, Artificial Sequence
  Synthetic oligonucleotide
acactactagccgcacatatgccaggctctccctca

SEQ ID NO: 4415 - DNA, 36 bp, Artificial Sequence
  Synthetic oligonucleotide
ttcgcccaccgcacgatcttgtctctttgctcgtaa

SEQ ID NO: 4416 - DNA, 35 bp, Artificial Sequence
  Synthetic oligonucleotide
acgctggtgcatctcattttccaccgcctccctgc

SEQ ID NO: 4417 - DNA, 35 bp, Artificial Sequence
  Synthetic oligonucleotide
acccgctgaccgtcccatttggttcctttcactct

SEQ ID NO: 4418 - DNA, 35 bp, Artificial Sequence
  Synthetic oligonucleotide
tagtaccggcctggacgcccaacatacccctagtt

SEQ ID NO: 4419 - DNA, 35 bp, Artificial Sequence
  Synthetic oligonucleotide
gaaccgctgtgcgaatcacaatcactggcctctct

SEQ ID NO: 4420 - DNA, 36 bp, Artificial Sequence
  Synthetic oligonucleotide
atccgcccaatgtcaccctgtcctccttgtcagaca

SEQ ID NO: 4421 - DNA, 35 bp, Artificial Sequence
  Synthetic oligonucleotide
gtacacctacgttacattatcacgccgcccgggcc

SEQ ID NO: 4422 - DNA, 35 bp, Artificial Sequence
  Synthetic oligonucleotide
tgccactcccaatcgctgtcgtttcgtttcttcgc

SEQ ID NO: 4423 - DNA, 35 bp, Artificial Sequence
  Synthetic oligonucleotide
tccacaccttgcatcctggccgccttttggcttct

SEQ ID NO: 4424 - DNA, 36 bp, Artificial Sequence
  Synthetic oligonucleotide
taccaccctcggccgtgcctggtctcctccagttaa

SEQ ID NO: 4425 - DNA, 35 bp, Artificial Sequence
  Synthetic oligonucleotide
gcccatcacccgccacataacgtccggcccttggc

SEQ ID NO: 4426 - DNA, 35 bp, Artificial Sequence
  Synthetic oligonucleotide
tcatcataccgagtgccgaactgacattgcaccat

SEQ ID NO: 4427 - DNA, 38 bp, Artificial Sequence
  Synthetic oligonucleotide
accacatcaccatgctgatatacctctctattacctga

SEQ ID NO: 4428 - DNA, 35 bp, Artificial Sequence
  Synthetic oligonucleotide
tgggacgtgcccggccgttttgtctctctgtttcc

SEQ ID NO: 4429 - DNA, 35 bp, Artificial Sequence
  Synthetic oligonucleotide
tgcacgccacccctccccactacgaatgccgcact

SEQ ID NO: 4430 - DNA, 35 bp, Artificial Sequence
  Synthetic oligonucleotide
tcagtggagcctccgcctcgatcccgttctttgcc

SEQ ID NO: 4431 - DNA, 35 bp, Artificial Sequence
  Synthetic oligonucleotide
actcatcctctgttcggtcaaaccgtcctcgccgc

SEQ ID NO: 4432 - DNA, 37 bp, Artificial Sequence
  Synthetic oligonucleotide
taccaccgcctgttgacctatcttctcggactaacga

SEQ ID NO: 4433 - DNA, 35 bp, Artificial Sequence
  Synthetic oligonucleotide
ttccacccaccaggagttgccccatccgcttcggt

SEQ ID NO: 4434 - DNA, 38 bp, Artificial Sequence
  Synthetic oligonucleotide
gagagagagagaaggtgggtatgtaggtgggtggatga

SEQ ID NO: 4435 - DNA, 35 bp, Artificial Sequence
  Synthetic oligonucleotide
gcagacgctattgtcctagttccccccgtatcttg

SEQ ID NO: 4436 - DNA, 35 bp, Artificial Sequence
  Synthetic oligonucleotide
ttcccaccgcagttttatcttcaacgcttcctcaa

SEQ ID NO: 4437 - DNA, 35 bp, Artificial Sequence
  Synthetic oligonucleotide
tacgcatccaccctattatgtcgagcggtccatcc

SEQ ID NO: 4438 - DNA, 35 bp, Artificial Sequence
  Synthetic oligonucleotide
gatgtcgccgcccaccttgcgttcctaacaacttg

SEQ ID NO: 4439 - DNA, 35 bp, Artificial Sequence
  Synthetic oligonucleotide
tacgcccggtacccctcgtcctatacagctgctgc

SEQ ID NO: 4440 - DNA, 36 bp, Artificial Sequence
  Synthetic oligonucleotide
ttgggagggcacaggttccaggcgggagggggttca

SEQ ID NO: 4441 - DNA, 37 bp, Artificial Sequence
  Synthetic oligonucleotide
atccacgtcgacccactacccatcgtcctgtccacga

SEQ ID NO: 4442 - DNA, 34 bp, Artificial Sequence
  Synthetic oligonucleotide
tgaccccccggggatgctacacacactttcatgc

SEQ ID NO: 4443 - DNA, 37 bp, Artificial Sequence
  Synthetic oligonucleotide
gccaccctcacctcttcagcctgggtcacctaggtga

SEQ ID NO: 4444 - DNA, 36 bp, Artificial Sequence
  Synthetic oligonucleotide
gcatgtacgccctctgatccccggctctcttgaaca

SEQ ID NO: 4445 - DNA, 35 bp, Artificial Sequence
  Synthetic oligonucleotide
ttcattcccacgtacacctttggccactcgacctc

SEQ ID NO: 4446 - DNA, 35 bp, Artificial Sequence
  Synthetic oligonucleotide
tccgacgtcacgaaacctaatgccgccccatcgcc

SEQ ID NO: 4447 - DNA, 37 bp, Artificial Sequence
  Synthetic oligonucleotide
tgatgctccaaacatgttatgtttctgttccacccga

SEQ ID NO: 4448 - DNA, 35 bp, Artificial Sequence
  Synthetic oligonucleotide
atccccgctccaccacacctccattgcttggagcc

SEQ ID NO: 4449 - DNA, 36 bp, Artificial Sequence
  Synthetic oligonucleotide
ttgtcctaccgcattgtagtccgtcctgccctggca

SEQ ID NO: 4450 - DNA, 36 bp, Artificial Sequence
  Synthetic oligonucleotide
acatcccacgcaatttcctgctaaggacctgtacta

SEQ ID NO: 4451 - DNA, 35 bp, Artificial Sequence
  Synthetic oligonucleotide
acatgacgccctgacccatagtctatgaaacctca

SEQ ID NO: 4452 - DNA, 38 bp, Artificial Sequence
  Synthetic oligonucleotide
tcacgtcgctccaccatcccctgaactgtaccctgtga

SEQ ID NO: 4453 - DNA, 37 bp, Artificial Sequence
  Synthetic oligonucleotide
tacattgggggggcaaggaaggcaagttcccgtggga

SEQ ID NO: 4454 - DNA, 35 bp, Artificial Sequence
  Synthetic oligonucleotide
ttcccaccctgttgctgtactgtctcgcctgaaca

SEQ ID NO: 4455 - DNA, 35 bp, Artificial Sequence
  Synthetic oligonucleotide
tgcctgtcgccgagaaccgcagctccctactcccc

SEQ ID NO: 4456 - DNA, 35 bp, Artificial Sequence
  Synthetic oligonucleotide
agtctccgcctcactgcattggtagcccccttata

SEQ ID NO: 4457 - DNA, 35 bp, Artificial Sequence
  Synthetic oligonucleotide
tcaacacgctggatggttcgtttttttcgtcctct

SEQ ID NO: 4458 - DNA, 35 bp, Artificial Sequence
  Synthetic oligonucleotide
tccccagtgcactggtaattatacaccctctcgtt

SEQ ID NO: 4459 - DNA, 35 bp, Artificial Sequence
  Synthetic oligonucleotide
tatatgcagcacggccactacattctccgttccac

SEQ ID NO: 4460 - DNA, 36 bp, Artificial Sequence
  Synthetic oligonucleotide
atgcccccgaccagccgttctatccagcttggagca

SEQ ID NO: 4461 - DNA, 36 bp, Artificial Sequence
  Synthetic oligonucleotide
gagtgccgcctgttttgctctgtgccgcccatccaa

SEQ ID NO: 4462 - DNA, 37 bp, Artificial Sequence
  Synthetic oligonucleotide
tatcacgcctcctttgctccccactcgttatcatcga

SEQ ID NO: 4463 - DNA, 35 bp, Artificial Sequence
  Synthetic oligonucleotide
ttagcccgatccatctatctgaccgctgtttgtac

SEQ ID NO: 4464 - DNA, 35 bp, Artificial Sequence
  Synthetic oligonucleotide
acatcgccaatacgatgtttctttcgttcaccatc

SEQ ID NO: 4465 - DNA, 35 bp, Artificial Sequence
  Synthetic oligonucleotide
gcgataccaccacctccgtcgaggcccttacatgt

SEQ ID NO: 4466 - DNA, 35 bp, Artificial Sequence
  Synthetic oligonucleotide
tcatgcccggtccctgctttgctgctgtcccccca

SEQ ID NO: 4467 - DNA, 38 bp, Artificial Sequence
  Synthetic oligonucleotide
taggcggaacagcacgccacacactctcgattttctga

SEQ ID NO: 4468 - DNA, 35 bp, Artificial Sequence
  Synthetic oligonucleotide
agcatctgccccaccgactttgccccaactgtgac

SEQ ID NO: 4469 - DNA, 34 bp, Artificial Sequence
  Synthetic oligonucleotide
gctcacaccctctgttacatcctcctgccttgtc

SEQ ID NO: 4470 - DNA, 35 bp, Artificial Sequence
  Synthetic oligonucleotide
taccccgattgccgtgttgttccacccatgcatgt

SEQ ID NO: 4471 - DNA, 35 bp, Artificial Sequence
  Synthetic oligonucleotide
atctcgccggtcccttatgagtcactccccttccc

SEQ ID NO: 4472 - DNA, 35 bp, Artificial Sequence
  Synthetic oligonucleotide
ggaggggaaggcaagggagggggggcgtagcggaa

SEQ ID NO: 4473 - DNA, 38 bp, Artificial Sequence
  Synthetic oligonucleotide
taccccgttcccatctgcattgtttaccccatacttga

SEQ ID NO: 4474 - DNA, 37 bp, Artificial Sequence
  Synthetic oligonucleotide
tgacagggagggcaaacagggggagggtgggctcgga

SEQ ID NO: 4475 - DNA, 35 bp, Artificial Sequence
  Synthetic oligonucleotide
tcaccccgctggtttatacacgtacgcaaacacac

SEQ ID NO: 4476 - DNA, 35 bp, Artificial Sequence
  Synthetic oligonucleotide
gtgcaccgccggtccgagccatcccacctaactgt

SEQ ID NO: 4477 - DNA, 38 bp, Artificial Sequence
  Synthetic oligonucleotide
tgacctcccccatgcccgcctccggtgcagtaacatta

SEQ ID NO: 4478 - DNA, 35 bp, Artificial Sequence
  Synthetic oligonucleotide
gccatcccttacagatgcaccatccctcgccctgc

SEQ ID NO: 4479 - DNA, 35 bp, Artificial Sequence
  Synthetic oligonucleotide
aacacgctagtgaaccacccccacggatctgcccc

SEQ ID NO: 4480 - DNA, 36 bp, Artificial Sequence
  Synthetic oligonucleotide
gatgcaagcaaccgacttgctccacatcctgttaca

SEQ ID NO: 4481 - DNA, 36 bp, Artificial Sequence
  Synthetic oligonucleotide
tccaatccacagttgcttatcgcctggtgcgcacca

SEQ ID NO: 4482 - DNA, 35 bp, Artificial Sequence
  Synthetic oligonucleotide
gcaccccaccacgttccaccacatacggtcgaaga

SEQ ID NO: 4483 - DNA, 35 bp, Artificial Sequence
  Synthetic oligonucleotide
gagcccccgtccacagcccttaacggtacgctttc

SEQ ID NO: 4484 - DNA, 35 bp, Artificial Sequence
  Synthetic oligonucleotide
gtaccatcctcaggcgattcgcaccactttccttc

SEQ ID NO: 4485 - DNA, 31 bp, Artificial Sequence
  Synthetic oligonucleotide
gccgccgaatctcttagcctagcccccccga

SEQ ID NO: 4486 - DNA, 37 bp, Artificial Sequence
  Synthetic oligonucleotide
attcacccgtacaactgccatgcattttctcctctga

SEQ ID NO: 4487 - DNA, 35 bp, Artificial Sequence
  Synthetic oligonucleotide
gcgttgtcgccgactttcccaccatcatgttctac

SEQ ID NO: 4488 - DNA, 36 bp, Artificial Sequence
  Synthetic oligonucleotide
gcttcacccgctgagccgtgcccctgcctactttaa

SEQ ID NO: 4489 - DNA, 35 bp, Artificial Sequence
  Synthetic oligonucleotide
tccccccgccggtccgctatattctaccagtcccg

SEQ ID NO: 4490 - DNA, 35 bp, Artificial Sequence
  Synthetic oligonucleotide
gaagccccgtatcccgttgacctgcgcacaccatt

SEQ ID NO: 4491 - DNA, 35 bp, Artificial Sequence
  Synthetic oligonucleotide
atacgccccacacccccacagagagcaaacggatt

SEQ ID NO: 4492 - DNA, 37 bp, Artificial Sequence
  Synthetic oligonucleotide
acacccccgcactatatggttacgccgccctgtagga

SEQ ID NO: 4493 - DNA, 38 bp, Artificial Sequence
  Synthetic oligonucleotide
tgatacattggccggggtgtaataaggtgcgggtgtga

SEQ ID NO: 4494 - DNA, 35 bp, Artificial Sequence
  Synthetic oligonucleotide
gcaggtagctgccgtttctatcacctccatacttg

SEQ ID NO: 4495 - DNA, 37 bp, Artificial Sequence
  Synthetic oligonucleotide
agccctccgacgcttagcccaccccctgccttatcga

SEQ ID NO: 4496 - DNA, 37 bp, Artificial Sequence
  Synthetic oligonucleotide
accttacccgaggcggaggccgggggcggtggacgga

SEQ ID NO: 4497 - DNA, 37 bp, Artificial Sequence
  Synthetic oligonucleotide
tcatccaccgccaacgacttataccaactcgctacga

SEQ ID NO: 4498 - DNA, 34 bp, Artificial Sequence
  Synthetic oligonucleotide
tcccacctgcacctagctcgaccacgaccaagta

SEQ ID NO: 4499 - DNA, 35 bp, Artificial Sequence
  Synthetic oligonucleotide
acatccacaagccactgagtttggctatccttgtc

SEQ ID NO: 4500 - DNA, 35 bp, Artificial Sequence
  Synthetic oligonucleotide
acacgccttccatcggttgcttatttttacgttcg

SEQ ID NO: 4501 - DNA, 35 bp, Artificial Sequence
  Synthetic oligonucleotide
gtgaacactgcggcaactatataccgtttcgccta

SEQ ID NO: 4502 - DNA, 38 bp, Artificial Sequence
  Synthetic oligonucleotide
ctacgtccaacacgttatcgactaccctcctccaatga

SEQ ID NO: 4503 - DNA, 36 bp, Artificial Sequence
  Synthetic oligonucleotide
gagccgcccaaccactccatacacgtgcattcctta

SEQ ID NO: 4504 - DNA, 37 bp, Artificial Sequence
  Synthetic oligonucleotide
atcgtagcccaggctcatccccgctgttcacattgga

SEQ ID NO: 4505 - DNA, 35 bp, Artificial Sequence
  Synthetic oligonucleotide
accagccatcggggcccagtacttctccaattgct

SEQ ID NO: 4506 - DNA, 34 bp, Artificial Sequence
  Synthetic oligonucleotide
tgcaaccctgtttgttactgttccccctgccatt

SEQ ID NO: 4507 - DNA, 35 bp, Artificial Sequence
  Synthetic oligonucleotide
acattccatccccagtcccgcccaatgagacaatc

SEQ ID NO: 4508 - DNA, 36 bp, Artificial Sequence
  Synthetic oligonucleotide
tcagttacccgcctgtcccgtttaccacccggtcca

SEQ ID NO: 4509 - DNA, 35 bp, Artificial Sequence
  Synthetic oligonucleotide
atgcacgcagttcgtgctgcacccctttttttgtc

SEQ ID NO: 4510 - DNA, 35 bp, Artificial Sequence
  Synthetic oligonucleotide
tgtatgctccaccctacccattgtgcctgtccgac

SEQ ID NO: 4511 - DNA, 35 bp, Artificial Sequence
  Synthetic oligonucleotide
tgtgaccacatatactacaccgtgcgttgcacgcc

SEQ ID NO: 4512 - DNA, 36 bp, Artificial Sequence
  Synthetic oligonucleotide
tcactcgtgccatcctgcattatgtctgttgcccga

SEQ ID NO: 4513 - DNA, 35 bp, Artificial Sequence
  Synthetic oligonucleotide
tgcaaaccctgctccccacgcccataacttacgac

SEQ ID NO: 4514 - DNA, 35 bp, Artificial Sequence
  Synthetic oligonucleotide
acctgtcccgttgacgcttacaacccccgtagccc

SEQ ID NO: 4515 - DNA, 35 bp, Artificial Sequence
  Synthetic oligonucleotide
atagtacgcccatccatcctggtttcgatcaccct

SEQ ID NO: 4516 - DNA, 37 bp, Artificial Sequence
  Synthetic oligonucleotide
tgctccaccgccggatcctattgtcacacccactcga

SEQ ID NO: 4517 - DNA, 37 bp, Artificial Sequence
  Synthetic oligonucleotide
gttgcccaccctgcactctcagtcgatcgtcttacga

SEQ ID NO: 4518 - DNA, 35 bp, Artificial Sequence
  Synthetic oligonucleotide
aacagtgcaccccgtcccgcaagccccatcattca

SEQ ID NO: 4519 - DNA, 35 bp, Artificial Sequence
  Synthetic oligonucleotide
atccacccctgcctgccaagaaacccggttggttc

SEQ ID NO: 4520 - DNA, 35 bp, Artificial Sequence
  Synthetic oligonucleotide
gccccccttgcgccttccacttatttgtcattgca

SEQ ID NO: 4521 - DNA, 35 bp, Artificial Sequence
  Synthetic oligonucleotide
acctctcccacctgagtaccatctttgacagttgc

SEQ ID NO: 4522 - DNA, 35 bp, Artificial Sequence
  Synthetic oligonucleotide
ggacccccaggccgtttgcaacacgctcactcctc

SEQ ID NO: 4523 - DNA, 35 bp, Artificial Sequence
  Synthetic oligonucleotide
tagacctgagctgctgctgtccacttaccaccatt

SEQ ID NO: 4524 - DNA, 35 bp, Artificial Sequence
  Synthetic oligonucleotide
tccccacccaaccggtcttaataggccccatgaaa

SEQ ID NO: 4525 - DNA, 35 bp, Artificial Sequence
  Synthetic oligonucleotide
accgccccttcagccccgcgcacacgctcccatag

SEQ ID NO: 4526 - DNA, 35 bp, Artificial Sequence
  Synthetic oligonucleotide
gtaccactgtagaactgcaattgccacatcccccg

SEQ ID NO: 4527 - DNA, 37 bp, Artificial Sequence
  Synthetic oligonucleotide
atccccaccgcgatagctcgtactaactctcctttga

SEQ ID NO: 4528 - DNA, 35 bp, Artificial Sequence
  Synthetic oligonucleotide
tctaacctgcccacgacgagctttgcgattgaccg

SEQ ID NO: 4529 - DNA, 35 bp, Artificial Sequence
  Synthetic oligonucleotide
acatgcacccgtccctttgctttttcgcgaccttc

SEQ ID NO: 4530 - DNA, 35 bp, Artificial Sequence
  Synthetic oligonucleotide
tacgcccatctaccgccgcgccacttgcctcccaa

SEQ ID NO: 4531 - DNA, 37 bp, Artificial Sequence
  Synthetic oligonucleotide
ggtgggtgggcaaggaattaaggggagacacgacgga

SEQ ID NO: 4532 - DNA, 35 bp, Artificial Sequence
  Synthetic oligonucleotide
atccaccccgataactagtaccgggggtctcctcc

SEQ ID NO: 4533 - DNA, 35 bp, Artificial Sequence
  Synthetic oligonucleotide
aacccgccttagtccaccgctcagccctcgtacgc

SEQ ID NO: 4534 - DNA, 34 bp, Artificial Sequence
  Synthetic oligonucleotide
aaccgcccactgctgctttctactcgtaccatga

SEQ ID NO: 4535 - DNA, 35 bp, Artificial Sequence
  Synthetic oligonucleotide
tatgcccatcgttttagtccgtccatgccaacagc

SEQ ID NO: 4536 - DNA, 36 bp, Artificial Sequence
  Synthetic oligonucleotide
ggacccacgcctgtcttgtttcaccgctaatgccca

SEQ ID NO: 4537 - DNA, 37 bp, Artificial Sequence
  Synthetic oligonucleotide
tcaccgcgatcctcatgccccccgtatcccttgtcga

SEQ ID NO: 4538 - DNA, 36 bp, Artificial Sequence
  Synthetic oligonucleotide
tccagccatgccttggtctaccctgcggttctcaca

SEQ ID NO: 4539 - DNA, 36 bp, Artificial Sequence
  Synthetic oligonucleotide
tccgccgtcgaccccccaccatagcctactgtttta

SEQ ID NO: 4540 - DNA, 35 bp, Artificial Sequence
  Synthetic oligonucleotide
ttcaccatctgttcatgcaaaatcatggcttcttc

SEQ ID NO: 4541 - DNA, 35 bp, Artificial Sequence
  Synthetic oligonucleotide
tcgccgtacgtccgtttcccctgcgcctctcttca

SEQ ID NO: 4542 - DNA, 35 bp, Artificial Sequence
  Synthetic oligonucleotide
accccgatccccgccgagatactcatttgccaaca

SEQ ID NO: 4543 - DNA, 35 bp, Artificial Sequence
  Synthetic oligonucleotide
tacggaggacgggcggataacacgtaggtgggggt

SEQ ID NO: 4544 - DNA, 35 bp, Artificial Sequence
  Synthetic oligonucleotide
acccccaccacaactacatgtcgacgtacggcgaa

SEQ ID NO: 4545 - DNA, 37 bp, Artificial Sequence
  Synthetic oligonucleotide
gcgtgggaagggctgaagcatgggaacgggtggagga

SEQ ID NO: 4546 - DNA, 35 bp, Artificial Sequence
  Synthetic oligonucleotide
gtaccacctcagtgcgcttagaatttcatctcccc

SEQ ID NO: 4547 - DNA, 36 bp, Artificial Sequence
  Synthetic oligonucleotide
gcaatgggtgagggttagaaggggaatgtgggaaaa

SEQ ID NO: 4548 - DNA, 35 bp, Artificial Sequence
  Synthetic oligonucleotide
acccgccacccatgttccgcaagtactaatttttc

SEQ ID NO: 4549 - DNA, 38 bp, Artificial Sequence
  Synthetic oligonucleotide
gatccgcccctgacacgttctatcctgcctctcactga

SEQ ID NO: 4550 - DNA, 35 bp, Artificial Sequence
  Synthetic oligonucleotide
taactgcacactgcatcgacctgcctaattttttc

SEQ ID NO: 4551 - DNA, 35 bp, Artificial Sequence
  Synthetic oligonucleotide
tgagcgcctgcgtactatcctctttcctcattggt

SEQ ID NO: 4552 - DNA, 36 bp, Artificial Sequence
  Synthetic oligonucleotide
gcgtatgccacggaccgttactccccagctatccaa

SEQ ID NO: 4553 - DNA, 35 bp, Artificial Sequence
  Synthetic oligonucleotide
accccttgcacctcttcagttggcgtccccctccc

SEQ ID NO: 4554 - DNA, 36 bp, Artificial Sequence
  Synthetic oligonucleotide
tcactcagccgttgtactcgatatcgctcctctgca

SEQ ID NO: 4555 - DNA, 35 bp, Artificial Sequence
  Synthetic oligonucleotide
tgatgtcagccgccctgcctgcgccttcaccctcg

SEQ ID NO: 4556 - DNA, 36 bp, Artificial Sequence
  Synthetic oligonucleotide
atcgctcccaccgcattggctatggcctcaacaaca

SEQ ID NO: 4557 - DNA, 37 bp, Artificial Sequence
  Synthetic oligonucleotide
tccaccctcaactgacgacgtcccgagctccccctga

SEQ ID NO: 4558 - DNA, 36 bp, Artificial Sequence
  Synthetic oligonucleotide
gctgtacagccgcctgccttgttccgggtcccttta

SEQ ID NO: 4559 - DNA, 35 bp, Artificial Sequence
  Synthetic oligonucleotide
tctctccactgaatttgccacaccatctcgctgtg

SEQ ID NO: 4560 - DNA, 35 bp, Artificial Sequence
  Synthetic oligonucleotide
gaggtacgggaggaacggtgaaggaagggtgagga

SEQ ID NO: 4561 - DNA, 34 bp, Artificial Sequence
  Synthetic oligonucleotide
cacacaaaggcctcttgctacgtgtttgtttctc

SEQ ID NO: 4562 - DNA, 35 bp, Artificial Sequence
  Synthetic oligonucleotide
gacaggtgaccatgacctatttttcccccacttgg

SEQ ID NO: 4563 - DNA, 35 bp, Artificial Sequence
  Synthetic oligonucleotide
tcccacccaccatttacttgcacgttgagctctac

SEQ ID NO: 4564 - DNA, 36 bp, Artificial Sequence
  Synthetic oligonucleotide
gccccgctcacctcttaacgtcacccatgctaatga

SEQ ID NO: 4565 - DNA, 38 bp, Artificial Sequence
  Synthetic oligonucleotide
gaagcaccctcgtctagcttcgttttgccctttcctga

SEQ ID NO: 4566 - DNA, 35 bp, Artificial Sequence
  Synthetic oligonucleotide
accgccccaccgacgccttatatcatccctagcga

SEQ ID NO: 4567 - DNA, 38 bp, Artificial Sequence
  Synthetic oligonucleotide
acgacactcccaacgctcgacactctccgttcacctga

SEQ ID NO: 4568 - DNA, 35 bp, Artificial Sequence
  Synthetic oligonucleotide
accggggagagttgggaagggtggcgggggggatt

SEQ ID NO: 4569 - DNA, 35 bp, Artificial Sequence
  Synthetic oligonucleotide
tgagacgttaacctatctctgcccgcccatcatgt

SEQ ID NO: 4570 - DNA, 38 bp, Artificial Sequence
  Synthetic oligonucleotide
accacaccgccccctgctgctacaggtacacaaactga

SEQ ID NO: 4571 - DNA, 36 bp, Artificial Sequence
  Synthetic oligonucleotide
gcaccgtacgcacccatatgccagtctcccaaccta

SEQ ID NO: 4572 - DNA, 35 bp, Artificial Sequence
  Synthetic oligonucleotide
tgctcaagcccttctgccgtctaatcgcactcttt

SEQ ID NO: 4573 - DNA, 35 bp, Artificial Sequence
  Synthetic oligonucleotide
acacgtgccgccacacctcccgctattgttacaac

SEQ ID NO: 4574 - DNA, 35 bp, Artificial Sequence
  Synthetic oligonucleotide
accgcccacccctccctccgctttgttacggacat

SEQ ID NO: 4575 - DNA, 36 bp, Artificial Sequence
  Synthetic oligonucleotide
tccatagccctccattgttgtccctcaatttcggga

SEQ ID NO: 4576 - DNA, 35 bp, Artificial Sequence
  Synthetic oligonucleotide
tcatccgcactctggtcctggcactacctacggcc

SEQ ID NO: 4577 - DNA, 35 bp, Artificial Sequence
  Synthetic oligonucleotide
gttgcccaaaatgcgctccctcccctgctatcccg

SEQ ID NO: 4578 - DNA, 35 bp, Artificial Sequence
  Synthetic oligonucleotide
aacccaccgcgcccacctcaccttgacatgcttag

SEQ ID NO: 4579 - DNA, 35 bp, Artificial Sequence
  Synthetic oligonucleotide
aatgcacactcccctccttactatgggacttccac

SEQ ID NO: 4580 - DNA, 35 bp, Artificial Sequence
  Synthetic oligonucleotide
tccaccccctgtacttcagtgtccgctccggaacg

SEQ ID NO: 4581 - DNA, 35 bp, Artificial Sequence
  Synthetic oligonucleotide
tttactacaccgcctgtttcgtctttgcatcaatc

SEQ ID NO: 4582 - DNA, 35 bp, Artificial Sequence
  Synthetic oligonucleotide
tcacaggcgctagattgctcctctcttgtaccctc

SEQ ID NO: 4583 - DNA, 35 bp, Artificial Sequence
  Synthetic oligonucleotide
ttgacactcgacgttagtgcccctctcatcctcca

SEQ ID NO: 4584 - DNA, 35 bp, Artificial Sequence
  Synthetic oligonucleotide
attgaccgccacaagcgcaagacacctatacctcc

SEQ ID NO: 4585 - DNA, 35 bp, Artificial Sequence
  Synthetic oligonucleotide
gtgggaggcttctgccgccgttgccttcgacctac

SEQ ID NO: 4586 - DNA, 35 bp, Artificial Sequence
  Synthetic oligonucleotide
acacccccgtcccccctgcttgactctcgttccta

SEQ ID NO: 4587 - DNA, 35 bp, Artificial Sequence
  Synthetic oligonucleotide
ttagcgcccaccacgaattgtcgcattccggcctc

SEQ ID NO: 4588 - DNA, 35 bp, Artificial Sequence
  Synthetic oligonucleotide
accaccgtcgctctgcctcccaccctccttgtgcg

SEQ ID NO: 4589 - DNA, 37 bp, Artificial Sequence
  Synthetic oligonucleotide
ttgcaccgcataacgccttgttgacctcctccctaga

SEQ ID NO: 4590 - DNA, 36 bp, Artificial Sequence
  Synthetic oligonucleotide
tccgcacccaacccactgtgccttccgtctctatca

SEQ ID NO: 4591 - DNA, 35 bp, Artificial Sequence
  Synthetic oligonucleotide
accggacgtctctccattcttgcgcttcacctgcc

SEQ ID NO: 4592 - DNA, 35 bp, Artificial Sequence
  Synthetic oligonucleotide
tccccctgccctccgtcaaagcacacgcaatattc

SEQ ID NO: 4593 - DNA, 32 bp, Artificial Sequence
  Synthetic oligonucleotide
aactcccacgcccctatgctccgtttaatgaa

SEQ ID NO: 4594 - DNA, 35 bp, Artificial Sequence
  Synthetic oligonucleotide
atgaccgccgccgatgccccaccaaccttatcgta

SEQ ID NO: 4595 - DNA, 35 bp, Artificial Sequence
  Synthetic oligonucleotide
ggatcgatcccattcctataccaactgctgcattc

SEQ ID NO: 4596 - DNA, 37 bp, Artificial Sequence
  Synthetic oligonucleotide
tccaccgcctctgcccctgtcatcagatccaaaacga

SEQ ID NO: 4597 - DNA, 35 bp, Artificial Sequence
  Synthetic oligonucleotide
aacgacaccgatccctgcgtaccttttgctatcta

SEQ ID NO: 4598 - DNA, 36 bp, Artificial Sequence
  Synthetic oligonucleotide
tctgtccgccccactgtcgtgcacctcctactgcca

SEQ ID NO: 4599 - DNA, 35 bp, Artificial Sequence
  Synthetic oligonucleotide
actgcgcctacgtttcgttccagccaattgccttt

SEQ ID NO: 4600 - DNA, 37 bp, Artificial Sequence
  Synthetic oligonucleotide
acccgccacccgttccaatcccgcgtcgagaagacga

SEQ ID NO: 4601 - DNA, 36 bp, Artificial Sequence
  Synthetic oligonucleotide
tgacccctaattccaacgtgcctgtctctacgctca

SEQ ID NO: 4602 - DNA, 36 bp, Artificial Sequence
  Synthetic oligonucleotide
taccatccccgggcctccaggtcagtccccttctga

SEQ ID NO: 4603 - DNA, 37 bp, Artificial Sequence
  Synthetic oligonucleotide
ttgaccctcgcactttgctccacctgacctggcccga

SEQ ID NO: 4604 - DNA, 35 bp, Artificial Sequence
  Synthetic oligonucleotide
gtacccccacgctgatctaccccaactgcccagtc

SEQ ID NO: 4605 - DNA, 35 bp, Artificial Sequence
  Synthetic oligonucleotide
gtcgaacgcgccccgctttattttgaccctatccc

SEQ ID NO: 4606 - DNA, 35 bp, Artificial Sequence
  Synthetic oligonucleotide
ttcaccagcctcccccacatcgtcaacacacccac

SEQ ID NO: 4607 - DNA, 35 bp, Artificial Sequence
  Synthetic oligonucleotide
aacgcccctgcgtggctctatacccattcacctgt

SEQ ID NO: 4608 - DNA, 36 bp, Artificial Sequence
  Synthetic oligonucleotide
tcacctcctgctgatcctcagtgtcccaactgaaca

SEQ ID NO: 4609 - DNA, 35 bp, Artificial Sequence
  Synthetic oligonucleotide
gatcggtgctgcaatcgatcatagtacttcccccg

SEQ ID NO: 4610 - DNA, 35 bp, Artificial Sequence
  Synthetic oligonucleotide
gtgcatgtactgtctccgctttgccctacctggcc

SEQ ID NO: 4611 - DNA, 35 bp, Artificial Sequence
  Synthetic oligonucleotide
atgttgcctcccatcgttgattagcgctctcctct

SEQ ID NO: 4612 - DNA, 35 bp, Artificial Sequence
  Synthetic oligonucleotide
gcacctcctgcgctgcccggtccttccccgtttaa

SEQ ID NO: 4613 - DNA, 35 bp, Artificial Sequence
  Synthetic oligonucleotide
gacaccctcggcgcctgcatccggttaacttctct

SEQ ID NO: 4614 - DNA, 35 bp, Artificial Sequence
  Synthetic oligonucleotide
acctcactgcttccggtcccgactatactcaacct

SEQ ID NO: 4615 - DNA, 35 bp, Artificial Sequence
  Synthetic oligonucleotide
tatgccgcccatacttgccattttgaccccttatg

SEQ ID NO: 4616 - DNA, 37 bp, Artificial Sequence
  Synthetic oligonucleotide
ggaacggggagaagaagcggggcggcggataggggga

SEQ ID NO: 4617 - DNA, 35 bp, Artificial Sequence
  Synthetic oligonucleotide
tttcccagccccccgttcacagctctcggttcgac

SEQ ID NO: 4618 - DNA, 35 bp, Artificial Sequence
  Synthetic oligonucleotide
tctccccgccgtcttacctatcatgcatctccgta

SEQ ID NO: 4619 - DNA, 35 bp, Artificial Sequence
  Synthetic oligonucleotide
acacaccacacgtgcaccgtccgtccctgggcatc

SEQ ID NO: 4620 - DNA, 36 bp, Artificial Sequence
  Synthetic oligonucleotide
gccgataggccggatcgtactctacacctgatcata

SEQ ID NO: 4621 - DNA, 35 bp, Artificial Sequence
  Synthetic oligonucleotide
tatgcctgagccccatctcttcccgcccgctgtcc

SEQ ID NO: 4622 - DNA, 36 bp, Artificial Sequence
  Synthetic oligonucleotide
gtccccctcccattttgttagtcgtctcacgcacta

SEQ ID NO: 4623 - DNA, 35 bp, Artificial Sequence
  Synthetic oligonucleotide
tgcatccatatcaccccgtcctctctctcgtgagt

SEQ ID NO: 4624 - DNA, 38 bp, Artificial Sequence
  Synthetic oligonucleotide
tcactgccgcctcttctcctgtagcctggctttcctga

SEQ ID NO: 4625 - DNA, 35 bp, Artificial Sequence
  Synthetic oligonucleotide
gcactcccgcttgcattgccattggcccacttgac

SEQ ID NO: 4626 - DNA, 35 bp, Artificial Sequence
  Synthetic oligonucleotide
tccacaccccacgggaaacttcgatgttcttaata

SEQ ID NO: 4627 - DNA, 35 bp, Artificial Sequence
  Synthetic oligonucleotide
tagtccctcccccgtttgccaactgaccacgttct

SEQ ID NO: 4628 - DNA, 35 bp, Artificial Sequence
  Synthetic oligonucleotide
ggtccctgccaccggatcgctaaacttgctgcctc

SEQ ID NO: 4629 - DNA, 38 bp, Artificial Sequence
  Synthetic oligonucleotide
gtcacatccaaccttgctaagcctgcccatcttattga

SEQ ID NO: 4630 - DNA, 36 bp, Artificial Sequence
  Synthetic oligonucleotide
tctaccccctgacccactgcacgagagcagtctgta

SEQ ID NO: 4631 - DNA, 35 bp, Artificial Sequence
  Synthetic oligonucleotide
tcaccccctgcgtagggtttctttttccgcactat

SEQ ID NO: 4632 - DNA, 35 bp, Artificial Sequence
  Synthetic oligonucleotide
atccatcctcacacatgtaatcgtctcctcctcgc

SEQ ID NO: 4633 - DNA, 35 bp, Artificial Sequence
  Synthetic oligonucleotide
ttgtgcagggcggagggggaagggggtgccggtca

SEQ ID NO: 4634 - DNA, 35 bp, Artificial Sequence
  Synthetic oligonucleotide
aacgcaccctcggggggcatctcccatctgttttt

SEQ ID NO: 4635 - DNA, 35 bp, Artificial Sequence
  Synthetic oligonucleotide
gagcccggcatccgtatcactgcccctttcatgcc

SEQ ID NO: 4636 - DNA, 35 bp, Artificial Sequence
  Synthetic oligonucleotide
taccaaccgccaccacgtttgcgccaaatcccctt

SEQ ID NO: 4637 - DNA, 35 bp, Artificial Sequence
  Synthetic oligonucleotide
tcagtgagaagggtagcagggcgggaatgggtgtt

SEQ ID NO: 4638 - DNA, 37 bp, Artificial Sequence
  Synthetic oligonucleotide
gtgccgccccccccctgctttgcctgtcactttgcga

SEQ ID NO: 4639 - DNA, 36 bp, Artificial Sequence
  Synthetic oligonucleotide
tccgttcccccccagcccgcctgtccgccgttgcga

SEQ ID NO: 4640 - DNA, 36 bp, Artificial Sequence
  Synthetic oligonucleotide
aacgcaccatccgtggcttatctccgtctcctgtga

SEQ ID NO: 4641 - DNA, 36 bp, Artificial Sequence
  Synthetic oligonucleotide
gtcgccacctccctggtcaattgtacaccgctccca

SEQ ID NO: 4642 - DNA, 35 bp, Artificial Sequence
  Synthetic oligonucleotide
tactcccgcacctgttcatctaagctccgcctcca

SEQ ID NO: 4643 - DNA, 35 bp, Artificial Sequence
  Synthetic oligonucleotide
aaccacacaggttgcatgaaccgactttcctcctc

SEQ ID NO: 4644 - DNA, 35 bp, Artificial Sequence
  Synthetic oligonucleotide
gctcgccaagccgggaccctcgccactacctccat

SEQ ID NO: 4645 - DNA, 35 bp, Artificial Sequence
  Synthetic oligonucleotide
tcagccatccttgtcaatgtctccccactactctt

SEQ ID NO: 4646 - DNA, 37 bp, Artificial Sequence
  Synthetic oligonucleotide
gactgctatgggccgggaagtgggagggtgggtgcga

SEQ ID NO: 4647 - DNA, 35 bp, Artificial Sequence
  Synthetic oligonucleotide
gtccacgcctctccgctttcaactactctcgcagg

SEQ ID NO: 4648 - DNA, 36 bp, Artificial Sequence
  Synthetic oligonucleotide
gaccatgcccaacggtccgcatactgactcgcctca

SEQ ID NO: 4649 - DNA, 35 bp, Artificial Sequence
  Synthetic oligonucleotide
gcatgaccacccggtcgagagcctcccacacactt

SEQ ID NO: 4650 - DNA, 35 bp, Artificial Sequence
  Synthetic oligonucleotide
cctcatctgctagcgagcattgacccttctccaac

SEQ ID NO: 4651 - DNA, 35 bp, Artificial Sequence
  Synthetic oligonucleotide
acacacgtccatcacgtccatactgtcttccccgc

SEQ ID NO: 4652 - DNA, 35 bp, Artificial Sequence
  Synthetic oligonucleotide
gctgtcctccgccctccggtgttgattccacgtat

SEQ ID NO: 4653 - DNA, 35 bp, Artificial Sequence
  Synthetic oligonucleotide
tgaccccctcgatccgcgctactttaacctgtttc

SEQ ID NO: 4654 - DNA, 35 bp, Artificial Sequence
  Synthetic oligonucleotide
gtcgcaccagaagctctggccccacgctttctcat

SEQ ID NO: 4655 - DNA, 35 bp, Artificial Sequence
  Synthetic oligonucleotide
atagaccccgcctaagccccgccgcctttggactc

SEQ ID NO: 4656 - DNA, 35 bp, Artificial Sequence
  Synthetic oligonucleotide
tgcgcctacaacaagttttctgccatcgcctaccg

SEQ ID NO: 4657 - DNA, 37 bp, Artificial Sequence
  Synthetic oligonucleotide
agcgcacccaccgtacctgactctgccaccacaatga

SEQ ID NO: 4658 - DNA, 36 bp, Artificial Sequence
  Synthetic oligonucleotide
aacagtcacagggggtagagggtgggaggggtgtag

SEQ ID NO: 4659 - DNA, 37 bp, Artificial Sequence
  Synthetic oligonucleotide
atcagggggcaagggatcaagggaagggctggggtga

SEQ ID NO: 4660 - DNA, 35 bp, Artificial Sequence
  Synthetic oligonucleotide
gaacacatccgtcgcctgcaccccccgcaactgca

SEQ ID NO: 4661 - DNA, 35 bp, Artificial Sequence
  Synthetic oligonucleotide
gtcgccctggcctctcgtctgcatacgcgctctac

SEQ ID NO: 4662 - DNA, 35 bp, Artificial Sequence
  Synthetic oligonucleotide
gtccccgctgtacgattttaggcctgtttgctctt

SEQ ID NO: 4663 - DNA, 35 bp, Artificial Sequence
  Synthetic oligonucleotide
tcaatcgacggccttgcttttctgccacccaaccg

SEQ ID NO: 4664 - DNA, 36 bp, Artificial Sequence
  Synthetic oligonucleotide
gataccaacgccaccgctcactgcctgccttaatta

SEQ ID NO: 4665 - DNA, 35 bp, Artificial Sequence
  Synthetic oligonucleotide
gttcgcacaccaccctgcttatgaatgggcaaatt

SEQ ID NO: 4666 - DNA, 35 bp, Artificial Sequence
  Synthetic oligonucleotide
gtccacgctacctgactctggccatgaatttctac

SEQ ID NO: 4667 - DNA, 35 bp, Artificial Sequence
  Synthetic oligonucleotide
atgacactcgccccgtagcgacacaccccgtacac

SEQ ID NO: 4668 - DNA, 35 bp, Artificial Sequence
  Synthetic oligonucleotide
tccaacggagcagcataagccctctctcaccgcat

SEQ ID NO: 4669 - DNA, 38 bp, Artificial Sequence
  Synthetic oligonucleotide
tctcacgcctccgtaatcgaagccccacaagtctttga

SEQ ID NO: 4670 - DNA, 36 bp, Artificial Sequence
  Synthetic oligonucleotide
gaggaaagtgaggggtggagtggcgggagattcgta

SEQ ID NO: 4671 - DNA, 35 bp, Artificial Sequence
  Synthetic oligonucleotide
tcctccgcaatatgctcacctgaacctgccccttg

SEQ ID NO: 4672 - DNA, 37 bp, Artificial Sequence
  Synthetic oligonucleotide
tagccactctcaccctttgcctacgagaattccccga

SEQ ID NO: 4673 - DNA, 35 bp, Artificial Sequence
  Synthetic oligonucleotide
tggactgcccatctcttgcagctcctattctatgt

SEQ ID NO: 4674 - DNA, 35 bp, Artificial Sequence
  Synthetic oligonucleotide
attccctccccaatcagacgtatgtctaacgtctc

SEQ ID NO: 4675 - DNA, 36 bp, Artificial Sequence
  Synthetic oligonucleotide
gttgtacccgtcacgtgccttggcctctcactccga

SEQ ID NO: 4676 - DNA, 35 bp, Artificial Sequence
  Synthetic oligonucleotide
gcattatcccccgtctctttacaagcgctgcctgc

SEQ ID NO: 4677 - DNA, 35 bp, Artificial Sequence
  Synthetic oligonucleotide
tcacacttccctttcttcatcgcgacatgcctagc

SEQ ID NO: 4678 - DNA, 33 bp, Artificial Sequence
  Synthetic oligonucleotide
acacaccttcatctggcttgccgtacccttcca

SEQ ID NO: 4679 - DNA, 35 bp, Artificial Sequence
  Synthetic oligonucleotide
gtgcattcgcctcaattatcgtttctctgtctcac

SEQ ID NO: 4680 - DNA, 35 bp, Artificial Sequence
  Synthetic oligonucleotide
tcacactccatcacggagccaccctagtttatagc

SEQ ID NO: 4681 - DNA, 36 bp, Artificial Sequence
  Synthetic oligonucleotide
atgagcaatggcgggaggggcatggggacggcggta

SEQ ID NO: 4682 - DNA, 37 bp, Artificial Sequence
  Synthetic oligonucleotide
gtgcccctcgccgattagcccaccacctgcatggaga

SEQ ID NO: 4683 - DNA, 35 bp, Artificial Sequence
  Synthetic oligonucleotide
gccgcctcccatcccgtctacgaatcttccggttc

SEQ ID NO: 4684 - DNA, 35 bp, Artificial Sequence
  Synthetic oligonucleotide
tgtaccgcccccttatcgtactatatagcctctac

SEQ ID NO: 4685 - DNA, 35 bp, Artificial Sequence
  Synthetic oligonucleotide
tgcccccaccttgtgtctgccacgcccagtccaac

SEQ ID NO: 4686 - DNA, 35 bp, Artificial Sequence
  Synthetic oligonucleotide
tagctgcctgccaccgatctggcccctcgagttac

SEQ ID NO: 4687 - DNA, 36 bp, Artificial Sequence
  Synthetic oligonucleotide
gaatgggcgggatcgggaaagttggaagtggaggga

SEQ ID NO: 4688 - DNA, 35 bp, Artificial Sequence
  Synthetic oligonucleotide
tctagcccgaagtggtcctacactgcacacattcc

SEQ ID NO: 4689 - DNA, 35 bp, Artificial Sequence
  Synthetic oligonucleotide
gctcgcacgaacttgccgttttattttactggtcc

SEQ ID NO: 4690 - DNA, 36 bp, Artificial Sequence
  Synthetic oligonucleotide
atccccccccacagcccgtatggcaggatttctaca

SEQ ID NO: 4691 - DNA, 36 bp, Artificial Sequence
  Synthetic oligonucleotide
tagaccaagacaacggaaaggaagtagggtggtgaa

SEQ ID NO: 4692 - DNA, 35 bp, Artificial Sequence
  Synthetic oligonucleotide
taaagccacccaaagttctcggacccatgcttctc

SEQ ID NO: 4693 - DNA, 38 bp, Artificial Sequence
  Synthetic oligonucleotide
tgcatgccccacctgcgacctcatgcaacttcctctga

SEQ ID NO: 4694 - DNA, 36 bp, Artificial Sequence
  Synthetic oligonucleotide
gaccaccatcaccaccgcgcctactccagggtcgca

SEQ ID NO: 4695 - DNA, 35 bp, Artificial Sequence
  Synthetic oligonucleotide
gaatcgccgtgcacacccgcatcagttctcctatc

SEQ ID NO: 4696 - DNA, 37 bp, Artificial Sequence
  Synthetic oligonucleotide
acccccagccatctgcctgattttgcgcgatcctcga

SEQ ID NO: 4697 - DNA, 35 bp, Artificial Sequence
  Synthetic oligonucleotide
acgcctccccgcctcacgatccccatgtggcctca

SEQ ID NO: 4698 - DNA, 36 bp, Artificial Sequence
  Synthetic oligonucleotide
gaatcccaactcccccgtgcgcccacctgtcgcgaa

SEQ ID NO: 4699 - DNA, 35 bp, Artificial Sequence
  Synthetic oligonucleotide
acgcaccctgccctttttacccgttctcactgagg

SEQ ID NO: 4700 - DNA, 35 bp, Artificial Sequence
  Synthetic oligonucleotide
gccccctccgacctcacccggcgctttgaccccgg

SEQ ID NO: 4701 - DNA, 35 bp, Artificial Sequence
  Synthetic oligonucleotide
gaagtcgtcggtcctctcacattgtgccctctttg

SEQ ID NO: 4702 - DNA, 35 bp, Artificial Sequence
  Synthetic oligonucleotide
aaacctacgccacttctgaattagtcattgcatcc

SEQ ID NO: 4703 - DNA, 33 bp, Artificial Sequence
  Synthetic oligonucleotide
gtcactttcgtggccccctccacactggaacat

SEQ ID NO: 4704 - DNA, 35 bp, Artificial Sequence
  Synthetic oligonucleotide
aacgaagacagcaccgctccatctctcatgactcc

SEQ ID NO: 4705 - DNA, 35 bp, Artificial Sequence
  Synthetic oligonucleotide
acccagccactgccgttacgacctcttgtggtgtt

SEQ ID NO: 4706 - DNA, 38 bp, Artificial Sequence
  Synthetic oligonucleotide
gtcaccatccggtggctatgcctcattcctgtccctga

SEQ ID NO: 4707 - DNA, 35 bp, Artificial Sequence
  Synthetic oligonucleotide
acaccaccttgcccacgatcaccttcgtgcgtatc

SEQ ID NO: 4708 - DNA, 37 bp, Artificial Sequence
  Synthetic oligonucleotide
atggggtggcgggttgaggcttcggacgaagggggga

SEQ ID NO: 4709 - DNA, 38 bp, Artificial Sequence
  Synthetic oligonucleotide
actccgcggtcctttgcctaacctgttccccctgctga

SEQ ID NO: 4710 - DNA, 38 bp, Artificial Sequence
  Synthetic oligonucleotide
gcatgccagcccccccgcctgtgctttagtttccgtga

SEQ ID NO: 4711 - DNA, 35 bp, Artificial Sequence
  Synthetic oligonucleotide
tccgccctcctacattgttgtgacactttatcacc

SEQ ID NO: 4712 - DNA, 36 bp, Artificial Sequence
  Synthetic oligonucleotide
tactcgcctccgcagtatcttcgttctgttccacca

SEQ ID NO: 4713 - DNA, 35 bp, Artificial Sequence
  Synthetic oligonucleotide
acacacgtggcctgcctgcccggttctcccgattc

SEQ ID NO: 4714 - DNA, 35 bp, Artificial Sequence
  Synthetic oligonucleotide
gccggagctatgcatactgcatctttctatcctgt

SEQ ID NO: 4715 - DNA, 35 bp, Artificial Sequence
  Synthetic oligonucleotide
tccacgaccgggacacgcccaccgatctgtttttc

SEQ ID NO: 4716 - DNA, 36 bp, Artificial Sequence
  Synthetic oligonucleotide
aaccgcgcacgcgatattgtaccgctcctctttcca

SEQ ID NO: 4717 - DNA, 37 bp, Artificial Sequence
  Synthetic oligonucleotide
agacgcggagggggaggggaacactaggcaggacgga

SEQ ID NO: 4718 - DNA, 37 bp, Artificial Sequence
  Synthetic oligonucleotide
tccatccccacgtttcttctggctgcccctcttggga

SEQ ID NO: 4719 - DNA, 35 bp, Artificial Sequence
  Synthetic oligonucleotide
tcacctgcccgcctatcattgtcgtacacatacat

SEQ ID NO: 4720 - DNA, 36 bp, Artificial Sequence
  Synthetic oligonucleotide
gccactgccatcaatggccattctcctgctccacca

SEQ ID NO: 4721 - DNA, 35 bp, Artificial Sequence
  Synthetic oligonucleotide
tcccgcccccagctccgtttggcccttccttggcg

SEQ ID NO: 4722 - DNA, 37 bp, Artificial Sequence
  Synthetic oligonucleotide
gtctcaccgccgatgcgaacatcattttacccctcga

SEQ ID NO: 4723 - DNA, 35 bp, Artificial Sequence
  Synthetic oligonucleotide
tacgcgtgccctttattcgtctagccttcgactcc

SEQ ID NO: 4724 - DNA, 37 bp, Artificial Sequence
  Synthetic oligonucleotide
tgtttccaccgccccgaacgcatctcaagagcaccga

SEQ ID NO: 4725 - DNA, 35 bp, Artificial Sequence
  Synthetic oligonucleotide
ttcgcgctgagcacactgtctattcttcctcctgc

SEQ ID NO: 4726 - DNA, 35 bp, Artificial Sequence
  Synthetic oligonucleotide
gagatgcgttccacttaccctgtcgtgcctgcccc

SEQ ID NO: 4727 - DNA, 38 bp, Artificial Sequence
  Synthetic oligonucleotide
atgacaaccggctgtgtcgcccctcccgacccgcttga

SEQ ID NO: 4728 - DNA, 36 bp, Artificial Sequence
  Synthetic oligonucleotide
gacatagcccctattgatctgatcttcccccgttca

SEQ ID NO: 4729 - DNA, 35 bp, Artificial Sequence
  Synthetic oligonucleotide
ggacacagccacacccttttgcactcgtaggtttc

SEQ ID NO: 4730 - DNA, 35 bp, Artificial Sequence
  Synthetic oligonucleotide
gctgttcctccgcctcttcattggactgtcctatc

SEQ ID NO: 4731 - DNA, 35 bp, Artificial Sequence
  Synthetic oligonucleotide
ggaggaggggaagggtgaggagggaggatgtggct

SEQ ID NO: 4732 - DNA, 35 bp, Artificial Sequence
  Synthetic oligonucleotide
acacctgcctcgagcaaacatatcttaccgcccac

SEQ ID NO: 4733 - DNA, 36 bp, Artificial Sequence
  Synthetic oligonucleotide
gatcaccacgcagccggccctaccatctttatgcca

SEQ ID NO: 4734 - DNA, 35 bp, Artificial Sequence
  Synthetic oligonucleotide
ttacccgcacacatcacgcaagctgcaatatattc

SEQ ID NO: 4735 - DNA, 35 bp, Artificial Sequence
  Synthetic oligonucleotide
aaccgcccggcgaccacctgttttacgcacttttt

SEQ ID NO: 4736 - DNA, 35 bp, Artificial Sequence
  Synthetic oligonucleotide
acccgccccatactgagctttgtgcagtcttatta

SEQ ID NO: 4737 - DNA, 37 bp, Artificial Sequence
  Synthetic oligonucleotide
tgatcctgccccttgacgcttttggaacctccttcga

SEQ ID NO: 4738 - DNA, 35 bp, Artificial Sequence
  Synthetic oligonucleotide
accccaccacatggctctttaactctctggatttc

SEQ ID NO: 4739 - DNA, 35 bp, Artificial Sequence
  Synthetic oligonucleotide
tcccatgccgagatacttctgggccttaccacccc

SEQ ID NO: 4740 - DNA, 35 bp, Artificial Sequence
  Synthetic oligonucleotide
gactggcaccctgcccgtatatgtcatgtcccttt

SEQ ID NO: 4741 - DNA, 35 bp, Artificial Sequence
  Synthetic oligonucleotide
tgtcacccgactcacagtcctgctggccactaccc

SEQ ID NO: 4742 - DNA, 35 bp, Artificial Sequence
  Synthetic oligonucleotide
tcccacgccctatacaccaggccccctgtacaaca

SEQ ID NO: 4743 - DNA, 37 bp, Artificial Sequence
  Synthetic oligonucleotide
acccacctcactttctcataacgtacctggtcactga

SEQ ID NO: 4744 - DNA, 34 bp, Artificial Sequence
  Synthetic oligonucleotide
atttcaccacccggccaagtttgcgcatcacctc

SEQ ID NO: 4745 - DNA, 38 bp, Artificial Sequence
  Synthetic oligonucleotide
tgtcgccgcccgcgttagacccactcccctcgccttga

SEQ ID NO: 4746 - DNA, 36 bp, Artificial Sequence
  Synthetic oligonucleotide
gagacgcgcagagccgaactcgcacctcccactgta

SEQ ID NO: 4747 - DNA, 35 bp, Artificial Sequence
  Synthetic oligonucleotide
gatccacgcgccctcattactcccagtgtcaaaac

SEQ ID NO: 4748 - DNA, 35 bp, Artificial Sequence
  Synthetic oligonucleotide
agtaccgccgccaccggtcaatactggcccctgtc

SEQ ID NO: 4749 - DNA, 35 bp, Artificial Sequence
  Synthetic oligonucleotide
gcacgtatgccaggtccccctcaaccccgtttact

SEQ ID NO: 4750 - DNA, 35 bp, Artificial Sequence
  Synthetic oligonucleotide
tacgtggcctaccccatctatgctcctggttccgt

SEQ ID NO: 4751 - DNA, 35 bp, Artificial Sequence
  Synthetic oligonucleotide
acacctgcgcactcagcacgccgttcctcccaggc

SEQ ID NO: 4752 - DNA, 34 bp, Artificial Sequence
  Synthetic oligonucleotide
aactcgccccgtatccaccgccgttcatcctagt

SEQ ID NO: 4753 - DNA, 34 bp, Artificial Sequence
  Synthetic oligonucleotide
gacgccacaaaatcaacacaccccacgccctgtt

SEQ ID NO: 4754 - DNA, 37 bp, Artificial Sequence
  Synthetic oligonucleotide
ttgaagcgggaggcgggtaaggcgaggggggaaggga

SEQ ID NO: 4755 - DNA, 37 bp, Artificial Sequence
  Synthetic oligonucleotide
tcctccctcgcacactgcctaccgacacttcatttga

SEQ ID NO: 4756 - DNA, 35 bp, Artificial Sequence
  Synthetic oligonucleotide
acgcgctgtctctgcctgactcttagacctctctt

SEQ ID NO: 4757 - DNA, 35 bp, Artificial Sequence
  Synthetic oligonucleotide
tagtgctgcactcgggaacgcgtaacccacaatcc

SEQ ID NO: 4758 - DNA, 35 bp, Artificial Sequence
  Synthetic oligonucleotide
gctcgaaggcccggcgcataccaccacactgtaca

SEQ ID NO: 4759 - DNA, 35 bp, Artificial Sequence
  Synthetic oligonucleotide
gtgtccccacgtcacacctgcctaaatcctcctgc

SEQ ID NO: 4760 - DNA, 36 bp, Artificial Sequence
  Synthetic oligonucleotide
gtcatacgcctccatctgccctcgactaagtgatca

SEQ ID NO: 4761 - DNA, 35 bp, Artificial Sequence
  Synthetic oligonucleotide
gaccacctccgtgttatccatgtataggcccttcc

SEQ ID NO: 4762 - DNA, 35 bp, Artificial Sequence
  Synthetic oligonucleotide
agaccaacatccccacgccggactctcgctccact

SEQ ID NO: 4763 - DNA, 36 bp, Artificial Sequence
  Synthetic oligonucleotide
tcaccatacagacactagccccttcgcgccactgca

SEQ ID NO: 4764 - DNA, 35 bp, Artificial Sequence
  Synthetic oligonucleotide
gttcaccacaccgctccgactccctgtcacaggtc

SEQ ID NO: 4765 - DNA, 36 bp, Artificial Sequence
  Synthetic oligonucleotide
acctgtgccgaggctttagtcctgtcgctctcccta

SEQ ID NO: 4766 - DNA, 35 bp, Artificial Sequence
  Synthetic oligonucleotide
tcacaccacgcatacctgtacgcccctagtgctca

SEQ ID NO: 4767 - DNA, 35 bp, Artificial Sequence
  Synthetic oligonucleotide
atcacccgtcctagcccattgatccctcccgcatc

SEQ ID NO: 4768 - DNA, 35 bp, Artificial Sequence
  Synthetic oligonucleotide
acccatccgcttatacatcctgctgcctagtgacc

SEQ ID NO: 4769 - DNA, 35 bp, Artificial Sequence
  Synthetic oligonucleotide
accgcaaaccctctacttgctatgccccagaacca

SEQ ID NO: 4770 - DNA, 35 bp, Artificial Sequence
  Synthetic oligonucleotide
gcataggaggattggttggatgggaaggggtggtg

SEQ ID NO: 4771 - DNA, 36 bp, Artificial Sequence
  Synthetic oligonucleotide
accacccccatgcgatcggccttatatggctcatca

SEQ ID NO: 4772 - DNA, 37 bp, Artificial Sequence
  Synthetic oligonucleotide
acccccgccacacattctagccttcccaatgctccga

SEQ ID NO: 4773 - DNA, 35 bp, Artificial Sequence
  Synthetic oligonucleotide
gtgacacatcctaccacgccgaagcgcctcgcgct

SEQ ID NO: 4774 - DNA, 36 bp, Artificial Sequence
  Synthetic oligonucleotide
aaccctgcatcccgccccgctgttcctgttaggtta

SEQ ID NO: 4775 - DNA, 35 bp, Artificial Sequence
  Synthetic oligonucleotide
aacacacgcacgatctcggaacttagctcatctac

SEQ ID NO: 4776 - DNA, 35 bp, Artificial Sequence
  Synthetic oligonucleotide
gacacacccagacgccctcttcctgtgcgcaccca

SEQ ID NO: 4777 - DNA, 37 bp, Artificial Sequence
  Synthetic oligonucleotide
gtcgctcctcagtcctgtttacctcacctccctgcga

SEQ ID NO: 4778 - DNA, 38 bp, Artificial Sequence
  Synthetic oligonucleotide
ggcgggggggggcgaagatgatgcaggggcgatcgtga

SEQ ID NO: 4779 - DNA, 35 bp, Artificial Sequence
  Synthetic oligonucleotide
gccggatagtggtgcggtaatgggagggtgggctt

SEQ ID NO: 4780 - DNA, 35 bp, Artificial Sequence
  Synthetic oligonucleotide
ttactaccacaaccatactatcctcgcctggatag

SEQ ID NO: 4781 - DNA, 36 bp, Artificial Sequence
  Synthetic oligonucleotide
gcacacttagtgccgttttcttctctctgctttcgc

SEQ ID NO: 4782 - DNA, 35 bp, Artificial Sequence
  Synthetic oligonucleotide
acacaccgctccatggtccctctcctgccggggca

SEQ ID NO: 4783 - DNA, 37 bp, Artificial Sequence
  Synthetic oligonucleotide
actcagccctggtgcgccacctagtcccttgccacga

SEQ ID NO: 4784 - DNA, 35 bp, Artificial Sequence
  Synthetic oligonucleotide
aacgcccccggaacgtagtctacttgttttgctct

SEQ ID NO: 4785 - DNA, 35 bp, Artificial Sequence
  Synthetic oligonucleotide
aactgactccccccatgtgacgcgctcctttccat

SEQ ID NO: 4786 - DNA, 35 bp, Artificial Sequence
  Synthetic oligonucleotide
atcacacactcacacccggctatcgatgctgcccg

SEQ ID NO: 4787 - DNA, 35 bp, Artificial Sequence
  Synthetic oligonucleotide
gatgacggatgtgtgtgcacctgccctcaacccct

SEQ ID NO: 4788 - DNA, 37 bp, Artificial Sequence
  Synthetic oligonucleotide
ttaatgcgcacatgtgggacgggggtggagggaaaga

SEQ ID NO: 4789 - DNA, 37 bp, Artificial Sequence
  Synthetic oligonucleotide
atcacgcggagacatagggggggaaggagtagaggga

SEQ ID NO: 4790 - DNA, 36 bp, Artificial Sequence
  Synthetic oligonucleotide
accactcaggacttcgcatcctcttggcttaaccta

SEQ ID NO: 4791 - DNA, 35 bp, Artificial Sequence
  Synthetic oligonucleotide
atcgcacgagcctccaaaccacctgcattagatcc

SEQ ID NO: 4792 - DNA, 35 bp, Artificial Sequence
  Synthetic oligonucleotide
gtccatcccccacccttcccgatagcatgcgcttc

SEQ ID NO: 4793 - DNA, 35 bp, Artificial Sequence
  Synthetic oligonucleotide
tccgttaccacccacctgttgatgtattatcgttc

SEQ ID NO: 4794 - DNA, 36 bp, Artificial Sequence
  Synthetic oligonucleotide
gccacagcaccacacgcccgcctcgaccattgttaa

SEQ ID NO: 4795 - DNA, 35 bp, Artificial Sequence
  Synthetic oligonucleotide
taccgcaaccctgactgcaaacccaccgcacaacc

SEQ ID NO: 4796 - DNA, 37 bp, Artificial Sequence
  Synthetic oligonucleotide
gaagagccggaaagaagatggaggcggagggttaaga

SEQ ID NO: 4797 - DNA, 36 bp, Artificial Sequence
  Synthetic oligonucleotide
gaatgtcccacgtcgtattgcctctctgtcccctta

SEQ ID NO: 4798 - DNA, 32 bp, Artificial Sequence
  Synthetic oligonucleotide
agacccgctcgatccgctccatctattcgccg

SEQ ID NO: 4799 - DNA, 35 bp, Artificial Sequence
  Synthetic oligonucleotide
acccccagctgcccctgcccacgagttctggcctg

SEQ ID NO: 4800 - DNA, 36 bp, Artificial Sequence
  Synthetic oligonucleotide
tacatccccagggtgaccagcctagaccccgaccca

SEQ ID NO: 4801 - DNA, 35 bp, Artificial Sequence
  Synthetic oligonucleotide
ttgccatgcacatttttgcactgtccctgttttac

SEQ ID NO: 4802 - DNA, 35 bp, Artificial Sequence
  Synthetic oligonucleotide
tgagtacccaccctctgtataccccgagctacacc

SEQ ID NO: 4803 - DNA, 35 bp, Artificial Sequence
  Synthetic oligonucleotide
aagccgcccgcccttgtccgctctcttgtccgtcc

SEQ ID NO: 4804 - DNA, 35 bp, Artificial Sequence
  Synthetic oligonucleotide
tttgccaccgcctctgactttatgccgattaacct

SEQ ID NO: 4805 - DNA, 36 bp, Artificial Sequence
  Synthetic oligonucleotide
gatcatcccctgttctcgttctagtaaccatgcaaa

SEQ ID NO: 4806 - DNA, 37 bp, Artificial Sequence
  Synthetic oligonucleotide
gtctgccgccgtccttatcctggcctcgttttctgga

SEQ ID NO: 4807 - DNA, 36 bp, Artificial Sequence
  Synthetic oligonucleotide
gcacgccgctattatgcacatcccctccttgtagta

SEQ ID NO: 4808 - DNA, 35 bp, Artificial Sequence
  Synthetic oligonucleotide
tcacgcatccgtgccctccttatttgtttgtgtcg

SEQ ID NO: 4809 - DNA, 35 bp, Artificial Sequence
  Synthetic oligonucleotide
accccaccacctggtgtcaccgtatggtccgccat

SEQ ID NO: 4810 - DNA, 36 bp, Artificial Sequence
  Synthetic oligonucleotide
gtacagggcgggcggaatacggggaatggggctgct

SEQ ID NO: 4811 - DNA, 36 bp, Artificial Sequence
  Synthetic oligonucleotide
tccgcccacggatcacccgaatgcatgcccccttga

SEQ ID NO: 4812 - DNA, 35 bp, Artificial Sequence
  Synthetic oligonucleotide
aaccaacacccgttcacagtccccacgcacccgcg

SEQ ID NO: 4813 - DNA, 35 bp, Artificial Sequence
  Synthetic oligonucleotide
gtccgcccctgatttcctactgtccttcgcatgca

SEQ ID NO: 4814 - DNA, 35 bp, Artificial Sequence
  Synthetic oligonucleotide
tttgccgctccgttccgtttcccgttggatgcctc

SEQ ID NO: 4815 - DNA, 35 bp, Artificial Sequence
  Synthetic oligonucleotide
gcattcctccactgtgccatcgtttttcactactg

SEQ ID NO: 4816 - DNA, 35 bp, Artificial Sequence
  Synthetic oligonucleotide
tcaatgcctgccattcaaatgcacactgctacacc

SEQ ID NO: 4817 - DNA, 37 bp, Artificial Sequence
  Synthetic oligonucleotide
gatgctccacccagtctctcctgttcgcgttcaccga

SEQ ID NO: 4818 - DNA, 35 bp, Artificial Sequence
  Synthetic oligonucleotide
tgctccagccacatccacagtgaccttacaccatc

SEQ ID NO: 4819 - DNA, 35 bp, Artificial Sequence
  Synthetic oligonucleotide
tgcccatgtacgttgatcgtaccgccttgttactc

SEQ ID NO: 4820 - DNA, 35 bp, Artificial Sequence
  Synthetic oligonucleotide
ttcggacagcctgcccacacgtcatcctggccttt

SEQ ID NO: 4821 - DNA, 35 bp, Artificial Sequence
  Synthetic oligonucleotide
atccccaatgaaacgtgttcgtgtcctcttcttga

SEQ ID NO: 4822 - DNA, 37 bp, Artificial Sequence
  Synthetic oligonucleotide
atgctggtgggaacggtgaggcatgggggcggggtga

SEQ ID NO: 4823 - DNA, 35 bp, Artificial Sequence
  Synthetic oligonucleotide
gaacccacgcccttttgcaaagcccctacttgtac

SEQ ID NO: 4824 - DNA, 35 bp, Artificial Sequence
  Synthetic oligonucleotide
gactccaaccctagtgcgctatatcgcgtgttcct

SEQ ID NO: 4825 - DNA, 38 bp, Artificial Sequence
  Synthetic oligonucleotide
tacgtgccgaccatgcttctgcgctccttccccggtga

SEQ ID NO: 4826 - DNA, 37 bp, Artificial Sequence
  Synthetic oligonucleotide
gcacccgccccattcttatagcaccgtaaactgccga

SEQ ID NO: 4827 - DNA, 32 bp, Artificial Sequence
  Synthetic oligonucleotide
tacccgcaccccgacttctcatccccttcgta

SEQ ID NO: 4828 - DNA, 38 bp, Artificial Sequence
  Synthetic oligonucleotide
tagtgctggtagggggggtggtatgcaagtaagggtga

SEQ ID NO: 4829 - DNA, 35 bp, Artificial Sequence
  Synthetic oligonucleotide
acaaactgccggcgtactccctatttgaaccaccg

SEQ ID NO: 4830 - DNA, 36 bp, Artificial Sequence
  Synthetic oligonucleotide
atttacccgcgcgcccttccattgcgaaacctgtca

SEQ ID NO: 4831 - DNA, 35 bp, Artificial Sequence
  Synthetic oligonucleotide
accgaccatcaaccgcgtaggttgtcgcaatactc

SEQ ID NO: 4832 - DNA, 35 bp, Artificial Sequence
  Synthetic oligonucleotide
acctcacacctggacacttggtcctcccgcctttg

SEQ ID NO: 4833 - DNA, 35 bp, Artificial Sequence
  Synthetic oligonucleotide
gccagccatgtggcgcccccaacaacctgccctgt

SEQ ID NO: 4834 - DNA, 35 bp, Artificial Sequence
  Synthetic oligonucleotide
tctatgccccatacgctattaggttcgctacattc

SEQ ID NO: 4835 - DNA, 35 bp, Artificial Sequence
  Synthetic oligonucleotide
agaccagggcctcatgctttcctgcactcttcgtt

SEQ ID NO: 4836 - DNA, 35 bp, Artificial Sequence
  Synthetic oligonucleotide
ttaccggtcgccactctgggcactcacaactcctt

SEQ ID NO: 4837 - DNA, 35 bp, Artificial Sequence
  Synthetic oligonucleotide
gccaccccactatctcaccatctcggcgcgagcac

SEQ ID NO: 4838 - DNA, 35 bp, Artificial Sequence
  Synthetic oligonucleotide
tcccacctaccacatggtgagaaaatccgtaaccc

SEQ ID NO: 4839 - DNA, 35 bp, Artificial Sequence
  Synthetic oligonucleotide
gcacccctgacgtcgctaatcctatcgcctcacgc

SEQ ID NO: 4840 - DNA, 35 bp, Artificial Sequence
  Synthetic oligonucleotide
aactacaccaccgctcatgcgcgtaactaccattt

SEQ ID NO: 4841 - DNA, 35 bp, Artificial Sequence
  Synthetic oligonucleotide
gccgcctccttcgccctggtcttcagtcccgcaaa

SEQ ID NO: 4842 - DNA, 36 bp, Artificial Sequence
  Synthetic oligonucleotide
gaccaccggtcactacacttcaagccctgttcgtaa

SEQ ID NO: 4843 - DNA, 37 bp, Artificial Sequence
  Synthetic oligonucleotide
tgccaggacaaagccgtactcttcgcaccatctccga

SEQ ID NO: 4844 - DNA, 33 bp, Artificial Sequence
  Synthetic oligonucleotide
tgctgccatccccacaccttgcacgtccgacct

SEQ ID NO: 4845 - DNA, 35 bp, Artificial Sequence
  Synthetic oligonucleotide
gacctccctcacactgggaacacttcaagcctggc

SEQ ID NO: 4846 - DNA, 35 bp, Artificial Sequence
  Synthetic oligonucleotide
tagccccgcccccgctcctaggttaccctgccaat

SEQ ID NO: 4847 - DNA, 36 bp, Artificial Sequence
  Synthetic oligonucleotide
acatccctgatccgctgaagaccacgcaccctataa

SEQ ID NO: 4848 - DNA, 35 bp, Artificial Sequence
  Synthetic oligonucleotide
tgccccgcacccgttgctatctggttaattgttcc

SEQ ID NO: 4849 - DNA, 35 bp, Artificial Sequence
  Synthetic oligonucleotide
tagccccatccatatcattgcgaaaagcgagagct

SEQ ID NO: 4850 - DNA, 35 bp, Artificial Sequence
  Synthetic oligonucleotide
gcccgtactgagtgtacttacccgcccatccccaa

SEQ ID NO: 4851 - DNA, 35 bp, Artificial Sequence
  Synthetic oligonucleotide
gtctgcccgatccgctcatcgtcgacgttcccgcc

SEQ ID NO: 4852 - DNA, 37 bp, Artificial Sequence
  Synthetic oligonucleotide
accccgccaacctctctgcactatcggacgttaacga

SEQ ID NO: 4853 - DNA, 36 bp, Artificial Sequence
  Synthetic oligonucleotide
accaccaaacaggtagcataacctggactatcactc

SEQ ID NO: 4854 - DNA, 35 bp, Artificial Sequence
  Synthetic oligonucleotide
gactccctgccatttgataggcgcaccgaccactt

SEQ ID NO: 4855 - DNA, 35 bp, Artificial Sequence
  Synthetic oligonucleotide
agttcacactcacccccagcactgcacttctatgc

SEQ ID NO: 4856 - DNA, 35 bp, Artificial Sequence
  Synthetic oligonucleotide
gcccatgtccgtcgacaccaccacccccaggcttt

SEQ ID NO: 4857 - DNA, 35 bp, Artificial Sequence
  Synthetic oligonucleotide
taccgtccctaggcccctccatccctactcatgat

SEQ ID NO: 4858 - DNA, 35 bp, Artificial Sequence
  Synthetic oligonucleotide
acctgccggcagtccctgtcaccaaacttccactg

SEQ ID NO: 4859 - DNA, 37 bp, Artificial Sequence
  Synthetic oligonucleotide
gctcatccgtcccgctgccgacacacaccttccaaga

SEQ ID NO: 4860 - DNA, 36 bp, Artificial Sequence
  Synthetic oligonucleotide
gtgtggggaaggggtgcgggggaaccgggatgggta

SEQ ID NO: 4861 - DNA, 37 bp, Artificial Sequence
  Synthetic oligonucleotide
gagacaggacagggggagtcgggagggggacggatga

SEQ ID NO: 4862 - DNA, 35 bp, Artificial Sequence
  Synthetic oligonucleotide
tgtgtcgcaacccgacgctggacccacctacttta

SEQ ID NO: 4863 - DNA, 36 bp, Artificial Sequence
  Synthetic oligonucleotide
gtcactgccatgaaatgccgtttcgttccttaccca

SEQ ID NO: 4864 - DNA, 37 bp, Artificial Sequence
  Synthetic oligonucleotide
taacccaccgccattgctgacctagctttcatttgga

SEQ ID NO: 4865 - DNA, 32 bp, Artificial Sequence
  Synthetic oligonucleotide
tgattcagtcctttgcttcgtgccccaccgcg

SEQ ID NO: 4866 - DNA, 35 bp, Artificial Sequence
  Synthetic oligonucleotide
acccgctacggatcccccacccgataatgccctcc

SEQ ID NO: 4867 - DNA, 35 bp, Artificial Sequence
  Synthetic oligonucleotide
tacgagaagggtgacggtgagcataggggggtagg

SEQ ID NO: 4868 - DNA, 26 bp, Artificial Sequence
  Synthetic oligonucleotide
tatctctacacacctgttctccgttc

SEQ ID NO: 4869 - DNA, 35 bp, Artificial Sequence
  Synthetic oligonucleotide
tcacaccgcccccccaggtaacccttgtagttccc

SEQ ID NO: 4870 - DNA, 36 bp, Artificial Sequence
  Synthetic oligonucleotide
tacttgcccgcccccaaccagccgtccctacagtta

SEQ ID NO: 4871 - DNA, 35 bp, Artificial Sequence
  Synthetic oligonucleotide
tcccaggccagaccaggactccactcccaagctct

SEQ ID NO: 4872 - DNA, 35 bp, Artificial Sequence
  Synthetic oligonucleotide
gcaccatacccgcgcctggcacttgtctacacgca

SEQ ID NO: 4873 - DNA, 38 bp, Artificial Sequence
  Synthetic oligonucleotide
gaagcaatgtgggggggtggaaaaggggatgggtgtga

SEQ ID NO: 4874 - DNA, 35 bp, Artificial Sequence
  Synthetic oligonucleotide
gacgtgccgtaggcatgcttcttaatacaccattc

SEQ ID NO: 4875 - DNA, 35 bp, Artificial Sequence
  Synthetic oligonucleotide
gaccaccgtcattgcctcgcggcccaattccactt

SEQ ID NO: 4876 - DNA, 35 bp, Artificial Sequence
  Synthetic oligonucleotide
tatgacgtgcctctatgcctaactcctgctggttc

SEQ ID NO: 4877 - DNA, 36 bp, Artificial Sequence
  Synthetic oligonucleotide
accagccacgcgcacatgttacgtcattctccctca

SEQ ID NO: 4878 - DNA, 35 bp, Artificial Sequence
  Synthetic oligonucleotide
accgaccaccctcagttgtgaaacgccccaccgca

SEQ ID NO: 4879 - DNA, 35 bp, Artificial Sequence
  Synthetic oligonucleotide
tgctctctccgtatgcttattgtctgttcttccat

SEQ ID NO: 4880 - DNA, 35 bp, Artificial Sequence
  Synthetic oligonucleotide
tgcactttcacccctgcctcccgcccgtactgata

SEQ ID NO: 4881 - DNA, 35 bp, Artificial Sequence
  Synthetic oligonucleotide
gtcacaccaagcttatgcaccatcggactctcgac

SEQ ID NO: 4882 - DNA, 35 bp, Artificial Sequence
  Synthetic oligonucleotide
acatccgatccgaccgcctacgtgcttttcctacg

SEQ ID NO: 4883 - DNA, 36 bp, Artificial Sequence
  Synthetic oligonucleotide
ttcgacctcgcctcggagcgttccctcgccgttcca

SEQ ID NO: 4884 - DNA, 36 bp, Artificial Sequence
  Synthetic oligonucleotide
attgtcacgccgccctgagctccgaatcgcttgcca

SEQ ID NO: 4885 - DNA, 35 bp, Artificial Sequence
  Synthetic oligonucleotide
atcaccagcatcgtacaccccccgcgccacgaaag

SEQ ID NO: 4886 - DNA, 35 bp, Artificial Sequence
  Synthetic oligonucleotide
atacatccacgcatattgctacacccaggtcgaac

SEQ ID NO: 4887 - DNA, 35 bp, Artificial Sequence
  Synthetic oligonucleotide
tacctctgcccggtgtccattccaagtttcacctg

SEQ ID NO: 4888 - DNA, 35 bp, Artificial Sequence
  Synthetic oligonucleotide
actatccatccgctacactgccccggatcgagacc

SEQ ID NO: 4889 - DNA, 36 bp, Artificial Sequence
  Synthetic oligonucleotide
acgacccgccatccgttgcgacacactgtccaccca

SEQ ID NO: 4890 - DNA, 37 bp, Artificial Sequence
  Synthetic oligonucleotide
tcccaccgccttgccttgtatcacatccttgggacga

SEQ ID NO: 4891 - DNA, 35 bp, Artificial Sequence
  Synthetic oligonucleotide
taaccctgcctcgtgtgaccttgcaactctctcgt

SEQ ID NO: 4892 - DNA, 35 bp, Artificial Sequence
  Synthetic oligonucleotide
cccacactacgcatttcgggcctatttttacattg

SEQ ID NO: 4893 - DNA, 37 bp, Artificial Sequence
  Synthetic oligonucleotide
acgaccgccttcgacctggtatccgcctccctcatga

SEQ ID NO: 4894 - DNA, 35 bp, Artificial Sequence
  Synthetic oligonucleotide
attgcatccccggcctgtatgcccacccttatacg

SEQ ID NO: 4895 - DNA, 37 bp, Artificial Sequence
  Synthetic oligonucleotide
aagtaacgcaggaggggtgggtagggtggaaaaggga

SEQ ID NO: 4896 - DNA, 35 bp, Artificial Sequence
  Synthetic oligonucleotide
acgtcgaccctcatccatttgacaccctgcaacgc

SEQ ID NO: 4897 - DNA, 38 bp, Artificial Sequence
  Synthetic oligonucleotide
tgaacgcgcacgctccctgaacgcctgtccccacctga

SEQ ID NO: 4898 - DNA, 35 bp, Artificial Sequence
  Synthetic oligonucleotide
gacccccaactcctgttacgcctgatcgatttcat

SEQ ID NO: 4899 - DNA, 35 bp, Artificial Sequence
  Synthetic oligonucleotide
agaccccacggcaccttgatctatgccttatccaa

SEQ ID NO: 4900 - DNA, 36 bp, Artificial Sequence
  Synthetic oligonucleotide
atgtacggcgccgcattcccccgcttccgacctgta

SEQ ID NO: 4901 - DNA, 35 bp, Artificial Sequence
  Synthetic oligonucleotide
taaccccgcccccccacggttctacttctgtgtgc

SEQ ID NO: 4902 - DNA, 37 bp, Artificial Sequence
  Synthetic oligonucleotide
tcccccccacaggtaccatacacaagccatccacgga

SEQ ID NO: 4903 - DNA, 35 bp, Artificial Sequence
  Synthetic oligonucleotide
ttacaaccccggtcgctaccgactgctcaccacct

SEQ ID NO: 4904 - DNA, 36 bp, Artificial Sequence
  Synthetic oligonucleotide
tagctagcctccacgcaaccaccagctgacatactc

SEQ ID NO: 4905 - DNA, 35 bp, Artificial Sequence
  Synthetic oligonucleotide
tccccacgaaggggcccctcacttacctgacgtac

SEQ ID NO: 4906 - DNA, 36 bp, Artificial Sequence
  Synthetic oligonucleotide
ttgcaatgctgtcctgtttctctgtcgcccaccata

SEQ ID NO: 4907 - DNA, 35 bp, Artificial Sequence
  Synthetic oligonucleotide
acattatgcctcacgggtcgtttcctcacctgtcc

SEQ ID NO: 4908 - DNA, 37 bp, Artificial Sequence
  Synthetic oligonucleotide
taggaccgccgctattgcaacatcaccgcttccacga

SEQ ID NO: 4909 - DNA, 35 bp, Artificial Sequence
  Synthetic oligonucleotide
acgtacgcaccatctccactctccagcgcccgtgc

SEQ ID NO: 4910 - DNA, 36 bp, Artificial Sequence
  Synthetic oligonucleotide
gactggccccgaccctgtcccataaccagccattta

SEQ ID NO: 4911 - DNA, 35 bp, Artificial Sequence
  Synthetic oligonucleotide
tcactcgctccgtgtctctcttatctgttgccttg

SEQ ID NO: 4912 - DNA, 34 bp, Artificial Sequence
  Synthetic oligonucleotide
tgccaccttgaggttcccgtacatttccccgcca

SEQ ID NO: 4913 - DNA, 35 bp, Artificial Sequence
  Synthetic oligonucleotide
tccacgtgcacactgttgctcttatatcctcgtat

SEQ ID NO: 4914 - DNA, 35 bp, Artificial Sequence
  Synthetic oligonucleotide
gctgacccccggttatttttcgctaccatgagccc

SEQ ID NO: 4915 - DNA, 35 bp, Artificial Sequence
  Synthetic oligonucleotide
ttccgcgccgtatcacccatagtattgtccgcgcc

SEQ ID NO: 4916 - DNA, 35 bp, Artificial Sequence
  Synthetic oligonucleotide
gatcctcaccttgcctactatgacccgattcacgc

SEQ ID NO: 4917 - DNA, 31 bp, Artificial Sequence
  Synthetic oligonucleotide
tctcgctaccactcccttcagttgctgctac

SEQ ID NO: 4918 - DNA, 36 bp, Artificial Sequence
  Synthetic oligonucleotide
aatccaccgactctgtacatgcactgtcgtacccca

SEQ ID NO: 4919 - DNA, 35 bp, Artificial Sequence
  Synthetic oligonucleotide
acccaattgcctcgctgtctttcgtttctggttcg

SEQ ID NO: 4920 - DNA, 35 bp, Artificial Sequence
  Synthetic oligonucleotide
atcatctccacgttgtagcctcgcccgctttgcct

SEQ ID NO: 4921 - DNA, 36 bp, Artificial Sequence
  Synthetic oligonucleotide
agggtgggagggttggacaatggagggaactgttaa

SEQ ID NO: 4922 - DNA, 35 bp, Artificial Sequence
  Synthetic oligonucleotide
tccactcacaccggttactgccctgttaattctgc

SEQ ID NO: 4923 - DNA, 35 bp, Artificial Sequence
  Synthetic oligonucleotide
atacgccgcgacctagcatcacggctcttccaccc

SEQ ID NO: 4924 - DNA, 38 bp, Artificial Sequence
  Synthetic oligonucleotide
acacaccgaacttttccgcttagagccccccacgttga

SEQ ID NO: 4925 - DNA, 36 bp, Artificial Sequence
  Synthetic oligonucleotide
gactcgctatccgagcgattgacgcccctcccatga

SEQ ID NO: 4926 - DNA, 35 bp, Artificial Sequence
  Synthetic oligonucleotide
ttaatcaccgccggagtgacccccgccccccgtgt

SEQ ID NO: 4927 - DNA, 36 bp, Artificial Sequence
  Synthetic oligonucleotide
atctatcccgcaagtgtatactcgcgccatcctcca

SEQ ID NO: 4928 - DNA, 36 bp, Artificial Sequence
  Synthetic oligonucleotide
aacaccagccgtcacacttgttcaccacgcagccaa

SEQ ID NO: 4929 - DNA, 35 bp, Artificial Sequence
  Synthetic oligonucleotide
acgccccccttacgtgcgccccccgagctcctgcc

SEQ ID NO: 4930 - DNA, 35 bp, Artificial Sequence
  Synthetic oligonucleotide
gaccacgcgtgcccctcctccgcttacgtcactcg

SEQ ID NO: 4931 - DNA, 38 bp, Artificial Sequence
  Synthetic oligonucleotide
gcccactctcgcctcatcatgccccgaacacacggtga

SEQ ID NO: 4932 - DNA, 35 bp, Artificial Sequence
  Synthetic oligonucleotide
accatccacaagtttacacggaccaccttcctgcg

SEQ ID NO: 4933 - DNA, 36 bp, Artificial Sequence
  Synthetic oligonucleotide
gtcataacgggacacgccgccctcctacgacttcta

SEQ ID NO: 4934 - DNA, 36 bp, Artificial Sequence
  Synthetic oligonucleotide
atcacgcaaattgcataccacccggcctttgaccca

SEQ ID NO: 4935 - DNA, 35 bp, Artificial Sequence
  Synthetic oligonucleotide
gtggacctgccgtgtccctccctgttgtaatccca

SEQ ID NO: 4936 - DNA, 35 bp, Artificial Sequence
  Synthetic oligonucleotide
taccccgccgccaatgtctcctgactcatttctcg

SEQ ID NO: 4937 - DNA, 35 bp, Artificial Sequence
  Synthetic oligonucleotide
gccgcacccgaccacctctcactggcccttaggcg

SEQ ID NO: 4938 - DNA, 37 bp, Artificial Sequence
  Synthetic oligonucleotide
gactctcacaagctgaacttatgcccgtttccaccga

SEQ ID NO: 4939 - DNA, 35 bp, Artificial Sequence
  Synthetic oligonucleotide
atcgacccctctctgcattagcaatcgttacaacg

SEQ ID NO: 4940 - DNA, 35 bp, Artificial Sequence
  Synthetic oligonucleotide
agaccccgcacctggtcgcgcatttcacccacacg

SEQ ID NO: 4941 - DNA, 35 bp, Artificial Sequence
  Synthetic oligonucleotide
actacgcgccattggcttatctttcgcttccatgt

SEQ ID NO: 4942 - DNA, 35 bp, Artificial Sequence
  Synthetic oligonucleotide
accccaaccgaagccgttccagcgcatgctcattc

SEQ ID NO: 4943 - DNA, 36 bp, Artificial Sequence
  Synthetic oligonucleotide
tgacccccccgacttcacagcggaccatcgaaccga

SEQ ID NO: 4944 - DNA, 35 bp, Artificial Sequence
  Synthetic oligonucleotide
accccctggtccacacgctctatcttctacgctaa

SEQ ID NO: 4945 - DNA, 35 bp, Artificial Sequence
  Synthetic oligonucleotide
gccacacacccgcacccaatatgtttacgtatctc

SEQ ID NO: 4946 - DNA, 36 bp, Artificial Sequence
  Synthetic oligonucleotide
tccacgcccacggtctgttctcgccctatttgctga

SEQ ID NO: 4947 - DNA, 37 bp, Artificial Sequence
  Synthetic oligonucleotide
gattgcccccgtgactataccatctccctgttttcga

SEQ ID NO: 4948 - DNA, 35 bp, Artificial Sequence
  Synthetic oligonucleotide
accccgccaacattcgtagtagcactccttcgacc

SEQ ID NO: 4949 - DNA, 35 bp, Artificial Sequence
  Synthetic oligonucleotide
tccatccgctcctctccaaatgcgttctacacttg

SEQ ID NO: 4950 - DNA, 35 bp, Artificial Sequence
  Synthetic oligonucleotide
agacgctcagcagcccaattcgccatccccgctca

SEQ ID NO: 4951 - DNA, 38 bp, Artificial Sequence
  Synthetic oligonucleotide
agtcccaccatctgttcctcggctcttgccgatcttga

SEQ ID NO: 4952 - DNA, 35 bp, Artificial Sequence
  Synthetic oligonucleotide
gttccaccgacccgcctgacctcacttatcgcgat

SEQ ID NO: 4953 - DNA, 38 bp, Artificial Sequence
  Synthetic oligonucleotide
gtctgccctcgcaatcctaggagcctcttttcacctga

SEQ ID NO: 4954 - DNA, 35 bp, Artificial Sequence
  Synthetic oligonucleotide
gatacctccgcgggcctctgctacattcgcttcac

SEQ ID NO: 4955 - DNA, 35 bp, Artificial Sequence
  Synthetic oligonucleotide
tgttgtggcctgttgtcttccacgtttgccctgtt

SEQ ID NO: 4956 - DNA, 36 bp, Artificial Sequence
  Synthetic oligonucleotide
gcgacctcccgccgacttgctccattagttgccaaa

SEQ ID NO: 4957 - DNA, 35 bp, Artificial Sequence
  Synthetic oligonucleotide
atccgcccagctctccaggtcacctctttagtcct

SEQ ID NO: 4958 - DNA, 33 bp, Artificial Sequence
  Synthetic oligonucleotide
gagacgcggcccgctttcacttgcgccgttccc

SEQ ID NO: 4959 - DNA, 33 bp, Artificial Sequence
  Synthetic oligonucleotide
tccatcctgtacgtccccctttggtccagaacc

SEQ ID NO: 4960 - DNA, 35 bp, Artificial Sequence
  Synthetic oligonucleotide
ttgagctcaccttccttattgtggccactctttgt

SEQ ID NO: 4961 - DNA, 35 bp, Artificial Sequence
  Synthetic oligonucleotide
gaccctccgcccttaccgcttcataaaagtcgttc

SEQ ID NO: 4962 - DNA, 35 bp, Artificial Sequence
  Synthetic oligonucleotide
cattcgtggcgtagtaatcgccttgattccaccaa

SEQ ID NO: 4963 - DNA, 36 bp, Artificial Sequence
  Synthetic oligonucleotide
acgtccaccgcagctggaattccgtcatctccgtca

SEQ ID NO: 4964 - DNA, 35 bp, Artificial Sequence
  Synthetic oligonucleotide
tctcgacgtagcatgagcctcattccgcattccca

SEQ ID NO: 4965 - DNA, 37 bp, Artificial Sequence
  Synthetic oligonucleotide
tttaccctcgcccgccacatcggttcagcctcttgga

SEQ ID NO: 4966 - DNA, 35 bp, Artificial Sequence
  Synthetic oligonucleotide
gtccccaagccccgactatggattacacaacccac

SEQ ID NO: 4967 - DNA, 38 bp, Artificial Sequence
  Synthetic oligonucleotide
tgcatacctctgccctggccctctacactgttacatga

SEQ ID NO: 4968 - DNA, 37 bp, Artificial Sequence
  Synthetic oligonucleotide
ttgcgcacccttccgatctgctaagcagctattgtga

SEQ ID NO: 4969 - DNA, 35 bp, Artificial Sequence
  Synthetic oligonucleotide
acatccttgccgtgcagtctattaccgactacccc

SEQ ID NO: 4970 - DNA, 35 bp, Artificial Sequence
  Synthetic oligonucleotide
tccacccgaagcactctgccgcgcccccccgtaca

SEQ ID NO: 4971 - DNA, 36 bp, Artificial Sequence
  Synthetic oligonucleotide
tcaggacacttggcctgtacactgaacctctttaca

SEQ ID NO: 4972 - DNA, 36 bp, Artificial Sequence
  Synthetic oligonucleotide
tcaccgaccgtgatctaataccagcatctcccccca

SEQ ID NO: 4973 - DNA, 37 bp, Artificial Sequence
  Synthetic oligonucleotide
gatgcgccgacgcccttcatcctgccacagcttttga

SEQ ID NO: 4974 - DNA, 37 bp, Artificial Sequence
  Synthetic oligonucleotide
attgtcaccgcccgctttcataacatcctggccttga

SEQ ID NO: 4975 - DNA, 35 bp, Artificial Sequence
  Synthetic oligonucleotide
gccgattcacatccccgtctggcctcctgttgcac

SEQ ID NO: 4976 - DNA, 35 bp, Artificial Sequence
  Synthetic oligonucleotide
atcatcctcgcactgcgatggtccgtacttgccct

SEQ ID NO: 4977 - DNA, 36 bp, Artificial Sequence
  Synthetic oligonucleotide
accaccccactcgctaaacacaccgacggtctatca

SEQ ID NO: 4978 - DNA, 35 bp, Artificial Sequence
  Synthetic oligonucleotide
taggatcggcccatcccgtacctcatttgaccctc

SEQ ID NO: 4979 - DNA, 38 bp, Artificial Sequence
  Synthetic oligonucleotide
tctcacacgcctccttcccccgtacagctacagtttga

SEQ ID NO: 4980 - DNA, 35 bp, Artificial Sequence
  Synthetic oligonucleotide
gcaccgcctcctcgtttcctcgtttggcacgtacc

SEQ ID NO: 4981 - DNA, 30 bp, Artificial Sequence
  Synthetic oligonucleotide
gacaaccccctcattcaaccggcctggtac

SEQ ID NO: 4982 - DNA, 35 bp, Artificial Sequence
  Synthetic oligonucleotide
gaaggaagggaggaaaggtgggcaagaaaagcggt

SEQ ID NO: 4983 - DNA, 35 bp, Artificial Sequence
  Synthetic oligonucleotide
ggactacgcacggtcgccccttcatttccacgtcc

SEQ ID NO: 4984 - DNA, 35 bp, Artificial Sequence
  Synthetic oligonucleotide
gccactcgaactgcttacactaatgcctccgctta

SEQ ID NO: 4985 - DNA, 37 bp, Artificial Sequence
  Synthetic oligonucleotide
gacggggtggtggcatagtaaaaagggagggcgggga

SEQ ID NO: 4986 - DNA, 35 bp, Artificial Sequence
  Synthetic oligonucleotide
tgcccctgcacctctgtttacggtttcattcggtc

SEQ ID NO: 4987 - DNA, 35 bp, Artificial Sequence
  Synthetic oligonucleotide
gtgatcctgcctcgttcgcttattctgtaccatgc

SEQ ID NO: 4988 - DNA, 36 bp, Artificial Sequence
  Synthetic oligonucleotide
gtatcatccaccactgcgtatatgtgccctgcccaa

SEQ ID NO: 4989 - DNA, 33 bp, Artificial Sequence
  Synthetic oligonucleotide
tcttgcccatctacattcgactcctctgtaacg

SEQ ID NO: 4990 - DNA, 35 bp, Artificial Sequence
  Synthetic oligonucleotide
gatgttcggccccataccatgcactgctcctgcct

SEQ ID NO: 4991 - DNA, 37 bp, Artificial Sequence
  Synthetic oligonucleotide
gcacgcatgtgcgcgcccccaactcaactacttctga

SEQ ID NO: 4992 - DNA, 37 bp, Artificial Sequence
  Synthetic oligonucleotide
gagagggagggcgataggagaggagtgaggtacaaga

SEQ ID NO: 4993 - DNA, 35 bp, Artificial Sequence
  Synthetic oligonucleotide
aataacgggtgggagggggtcaaggggggatctac

SEQ ID NO: 4994 - DNA, 35 bp, Artificial Sequence
  Synthetic oligonucleotide
atccttccacgtcaccgcactgcctgaccccaaca

SEQ ID NO: 4995 - DNA, 35 bp, Artificial Sequence
  Synthetic oligonucleotide
gagtgagagggcgggtgggatcattggtgagggtg

SEQ ID NO: 4996 - DNA, 35 bp, Artificial Sequence
  Synthetic oligonucleotide
gtgcatcccaccaaccctagccagacctgtacgct

SEQ ID NO: 4997 - DNA, 36 bp, Artificial Sequence
  Synthetic oligonucleotide
gccacagtactggctcgtttactttttacaccttga

SEQ ID NO: 4998 - DNA, 36 bp, Artificial Sequence
  Synthetic oligonucleotide
acgtgccacagcttgcgcatcactcacccccttgca

SEQ ID NO: 4999 - DNA, 35 bp, Artificial Sequence
  Synthetic oligonucleotide
gcggaggggcgggaggggagggaaacgatgcgacc

SEQ ID NO: 5000 - DNA, 38 bp, Artificial Sequence
  Synthetic oligonucleotide
gatagccgcagcctttgcaactccacactggcctttga

SEQ ID NO: 5001 - DNA, 35 bp, Artificial Sequence
  Synthetic oligonucleotide
gtctccgccttacacacagtgctgttcgtacctcc

SEQ ID NO: 5002 - DNA, 35 bp, Artificial Sequence
  Synthetic oligonucleotide
gccacacctacgttactccgggtttcatgtttcac

SEQ ID NO: 5003 - DNA, 35 bp, Artificial Sequence
  Synthetic oligonucleotide
gctgtactaccacatctgtctctatgcaaaccgac

SEQ ID NO: 5004 - DNA, 35 bp, Artificial Sequence
  Synthetic oligonucleotide
ggaaaaaggagaggtagggaatggacaagaataag

SEQ ID NO: 5005 - DNA, 35 bp, Artificial Sequence
  Synthetic oligonucleotide
gccccgccttcaactttcctgctacgtacgctgcc

SEQ ID NO: 5006 - DNA, 36 bp, Artificial Sequence
  Synthetic oligonucleotide
tgctcctgccgccgatcgttcccatctgcagcccca

SEQ ID NO: 5007 - DNA, 36 bp, Artificial Sequence
  Synthetic oligonucleotide
ggataccccgcctcgttttggccctcctcgttttca

SEQ ID NO: 5008 - DNA, 37 bp, Artificial Sequence
  Synthetic oligonucleotide
tccaccaccacaccatgctaagcacgctaactagtga

SEQ ID NO: 5009 - DNA, 35 bp, Artificial Sequence
  Synthetic oligonucleotide
gtccaccgaccttctctacagcccgcacggttttt

SEQ ID NO: 5010 - DNA, 36 bp, Artificial Sequence
  Synthetic oligonucleotide
tcatgatccccggtgccgtatcctgtagacctctcc

SEQ ID NO: 5011 - DNA, 35 bp, Artificial Sequence
  Synthetic oligonucleotide
acagccataccatctcgaccgtgacccgttccagg

SEQ ID NO: 5012 - DNA, 35 bp, Artificial Sequence
  Synthetic oligonucleotide
gtacacccgtgctttcacccttcgacccccatgga

SEQ ID NO: 5013 - DNA, 37 bp, Artificial Sequence
  Synthetic oligonucleotide
tgagggtgggacggtgactagggggtgggcgaagcga

SEQ ID NO: 5014 - DNA, 37 bp, Artificial Sequence
  Synthetic oligonucleotide
gtcccccacccctcagccgtgtcctcgcgtctctcga

SEQ ID NO: 5015 - DNA, 35 bp, Artificial Sequence
  Synthetic oligonucleotide
gactcgtcctgcacccatctgcacttacttgaccg

SEQ ID NO: 5016 - DNA, 35 bp, Artificial Sequence
  Synthetic oligonucleotide
aacccccggtcaggtttactacacgcccccccgac

SEQ ID NO: 5017 - DNA, 35 bp, Artificial Sequence
  Synthetic oligonucleotide
ggggcctgccacgtgttccctgctcccattccgcc

SEQ ID NO: 5018 - DNA, 36 bp, Artificial Sequence
  Synthetic oligonucleotide
gccccaatcggcacacgtggccaaatcctctactca

SEQ ID NO: 5019 - DNA, 37 bp, Artificial Sequence
  Synthetic oligonucleotide
gcaacacatgtaggagggggggtggaaacggctggga

SEQ ID NO: 5020 - DNA, 37 bp, Artificial Sequence
  Synthetic oligonucleotide
tgtccgctcagcactgccactgtgccaccccaactga

SEQ ID NO: 5021 - DNA, 38 bp, Artificial Sequence
  Synthetic oligonucleotide
atgtcacaccccagtgctgaagtttttgccacccttga

SEQ ID NO: 5022 - DNA, 36 bp, Artificial Sequence
  Synthetic oligonucleotide
aaccttcgcctgtcccgttcaatgaagccaatttga

SEQ ID NO: 5023 - DNA, 35 bp, Artificial Sequence
  Synthetic oligonucleotide
tacacaccgcccactactccccaattcgttggtgc

SEQ ID NO: 5024 - DNA, 36 bp, Artificial Sequence
  Synthetic oligonucleotide
gaaacacaggggagggttaggtggcggataggcgga

SEQ ID NO: 5025 - DNA, 36 bp, Artificial Sequence
  Synthetic oligonucleotide
tcaccatgctcccattctaccagtcacagtgcaaca

SEQ ID NO: 5026 - DNA, 35 bp, Artificial Sequence
  Synthetic oligonucleotide
agctgcccacctcttgttcattggtaaccgctctc

SEQ ID NO: 5027 - DNA, 36 bp, Artificial Sequence
  Synthetic oligonucleotide
tcaccctccgccctgtctcaacaatatcagtcctca

SEQ ID NO: 5028 - DNA, 35 bp, Artificial Sequence
  Synthetic oligonucleotide
gcctccccgccggacataacacaaacattccattt

SEQ ID NO: 5029 - DNA, 35 bp, Artificial Sequence
  Synthetic oligonucleotide
acgccgactcgaccttattgtctctctccacctgt

SEQ ID NO: 5030 - DNA, 38 bp, Artificial Sequence
  Synthetic oligonucleotide
tagcgcccaatccgaagtgcccactatgccctcgttga

SEQ ID NO: 5031 - DNA, 35 bp, Artificial Sequence
  Synthetic oligonucleotide
accacggccacatctaatatcagtccccacgcgcc

SEQ ID NO: 5032 - DNA, 35 bp, Artificial Sequence
  Synthetic oligonucleotide
tgcacactgaagctcccgggacatccttccccacc

SEQ ID NO: 5033 - DNA, 35 bp, Artificial Sequence
  Synthetic oligonucleotide
tatggctagtcatccccgctgtcctatcgtactcc

SEQ ID NO: 5034 - DNA, 35 bp, Artificial Sequence
  Synthetic oligonucleotide
gatggctctccggtgcactatccccgaccgtatcc

SEQ ID NO: 5035 - DNA, 35 bp, Artificial Sequence
  Synthetic oligonucleotide
gcacaccacggcccctttaggcaaccccttttctc

SEQ ID NO: 5036 - DNA, 36 bp, Artificial Sequence
  Synthetic oligonucleotide
tacagcccctgctgcatgaactcaatctccctggaa

SEQ ID NO: 5037 - DNA, 38 bp, Artificial Sequence
  Synthetic oligonucleotide
agtgcgggcgcaactcctcgtaaacctgccactcctga

SEQ ID NO: 5038 - DNA, 35 bp, Artificial Sequence
  Synthetic oligonucleotide
gaccatcactatgtctccgaaccacctataagcca

SEQ ID NO: 5039 - DNA, 35 bp, Artificial Sequence
  Synthetic oligonucleotide
tccgacctgccctccgcggactaattatatgctat

SEQ ID NO: 5040 - DNA, 35 bp, Artificial Sequence
  Synthetic oligonucleotide
gcctcccaccgccgttttacttactgctagcttgg

SEQ ID NO: 5041 - DNA, 35 bp, Artificial Sequence
  Synthetic oligonucleotide
atccgggccggccttgctaccttcaccgttacaaa

SEQ ID NO: 5042 - DNA, 37 bp, Artificial Sequence
  Synthetic oligonucleotide
gaagccagagtccgacttatccatgcaccacctacga

SEQ ID NO: 5043 - DNA, 35 bp, Artificial Sequence
  Synthetic oligonucleotide
tcactcctcactgctactgttgttcggctcgaacc

SEQ ID NO: 5044 - DNA, 35 bp, Artificial Sequence
  Synthetic oligonucleotide
tgcccgccctcgcatgccgctatctagtcttaatc

SEQ ID NO: 5045 - DNA, 35 bp, Artificial Sequence
  Synthetic oligonucleotide
tgtcctccacctgccttgtgcacgccctattaaat

SEQ ID NO: 5046 - DNA, 35 bp, Artificial Sequence
  Synthetic oligonucleotide
tgaactacacgcctcagcttcggtcctctccattt

SEQ ID NO: 5047 - DNA, 35 bp, Artificial Sequence
  Synthetic oligonucleotide
gcaccactcacacagcaccctatgccgcacgcaaa

SEQ ID NO: 5048 - DNA, 36 bp, Artificial Sequence
  Synthetic oligonucleotide
gactgaggagggaggggcacggcggaacgggacgcg

SEQ ID NO: 5049 - DNA, 35 bp, Artificial Sequence
  Synthetic oligonucleotide
ttgtcgggcccccacatgccagactgccttattcc

SEQ ID NO: 5050 - DNA, 38 bp, Artificial Sequence
  Synthetic oligonucleotide
tcgtagccacatacccaatggtacttccaccctgctga

SEQ ID NO: 5051 - DNA, 37 bp, Artificial Sequence
  Synthetic oligonucleotide
tccgcaaccctcccatgataacgccctatccgcctga

SEQ ID NO: 5052 - DNA, 36 bp, Artificial Sequence
  Synthetic oligonucleotide
tcagccaggaccgatccctctctacgcgcactccca

SEQ ID NO: 5053 - DNA, 35 bp, Artificial Sequence
  Synthetic oligonucleotide
taacccgcagcctacgatcacccccgccctgcctg

SEQ ID NO: 5054 - DNA, 35 bp, Artificial Sequence
  Synthetic oligonucleotide
gaccagcacagcgcgctcccttcgaatcatgcata

SEQ ID NO: 5055 - DNA, 35 bp, Artificial Sequence
  Synthetic oligonucleotide
gactcaccaccggatcgaccccgataatgtcccct

SEQ ID NO: 5056 - DNA, 35 bp, Artificial Sequence
  Synthetic oligonucleotide
gccacctgccttttgtaggacctcttctgacccgt

SEQ ID NO: 5057 - DNA, 35 bp, Artificial Sequence
  Synthetic oligonucleotide
gccccgaggtcacatcatctagtttcctgctcgcc

SEQ ID NO: 5058 - DNA, 37 bp, Artificial Sequence
  Synthetic oligonucleotide
gcgaggagaggaagggagaagggattacaagtcggga

SEQ ID NO: 5059 - DNA, 36 bp, Artificial Sequence
  Synthetic oligonucleotide
tactgtcgaggtcgacgcctcccacacacttaccta

SEQ ID NO: 5060 - DNA, 35 bp, Artificial Sequence
  Synthetic oligonucleotide
gttcccccacgcctgtcccatttgttgtgccccca

SEQ ID NO: 5061 - DNA, 35 bp, Artificial Sequence
  Synthetic oligonucleotide
gtagaagggtggtcgggagggggcaagactcgggg

SEQ ID NO: 5062 - DNA, 35 bp, Artificial Sequence
  Synthetic oligonucleotide
acctggcccacgggcactctgtactacattttatc

SEQ ID NO: 5063 - DNA, 36 bp, Artificial Sequence
  Synthetic oligonucleotide
gtctcgagccaccgctgccgtactattcccgctata

SEQ ID NO: 5064 - DNA, 35 bp, Artificial Sequence
  Synthetic oligonucleotide
agtgtgcaccccctgacctcagtgaccgcccctcc

SEQ ID NO: 5065 - DNA, 37 bp, Artificial Sequence
  Synthetic oligonucleotide
tgcaacctcctgcactcactgtcacccggcttttcga

SEQ ID NO: 5066 - DNA, 38 bp, Artificial Sequence
  Synthetic oligonucleotide
gcaacgtgcggactgcctaacaaccccaagcctcctga

SEQ ID NO: 5067 - DNA, 35 bp, Artificial Sequence
  Synthetic oligonucleotide
tctaaggccaactgccatcatgtatctgtcctgct

SEQ ID NO: 5068 - DNA, 36 bp, Artificial Sequence
  Synthetic oligonucleotide
taacacctccgaaatctgcgaccctgcctcgacgca

SEQ ID NO: 5069 - DNA, 35 bp, Artificial Sequence
  Synthetic oligonucleotide
tcgatcaccaccccagctcgcgactacatagtccc

SEQ ID NO: 5070 - DNA, 35 bp, Artificial Sequence
  Synthetic oligonucleotide
gaatccgctcaggattcgctttactacctgttaat

SEQ ID NO: 5071 - DNA, 35 bp, Artificial Sequence
  Synthetic oligonucleotide
caaagggcacctccacccacagctctcgccggcct

SEQ ID NO: 5072 - DNA, 38 bp, Artificial Sequence
  Synthetic oligonucleotide
tcctctccaccgtcctgttgcacacctgttctgcgtga

SEQ ID NO: 5073 - DNA, 36 bp, Artificial Sequence
  Synthetic oligonucleotide
atcacctgtccgtggtcccgcgcctctcctttacta

SEQ ID NO: 5074 - DNA, 35 bp, Artificial Sequence
  Synthetic oligonucleotide
aacctcccatcacgtccagcacctctgtcttgaat

SEQ ID NO: 5075 - DNA, 35 bp, Artificial Sequence
  Synthetic oligonucleotide
gccgattcgccaccgctgtgccgcaacaccacttc

SEQ ID NO: 5076 - DNA, 36 bp, Artificial Sequence
  Synthetic oligonucleotide
gcactggggccggaaagggaaagaaggcgggtggga

SEQ ID NO: 5077 - DNA, 34 bp, Artificial Sequence
  Synthetic oligonucleotide
gaacgcccatccgctcttctcagactgccgttgg

SEQ ID NO: 5078 - DNA, 35 bp, Artificial Sequence
  Synthetic oligonucleotide
taaccatccatcgatctgctcaagcccctcgctca

SEQ ID NO: 5079 - DNA, 35 bp, Artificial Sequence
  Synthetic oligonucleotide
agcaccatgccccgttcttcgtctttttgctcatg

SEQ ID NO: 5080 - DNA, 36 bp, Artificial Sequence
  Synthetic oligonucleotide
tcgacaaccgtcgagcgaaatccgtccatcaccaca

SEQ ID NO: 5081 - DNA, 35 bp, Artificial Sequence
  Synthetic oligonucleotide
accgcctcaggccctcctgtaccctgagcctatcc

SEQ ID NO: 5082 - DNA, 35 bp, Artificial Sequence
  Synthetic oligonucleotide
gccaagggcggtgacttcctggcaacacattcttc

SEQ ID NO: 5083 - DNA, 34 bp, Artificial Sequence
  Synthetic oligonucleotide
gtgcacgcaggcttttgccccacccgccacacaa

SEQ ID NO: 5084 - DNA, 37 bp, Artificial Sequence
  Synthetic oligonucleotide
agggtggggagcatatgatggggacaggttatgggga

SEQ ID NO: 5085 - DNA, 35 bp, Artificial Sequence
  Synthetic oligonucleotide
taggcactgtactgcctcattgttccaacctgctc

SEQ ID NO: 5086 - DNA, 36 bp, Artificial Sequence
  Synthetic oligonucleotide
gccatctccgagcctgttttgatcctgatacttcga

SEQ ID NO: 5087 - DNA, 35 bp, Artificial Sequence
  Synthetic oligonucleotide
ttccacgcccgtccacacgcattttcaggtccgca

SEQ ID NO: 5088 - DNA, 35 bp, Artificial Sequence
  Synthetic oligonucleotide
ttcgtgggacccatctcgtttattgcctagcctct

SEQ ID NO: 5089 - DNA, 35 bp, Artificial Sequence
  Synthetic oligonucleotide
gtccgcatcgtccgtcggtccctgttcctttgtcc

SEQ ID NO: 5090 - DNA, 36 bp, Artificial Sequence
  Synthetic oligonucleotide
gacactcacgaaccctttaatgcatgcccgttcccg

SEQ ID NO: 5091 - DNA, 38 bp, Artificial Sequence
  Synthetic oligonucleotide
aaccaccatcactgcccgcaagacacaggtcgttttga

SEQ ID NO: 5092 - DNA, 35 bp, Artificial Sequence
  Synthetic oligonucleotide
acaacccgcatggactcgcttatttctttctgtgc

SEQ ID NO: 5093 - DNA, 35 bp, Artificial Sequence
  Synthetic oligonucleotide
tcgctcctcaccacctcaagttcatcggacacacc

SEQ ID NO: 5094 - DNA, 35 bp, Artificial Sequence
  Synthetic oligonucleotide
agccacctgttagaccactccccacccacttgtcg

SEQ ID NO: 5095 - DNA, 36 bp, Artificial Sequence
  Synthetic oligonucleotide
agaccgactgcccgtctccccagcatatcccctgca

SEQ ID NO: 5096 - DNA, 38 bp, Artificial Sequence
  Synthetic oligonucleotide
accacgcgccacgttttctcaccctccatgcactttga

SEQ ID NO: 5097 - DNA, 35 bp, Artificial Sequence
  Synthetic oligonucleotide
acccgctgacgactgctctagtcactcgcccttct

SEQ ID NO: 5098 - DNA, 37 bp, Artificial Sequence
  Synthetic oligonucleotide
acgccactggctccttcttatcgtcgtcgacctttga

SEQ ID NO: 5099 - DNA, 35 bp, Artificial Sequence
  Synthetic oligonucleotide
gtgagtggagggacgggtgggcgtgagagggagaa

SEQ ID NO: 5100 - DNA, 35 bp, Artificial Sequence
  Synthetic oligonucleotide
tgaaaccgcacatccatgcgtacttcaccttggtc

SEQ ID NO: 5101 - DNA, 35 bp, Artificial Sequence
  Synthetic oligonucleotide
gtctgaccgccgactcattcctatgcgatcctcgc

SEQ ID NO: 5102 - DNA, 35 bp, Artificial Sequence
  Synthetic oligonucleotide
tcaccaccttacttactgccaccttgcatgcccag

SEQ ID NO: 5103 - DNA, 35 bp, Artificial Sequence
  Synthetic oligonucleotide
gtcccagcctccaatatacccggcccctattcgcg

SEQ ID NO: 5104 - DNA, 35 bp, Artificial Sequence
  Synthetic oligonucleotide
tatgtgtgccttccatctctatctcaccgcatgtg

SEQ ID NO: 5105 - DNA, 35 bp, Artificial Sequence
  Synthetic oligonucleotide
acaccactgactcatgctttatttcatgttaaccc

SEQ ID NO: 5106 - DNA, 38 bp, Artificial Sequence
  Synthetic oligonucleotide
gcacatctatgccagcctgcatcccgacctgcccgtga

SEQ ID NO: 5107 - DNA, 35 bp, Artificial Sequence
  Synthetic oligonucleotide
tatggctcgccgttattgctctctcgcctcgctcc

SEQ ID NO: 5108 - DNA, 35 bp, Artificial Sequence
  Synthetic oligonucleotide
acctccagtcccctccatggtctgtcctattgatc

SEQ ID NO: 5109 - DNA, 37 bp, Artificial Sequence
  Synthetic oligonucleotide
aaagaggtgaggaaggcgataggggcgaagttacgga

SEQ ID NO: 5110 - DNA, 35 bp, Artificial Sequence
  Synthetic oligonucleotide
tccacaccaggactatccccttcgctctggaactc

SEQ ID NO: 5111 - DNA, 35 bp, Artificial Sequence
  Synthetic oligonucleotide
atccactccccattttgcttacccgatgagacgat

SEQ ID NO: 5112 - DNA, 35 bp, Artificial Sequence
  Synthetic oligonucleotide
acccaccagacggagtcctaccacccctttaaggc

SEQ ID NO: 5113 - DNA, 37 bp, Artificial Sequence
  Synthetic oligonucleotide
acaacgtccgccctccacctgagcgcctcctgaatga

SEQ ID NO: 5114 - DNA, 35 bp, Artificial Sequence
  Synthetic oligonucleotide
catcatcttgcaggctccaggttcgcctcatgtct

SEQ ID NO: 5115 - DNA, 38 bp, Artificial Sequence
  Synthetic oligonucleotide
tatccttgccactgttatacgccacctctgcctcatga

SEQ ID NO: 5116 - DNA, 35 bp, Artificial Sequence
  Synthetic oligonucleotide
agcatcaccatttcccctcacatacacgagtgccc

SEQ ID NO: 5117 - DNA, 35 bp, Artificial Sequence
  Synthetic oligonucleotide
atgcccggagccatggccagcaactctcccgaatc

SEQ ID NO: 5118 - DNA, 37 bp, Artificial Sequence
  Synthetic oligonucleotide
gatgaccgaggtaggagggtcgcaattgagggaggga

SEQ ID NO: 5119 - DNA, 35 bp, Artificial Sequence
  Synthetic oligonucleotide
tcacaagccgccttgtccgagttacccctcccact

SEQ ID NO: 5120 - DNA, 35 bp, Artificial Sequence
  Synthetic oligonucleotide
actccattcctgctgttttaccgtattctgcttac

SEQ ID NO: 5121 - DNA, 36 bp, Artificial Sequence
  Synthetic oligonucleotide
gtcgcaccgctttcgccacttccagtccttccgcca

SEQ ID NO: 5122 - DNA, 37 bp, Artificial Sequence
  Synthetic oligonucleotide
taccgaacagcagtgggggcggacgggggtggaggga

SEQ ID NO: 5123 - DNA, 38 bp, Artificial Sequence
  Synthetic oligonucleotide
tagcactccagccatctactacccaccactgaccatga

SEQ ID NO: 5124 - DNA, 36 bp, Artificial Sequence
  Synthetic oligonucleotide
gtcaccccacagtgctttttgtcatctcgtacctaa

SEQ ID NO: 5125 - DNA, 37 bp, Artificial Sequence
  Synthetic oligonucleotide
agcaaccccctctgctgtacagtacctccttctccga

SEQ ID NO: 5126 - DNA, 35 bp, Artificial Sequence
  Synthetic oligonucleotide
gtgtaacacccccgtgatcaatgtcgcttctttcc

SEQ ID NO: 5127 - DNA, 36 bp, Artificial Sequence
  Synthetic oligonucleotide
aatgcaatggggggggacgggagacgagggggagca

SEQ ID NO: 5128 - DNA, 36 bp, Artificial Sequence
  Synthetic oligonucleotide
gaagcaggagggaaaaggcggattaaaaaaaggtga

SEQ ID NO: 5129 - DNA, 35 bp, Artificial Sequence
  Synthetic oligonucleotide
ttccacccctgataggcagagtaccgcgccaacac

SEQ ID NO: 5130 - DNA, 35 bp, Artificial Sequence
  Synthetic oligonucleotide
gacgccccatccactcgagccctcaatgtctaata

SEQ ID NO: 5131 - DNA, 35 bp, Artificial Sequence
  Synthetic oligonucleotide
gcacctcgccgcctacatcctttccgactggatag

SEQ ID NO: 5132 - DNA, 35 bp, Artificial Sequence
  Synthetic oligonucleotide
tatcccgcccccagagtcgagcctagccttccctt

SEQ ID NO: 5133 - DNA, 35 bp, Artificial Sequence
  Synthetic oligonucleotide
atgactccactccattctaacatgggacactggtc

SEQ ID NO: 5134 - DNA, 37 bp, Artificial Sequence
  Synthetic oligonucleotide
agtccacgcatcgaatatctcgctctgcccttctgga

SEQ ID NO: 5135 - DNA, 37 bp, Artificial Sequence
  Synthetic oligonucleotide
tgagggatggagggtgaggtaagggttggtgaatcga

SEQ ID NO: 5136 - DNA, 35 bp, Artificial Sequence
  Synthetic oligonucleotide
aaaaccgtgggggaggggccgggggtggacttgtg

SEQ ID NO: 5137 - DNA, 36 bp, Artificial Sequence
  Synthetic oligonucleotide
acgcactcccaattactatcactggctgttccgaca

SEQ ID NO: 5138 - DNA, 35 bp, Artificial Sequence
  Synthetic oligonucleotide
accaatgctacgtacatcgtgctgccccgttctcc

SEQ ID NO: 5139 - DNA, 35 bp, Artificial Sequence
  Synthetic oligonucleotide
gcccacccgcacgacccgccgagtagcaccttgcg

SEQ ID NO: 5140 - DNA, 35 bp, Artificial Sequence
  Synthetic oligonucleotide
tcaagcccgccgacgattccctacctatgtccgac

SEQ ID NO: 5141 - DNA, 35 bp, Artificial Sequence
  Synthetic oligonucleotide
tacactgcccgctcccgagtcccagactgctaatc

SEQ ID NO: 5142 - DNA, 36 bp, Artificial Sequence
  Synthetic oligonucleotide
tagtagcgccatccatcgtcccctccgagcttctga

SEQ ID NO: 5143 - DNA, 35 bp, Artificial Sequence
  Synthetic oligonucleotide
tccgcccggactttaaccttgacccaccgctttgc

SEQ ID NO: 5144 - DNA, 35 bp, Artificial Sequence
  Synthetic oligonucleotide
gagtgcagactgttcgccgcgcaccattgcctatc

SEQ ID NO: 5145 - DNA, 35 bp, Artificial Sequence
  Synthetic oligonucleotide
tgtccattcgatcctggtactacactccctctgac

SEQ ID NO: 5146 - DNA, 38 bp, Artificial Sequence
  Synthetic oligonucleotide
tccacagccctgcctttcgcccacgctctcgcacatga

SEQ ID NO: 5147 - DNA, 35 bp, Artificial Sequence
  Synthetic oligonucleotide
acatcatactccaccgccgaccagttaagccgcct

SEQ ID NO: 5148 - DNA, 35 bp, Artificial Sequence
  Synthetic oligonucleotide
gtaccaccctcatcccagaaactgtagtgacccct

SEQ ID NO: 5149 - DNA, 35 bp, Artificial Sequence
  Synthetic oligonucleotide
gtcgccccatccatctactcgttccaactttgacg

SEQ ID NO: 5150 - DNA, 35 bp, Artificial Sequence
  Synthetic oligonucleotide
ataacgagatgggggggtgggaggtggtaaactga

SEQ ID NO: 5151 - DNA, 38 bp, Artificial Sequence
  Synthetic oligonucleotide
gagtacgcaaggggggggtgatggggatgaagttgtga

SEQ ID NO: 5152 - DNA, 35 bp, Artificial Sequence
  Synthetic oligonucleotide
gcccctgcctccaaacgcctgcatacaactcgtgt

SEQ ID NO: 5153 - DNA, 37 bp, Artificial Sequence
  Synthetic oligonucleotide
gcaaagggcaggtaggaacaggagggcggtagagtga

SEQ ID NO: 5154 - DNA, 35 bp, Artificial Sequence
  Synthetic oligonucleotide
gctacgccccctcacccgtaagccggtacctaatc

SEQ ID NO: 5155 - DNA, 35 bp, Artificial Sequence
  Synthetic oligonucleotide
agatcaccgccgccttcatgactcttgcgtaattc

SEQ ID NO: 5156 - DNA, 35 bp, Artificial Sequence
  Synthetic oligonucleotide
gatgtactgctcgcttttctcatgtgtcgttccat

SEQ ID NO: 5157 - DNA, 35 bp, Artificial Sequence
  Synthetic oligonucleotide
gccgcctatcaattgctctttccctgcgttatacc

SEQ ID NO: 5158 - DNA, 35 bp, Artificial Sequence
  Synthetic oligonucleotide
gatgaggtaggaagggaaaatgtgcgtgctatggg

SEQ ID NO: 5159 - DNA, 35 bp, Artificial Sequence
  Synthetic oligonucleotide
tgacccctccagaaatcgccgcagaattccaactc

SEQ ID NO: 5160 - DNA, 35 bp, Artificial Sequence
  Synthetic oligonucleotide
aagagcacactgcgccaaatctccacgcctacacc

SEQ ID NO: 5161 - DNA, 36 bp, Artificial Sequence
  Synthetic oligonucleotide
ttcatccgcaacactcgtactcgtgacctacacgca

SEQ ID NO: 5162 - DNA, 35 bp, Artificial Sequence
  Synthetic oligonucleotide
tcacaccctactgctacccagccccaataactggc

SEQ ID NO: 5163 - DNA, 35 bp, Artificial Sequence
  Synthetic oligonucleotide
tgcatcagccagacaatacccgggccattctctca

SEQ ID NO: 5164 - DNA, 36 bp, Artificial Sequence
  Synthetic oligonucleotide
tacatgcccaggctcttcaccacttcccgctcgcaa

SEQ ID NO: 5165 - DNA, 36 bp, Artificial Sequence
  Synthetic oligonucleotide
caaatgcatccgcaccatcgtttggcctttcattga

SEQ ID NO: 5166 - DNA, 35 bp, Artificial Sequence
  Synthetic oligonucleotide
acgcaaagcactcggtaacacgcgcttctctttcc

SEQ ID NO: 5167 - DNA, 35 bp, Artificial Sequence
  Synthetic oligonucleotide
acccacatgccacgatccgatccgcttggctccac

SEQ ID NO: 5168 - DNA, 36 bp, Artificial Sequence
  Synthetic oligonucleotide
tacgacgctcacatctaccctaacctcgccattgca

SEQ ID NO: 5169 - DNA, 35 bp, Artificial Sequence
  Synthetic oligonucleotide
gtctgcactccctgacaatgtccgcaccatgccct

SEQ ID NO: 5170 - DNA, 35 bp, Artificial Sequence
  Synthetic oligonucleotide
aaagaggggaacaacaaggagggcggatagaagcg

SEQ ID NO: 5171 - DNA, 35 bp, Artificial Sequence
  Synthetic oligonucleotide
gtcctcacagcacgcgcacccctccgtttccttcg

SEQ ID NO: 5172 - DNA, 35 bp, Artificial Sequence
  Synthetic oligonucleotide
gttcgaccaccgggacatcaccttatgctaacttt

SEQ ID NO: 5173 - DNA, 35 bp, Artificial Sequence
  Synthetic oligonucleotide
aaccgcgctccggagccttacccgttcttacatgc

SEQ ID NO: 5174 - DNA, 35 bp, Artificial Sequence
  Synthetic oligonucleotide
tcctacccgcgccgctctccgccccgttatgtact

SEQ ID NO: 5175 - DNA, 34 bp, Artificial Sequence
  Synthetic oligonucleotide
atgccacccttagttcgcgccacccataactcat

SEQ ID NO: 5176 - DNA, 38 bp, Artificial Sequence
  Synthetic oligonucleotide
accccgcccttatgcgtctaccgaccatcacactctga

SEQ ID NO: 5177 - DNA, 35 bp, Artificial Sequence
  Synthetic oligonucleotide
gtcacccccggctgttcgtccatacatgcactttc

SEQ ID NO: 5178 - DNA, 35 bp, Artificial Sequence
  Synthetic oligonucleotide
acaaaggcacgcacttgcccactccttggttcacc

SEQ ID NO: 5179 - DNA, 35 bp, Artificial Sequence
  Synthetic oligonucleotide
acctgcgccactagaacccgctcccattgtacgac

SEQ ID NO: 5180 - DNA, 35 bp, Artificial Sequence
  Synthetic oligonucleotide
tgccacactgccacgagtcgctttcctcaaccgtc

SEQ ID NO: 5181 - DNA, 38 bp, Artificial Sequence
  Synthetic oligonucleotide
gcacgccatgactgtgtcactgcgttctccatccctga

SEQ ID NO: 5182 - DNA, 35 bp, Artificial Sequence
  Synthetic oligonucleotide
gcccggtcgctgcctgagatcatggcccctttctt

SEQ ID NO: 5183 - DNA, 35 bp, Artificial Sequence
  Synthetic oligonucleotide
tatctgaccccacgttcgcgaaaactaaacccccc

SEQ ID NO: 5184 - DNA, 35 bp, Artificial Sequence
  Synthetic oligonucleotide
atgtcgcccgcccagcccagtccagtaccacccgt

SEQ ID NO: 5185 - DNA, 38 bp, Artificial Sequence
  Synthetic oligonucleotide
tcacgagcccacgataactcgcgtccctcaccctgtga

SEQ ID NO: 5186 - DNA, 38 bp, Artificial Sequence
  Synthetic oligonucleotide
atgacagtcgcatgtccttgcaccccacacctagttga

SEQ ID NO: 5187 - DNA, 35 bp, Artificial Sequence
  Synthetic oligonucleotide
gttgcgtaggccgtcccccctcccataagcctatg

SEQ ID NO: 5188 - DNA, 35 bp, Artificial Sequence
  Synthetic oligonucleotide
tccacccggtccacttctgccgcccgttcgacgct

SEQ ID NO: 5189 - DNA, 35 bp, Artificial Sequence
  Synthetic oligonucleotide
tccccgcaccatccctcgacgttaactctatcagc

SEQ ID NO: 5190 - DNA, 36 bp, Artificial Sequence
  Synthetic oligonucleotide
gcacacatccttcccgcacatcagttaccggtccta

SEQ ID NO: 5191 - DNA, 35 bp, Artificial Sequence
  Synthetic oligonucleotide
tgtccgaactgcaacgggccccccatcccttcgac

SEQ ID NO: 5192 - DNA, 35 bp, Artificial Sequence
  Synthetic oligonucleotide
acatgtcagccattccctttgctcttagtccatgt

SEQ ID NO: 5193 - DNA, 35 bp, Artificial Sequence
  Synthetic oligonucleotide
gtactcccgccctcgcttcaaattgcctcgcgata

SEQ ID NO: 5194 - DNA, 35 bp, Artificial Sequence
  Synthetic oligonucleotide
tatgccggtcctccatttcttatgcgcccactcga

SEQ ID NO: 5195 - DNA, 35 bp, Artificial Sequence
  Synthetic oligonucleotide
ttgtcctcgatggttgccttgttttgttcctgccc

SEQ ID NO: 5196 - DNA, 35 bp, Artificial Sequence
  Synthetic oligonucleotide
gatctcctctcagtcccgttataacgcaccccttc

SEQ ID NO: 5197 - DNA, 35 bp, Artificial Sequence
  Synthetic oligonucleotide
cgctccgcaggcctcccgcatttgtttgtcccctc

SEQ ID NO: 5198 - DNA, 35 bp, Artificial Sequence
  Synthetic oligonucleotide
acacgcgagtgaaccattgccgccccagactaccg

SEQ ID NO: 5199 - DNA, 36 bp, Artificial Sequence
  Synthetic oligonucleotide
tcagggctgcaccaccaacacacctcacacgctgca

SEQ ID NO: 5200 - DNA, 37 bp, Artificial Sequence
  Synthetic oligonucleotide
tgtcaccctcaccctgccaagaccactcaccgcgcga

SEQ ID NO: 5201 - DNA, 35 bp, Artificial Sequence
  Synthetic oligonucleotide
agcacccaccacactccgacctacttattcgcgat

SEQ ID NO: 5202 - DNA, 35 bp, Artificial Sequence
  Synthetic oligonucleotide
acgcccctcatacatgacgcctggttgccctctac

SEQ ID NO: 5203 - DNA, 37 bp, Artificial Sequence
  Synthetic oligonucleotide
gtgcgctccgctactcctgcccctgcccctatgctga

SEQ ID NO: 5204 - DNA, 35 bp, Artificial Sequence
  Synthetic oligonucleotide
tatcacccccgcctactcagccacgggtctaaatc

SEQ ID NO: 5205 - DNA, 37 bp, Artificial Sequence
  Synthetic oligonucleotide
ccgatgcccctgcattacgtaactcttcctctgccga

SEQ ID NO: 5206 - DNA, 35 bp, Artificial Sequence
  Synthetic oligonucleotide
gatgcctcttcgccttcctcttaccagactgtact

SEQ ID NO: 5207 - DNA, 35 bp, Artificial Sequence
  Synthetic oligonucleotide
gcccggacagggttgtgcgctccatcctctgcaat

SEQ ID NO: 5208 - DNA, 35 bp, Artificial Sequence
  Synthetic oligonucleotide
acctaccgccctgacatccagtggatccaatccca

SEQ ID NO: 5209 - DNA, 35 bp, Artificial Sequence
  Synthetic oligonucleotide
atctgcgcctgccacatccgccatacgtatcattc

SEQ ID NO: 5210 - DNA, 35 bp, Artificial Sequence
  Synthetic oligonucleotide
tctacgctgccccacctgtctcccatactgaattt

SEQ ID NO: 5211 - DNA, 35 bp, Artificial Sequence
  Synthetic oligonucleotide
aactggaccatcacatttccgttttgactgactgc

SEQ ID NO: 5212 - DNA, 36 bp, Artificial Sequence
  Synthetic oligonucleotide
atcccatgccaccggtatttaacgatcttgaacata

SEQ ID NO: 5213 - DNA, 35 bp, Artificial Sequence
  Synthetic oligonucleotide
acgcggagcgcgttcttgttcgtcccatccatttc

SEQ ID NO: 5214 - DNA, 35 bp, Artificial Sequence
  Synthetic oligonucleotide
tccccccctggcctctttatgggcgcttgctttac

SEQ ID NO: 5215 - DNA, 36 bp, Artificial Sequence
  Synthetic oligonucleotide
acacatccggcagggcgggtcggactggggggggaa

SEQ ID NO: 5216 - DNA, 35 bp, Artificial Sequence
  Synthetic oligonucleotide
tttcgagccgaacgcacctgctgaaccgacacaca

SEQ ID NO: 5217 - DNA, 35 bp, Artificial Sequence
  Synthetic oligonucleotide
gaaccatccactttcgactatacgcaggggagtcc

SEQ ID NO: 5218 - DNA, 36 bp, Artificial Sequence
  Synthetic oligonucleotide
tgcccggcccttcaccatgtcaacgaaatccgctaa

SEQ ID NO: 5219 - DNA, 35 bp, Artificial Sequence
  Synthetic oligonucleotide
tatcgcactcctcaccatcattcgtccacaggttg

SEQ ID NO: 5220 - DNA, 36 bp, Artificial Sequence
  Synthetic oligonucleotide
accgctgcatcacgactgacccatctcccatccgca

SEQ ID NO: 5221 - DNA, 37 bp, Artificial Sequence
  Synthetic oligonucleotide
acctacgccccctcccacgctgacctatacccatgga

SEQ ID NO: 5222 - DNA, 36 bp, Artificial Sequence
  Synthetic oligonucleotide
acatggtgcagcctctatctatttacactcgccaca

SEQ ID NO: 5223 - DNA, 35 bp, Artificial Sequence
  Synthetic oligonucleotide
tgcatagcagagcagccccgcagccccccctattt

SEQ ID NO: 5224 - DNA, 36 bp, Artificial Sequence
  Synthetic oligonucleotide
gtgccccacgacggttttaagccacctgcaccccca

SEQ ID NO: 5225 - DNA, 35 bp, Artificial Sequence
  Synthetic oligonucleotide
atgcccgtcgattcgctcctccacgcctcttaatc

SEQ ID NO: 5226 - DNA, 35 bp, Artificial Sequence
  Synthetic oligonucleotide
tcacccatctgccgatcctggatactgtccacgca

SEQ ID NO: 5227 - DNA, 37 bp, Artificial Sequence
  Synthetic oligonucleotide
acctctgcccaccctgcctggtttattgccctcatga

SEQ ID NO: 5228 - DNA, 35 bp, Artificial Sequence
  Synthetic oligonucleotide
tcgcgcactgcggtgcgatcgacgtccaagccctc

SEQ ID NO: 5229 - DNA, 35 bp, Artificial Sequence
  Synthetic oligonucleotide
tttgccgtcgcatcctgccgcataacctgatcttc

SEQ ID NO: 5230 - DNA, 30 bp, Artificial Sequence
  Synthetic oligonucleotide
atggaaaggagttgggaggttagggtaggg

SEQ ID NO: 5231 - DNA, 36 bp, Artificial Sequence
  Synthetic oligonucleotide
gatggctcgtccccatgtcttccgcacccctccgaa

SEQ ID NO: 5232 - DNA, 37 bp, Artificial Sequence
  Synthetic oligonucleotide
gcgcaaaatcaaggggggacggagtggacgggtcgga

SEQ ID NO: 5233 - DNA, 35 bp, Artificial Sequence
  Synthetic oligonucleotide
tgccacccgtggctttgcaacatttattccgtact

SEQ ID NO: 5234 - DNA, 35 bp, Artificial Sequence
  Synthetic oligonucleotide
tccatagcaccacccacactgctcgcaataggaac

SEQ ID NO: 5235 - DNA, 37 bp, Artificial Sequence
  Synthetic oligonucleotide
gacccccgccctgcttgcaattcacacaattccgtga

SEQ ID NO: 5236 - DNA, 36 bp, Artificial Sequence
  Synthetic oligonucleotide
tatgcccggtctcgttccactcatgttccatcccaa

SEQ ID NO: 5237 - DNA, 35 bp, Artificial Sequence
  Synthetic oligonucleotide
acgatggtgcccacgggtacgctcctcccattttc

SEQ ID NO: 5238 - DNA, 36 bp, Artificial Sequence
  Synthetic oligonucleotide
gcctcaccgctcctcagttctaggcctcaccccgct

SEQ ID NO: 5239 - DNA, 38 bp, Artificial Sequence
  Synthetic oligonucleotide
ttgtgagcatgggggaggacaagggggaagcacaatga

SEQ ID NO: 5240 - DNA, 35 bp, Artificial Sequence
  Synthetic oligonucleotide
gattccactcagcttgttgcgaattcctggcctcc

SEQ ID NO: 5241 - DNA, 35 bp, Artificial Sequence
  Synthetic oligonucleotide
atagcaccacatgcggtaccctcctttcctctggt

SEQ ID NO: 5242 - DNA, 37 bp, Artificial Sequence
  Synthetic oligonucleotide
gtccccgcctccacctctgccactgacggctattgga

SEQ ID NO: 5243 - DNA, 35 bp, Artificial Sequence
  Synthetic oligonucleotide
gtgacgtccggcctgtcttacctctttgcctcacg

SEQ ID NO: 5244 - DNA, 35 bp, Artificial Sequence
  Synthetic oligonucleotide
ggtcacaaaatgaggaaaaaatggcgggatgggga

SEQ ID NO: 5245 - DNA, 37 bp, Artificial Sequence
  Synthetic oligonucleotide
tcctaccgcacgctgttcctccccgcattcccggcga

SEQ ID NO: 5246 - DNA, 35 bp, Artificial Sequence
  Synthetic oligonucleotide
aacccgccctcagcccagtccattgaccgacgttt

SEQ ID NO: 5247 - DNA, 38 bp, Artificial Sequence
  Synthetic oligonucleotide
gacgaccccgacttacttctctgttttatgtaccttga

SEQ ID NO: 5248 - DNA, 35 bp, Artificial Sequence
  Synthetic oligonucleotide
gtcccgtgtccgcacgtcttttcctgattgccaac

SEQ ID NO: 5249 - DNA, 35 bp, Artificial Sequence
  Synthetic oligonucleotide
tgaccccgggagtccatcgctattgtcccaccccc

SEQ ID NO: 5250 - DNA, 35 bp, Artificial Sequence
  Synthetic oligonucleotide
gcattgaccgcactatcaagtcatcacgacccaca

SEQ ID NO: 5251 - DNA, 37 bp, Artificial Sequence
  Synthetic oligonucleotide
ttcaccccccccacccactggaaagtcagtttccgga

SEQ ID NO: 5252 - DNA, 36 bp, Artificial Sequence
  Synthetic oligonucleotide
gtgcacccctggcctgtccgacatgtcccccgtaca

SEQ ID NO: 5253 - DNA, 38 bp, Artificial Sequence
  Synthetic oligonucleotide
atacgcccgcctcatcctccgcctccaatgccaagtga

SEQ ID NO: 5254 - DNA, 35 bp, Artificial Sequence
  Synthetic oligonucleotide
atggtggggggggagggaagatcgagacaggagcc

SEQ ID NO: 5255 - DNA, 35 bp, Artificial Sequence
  Synthetic oligonucleotide
ttacccctcagacgcccgggcacaccatctcattg

SEQ ID NO: 5256 - DNA, 35 bp, Artificial Sequence
  Synthetic oligonucleotide
acgttacgtcgccgcccgatacccgctgcctgtct

SEQ ID NO: 5257 - DNA, 35 bp, Artificial Sequence
  Synthetic oligonucleotide
acttcacagaccccgccgttccaccttaccagtgg

SEQ ID NO: 5258 - DNA, 36 bp, Artificial Sequence
  Synthetic oligonucleotide
tcccattcccagaacgtcttgccactgcaatctgta

SEQ ID NO: 5259 - DNA, 36 bp, Artificial Sequence
  Synthetic oligonucleotide
tatacactcgctgccctcttccccagtgttgcacca

SEQ ID NO: 5260 - DNA, 36 bp, Artificial Sequence
  Synthetic oligonucleotide
tgcacccccgctatgcatagactccttgcccctaga

SEQ ID NO: 5261 - DNA, 36 bp, Artificial Sequence
  Synthetic oligonucleotide
aacgaccgcaccataggcccatcaccgcttccgtaa

SEQ ID NO: 5262 - DNA, 35 bp, Artificial Sequence
  Synthetic oligonucleotide
accggacgcatcctagccacctgttccgctgttcc

SEQ ID NO: 5263 - DNA, 37 bp, Artificial Sequence
  Synthetic oligonucleotide
tgctccccgccatatttttgtccacccgcccctgaga

SEQ ID NO: 5264 - DNA, 35 bp, Artificial Sequence
  Synthetic oligonucleotide
gcccactatcacagcgccctgcccgctccattcct

SEQ ID NO: 5265 - DNA, 35 bp, Artificial Sequence
  Synthetic oligonucleotide
ttcctctccattagccgcccgacgtgttccaccgt

SEQ ID NO: 5266 - DNA, 36 bp, Artificial Sequence
  Synthetic oligonucleotide
gagggaagggagtgggagtggagtgttggaattgaa

SEQ ID NO: 5267 - DNA, 35 bp, Artificial Sequence
  Synthetic oligonucleotide
acactacgccgcctcatatactatcccttgtcatc

SEQ ID NO: 5268 - DNA, 35 bp, Artificial Sequence
  Synthetic oligonucleotide
gacgcatcccgtacttgcatcactgctcacgactt

SEQ ID NO: 5269 - DNA, 37 bp, Artificial Sequence
  Synthetic oligonucleotide
tgcacctgctatggtttctgttccttgcccctctcga

SEQ ID NO: 5270 - DNA, 35 bp, Artificial Sequence
  Synthetic oligonucleotide
gaccccatcaccgcgctgagcaacttacctttggc

SEQ ID NO: 5271 - DNA, 37 bp, Artificial Sequence
  Synthetic oligonucleotide
gccctaccacgcaccgcccctaccccatgtttgctga

SEQ ID NO: 5272 - DNA, 35 bp, Artificial Sequence
  Synthetic oligonucleotide
tcctcccgctggacatattaacctcgcgtaccatc

SEQ ID NO: 5273 - DNA, 37 bp, Artificial Sequence
  Synthetic oligonucleotide
gacgaggtgggaagaaaaacggtgaccggggagtaga

SEQ ID NO: 5274 - DNA, 35 bp, Artificial Sequence
  Synthetic oligonucleotide
tgtgaagcctagcgcccccctactcgagttgcccc

SEQ ID NO: 5275 - DNA, 35 bp, Artificial Sequence
  Synthetic oligonucleotide
acacgccacatcctggagggtccaacatctatctc

SEQ ID NO: 5276 - DNA, 35 bp, Artificial Sequence
  Synthetic oligonucleotide
aagacacccactgatccgtcttcgtcattttctcc

SEQ ID NO: 5277 - DNA, 36 bp, Artificial Sequence
  Synthetic oligonucleotide
gtgtccccgtgcccttcccacatgagcttggtctca

SEQ ID NO: 5278 - DNA, 34 bp, Artificial Sequence
  Synthetic oligonucleotide
gcatacatcctgtgaccacgccggatccacacct

SEQ ID NO: 5279 - DNA, 35 bp, Artificial Sequence
  Synthetic oligonucleotide
tcaggtgccgtcgctcccgtccttcccttcgtagt

SEQ ID NO: 5280 - DNA, 35 bp, Artificial Sequence
  Synthetic oligonucleotide
tgcccccacggttgccgcccacaccccgagaaact

SEQ ID NO: 5281 - DNA, 35 bp, Artificial Sequence
  Synthetic oligonucleotide
tccccacgagctgtaaagcacttcctcgctgaccc

SEQ ID NO: 5282 - DNA, 35 bp, Artificial Sequence
  Synthetic oligonucleotide
tctacacccctctcatcccattcgtgtgtatttcc

SEQ ID NO: 5283 - DNA, 35 bp, Artificial Sequence
  Synthetic oligonucleotide
catggagcactgactctgcctgctaacaaaagccc

SEQ ID NO: 5284 - DNA, 35 bp, Artificial Sequence
  Synthetic oligonucleotide
tatgggaggggactatggggtgtgggaagggatat

SEQ ID NO: 5285 - DNA, 36 bp, Artificial Sequence
  Synthetic oligonucleotide
gaaccgccctcgccatgactacacctcctccaagta

SEQ ID NO: 5286 - DNA, 38 bp, Artificial Sequence
  Synthetic oligonucleotide
gcaccccgccgcttttaggatcccttcccatttattga

SEQ ID NO: 5287 - DNA, 35 bp, Artificial Sequence
  Synthetic oligonucleotide
tgaacaccccagcgttatcctgcgcactcatcgac

SEQ ID NO: 5288 - DNA, 35 bp, Artificial Sequence
  Synthetic oligonucleotide
gcaatcggaacggaggaggaacaaagggtgggtca

SEQ ID NO: 5289 - DNA, 35 bp, Artificial Sequence
  Synthetic oligonucleotide
tagcatgacgccgcctctatgcctatcaacgctcc

SEQ ID NO: 5290 - DNA, 35 bp, Artificial Sequence
  Synthetic oligonucleotide
tagttcacaacacatggtcctctgtcaacttttaa

SEQ ID NO: 5291 - DNA, 35 bp, Artificial Sequence
  Synthetic oligonucleotide
tagccctcccctaggcctctagtagcactgcctgc

SEQ ID NO: 5292 - DNA, 36 bp, Artificial Sequence
  Synthetic oligonucleotide
accaggccgcattctgtccttgtccattcctgtctc

SEQ ID NO: 5293 - DNA, 35 bp, Artificial Sequence
  Synthetic oligonucleotide
gagaagggcgtaggagaaaccaagggggggggatc

SEQ ID NO: 5294 - DNA, 37 bp, Artificial Sequence
  Synthetic oligonucleotide
acgtgtgccatcactttgctaatctgcctttccacga

SEQ ID NO: 5295 - DNA, 35 bp, Artificial Sequence
  Synthetic oligonucleotide
gtagaggccgtatcccgcctagtttgccctgccct

SEQ ID NO: 5296 - DNA, 37 bp, Artificial Sequence
  Synthetic oligonucleotide
gggggggtggttgcaggagggaatgggccatgaggga

SEQ ID NO: 5297 - DNA, 35 bp, Artificial Sequence
  Synthetic oligonucleotide
tgccctggccacatctcaccccctttgtttgcact

SEQ ID NO: 5298 - DNA, 37 bp, Artificial Sequence
  Synthetic oligonucleotide
gtgaagtggggagtggcgggcgggcgaagtacggtga

SEQ ID NO: 5299 - DNA, 37 bp, Artificial Sequence
  Synthetic oligonucleotide
acctccccgaccctccgctggtaccagtcattactga

SEQ ID NO: 5300 - DNA, 35 bp, Artificial Sequence
  Synthetic oligonucleotide
tccccacctgacgtgctggcctgacgtaccattta

SEQ ID NO: 5301 - DNA, 35 bp, Artificial Sequence
  Synthetic oligonucleotide
aacgccccgctggtcccctctatctctccttccct

SEQ ID NO: 5302 - DNA, 35 bp, Artificial Sequence
  Synthetic oligonucleotide
aaccgcaaggggaagaagggaggggaataggagct

SEQ ID NO: 5303 - DNA, 36 bp, Artificial Sequence
  Synthetic oligonucleotide
gtgcaatcctggcctgctgctattttttgttcaccg

SEQ ID NO: 5304 - DNA, 35 bp, Artificial Sequence
  Synthetic oligonucleotide
agacctccccccccagaaacgcgaacagcaacgct

SEQ ID NO: 5305 - DNA, 35 bp, Artificial Sequence
  Synthetic oligonucleotide
gtcacctgctattgtcacaacaccctgatttcgtt

SEQ ID NO: 5306 - DNA, 35 bp, Artificial Sequence
  Synthetic oligonucleotide
atgattgcactgcctcccatgctcaagcccacccg

SEQ ID NO: 5307 - DNA, 38 bp, Artificial Sequence
  Synthetic oligonucleotide
ggggtagccagggggggggacaagctgcattggggtga

SEQ ID NO: 5308 - DNA, 35 bp, Artificial Sequence
  Synthetic oligonucleotide
accacgcacttcgacgtgtctttgttttacctcgc

SEQ ID NO: 5309 - DNA, 35 bp, Artificial Sequence
  Synthetic oligonucleotide
acgacttccacctgaccactgctatcgaaagccct

SEQ ID NO: 5310 - DNA, 35 bp, Artificial Sequence
  Synthetic oligonucleotide
acctcacctgtccatttggccacttcgttgcattc

SEQ ID NO: 5311 - DNA, 35 bp, Artificial Sequence
  Synthetic oligonucleotide
gcaaccaacacctggcttactgcttctagacgaaa

SEQ ID NO: 5312 - DNA, 37 bp, Artificial Sequence
  Synthetic oligonucleotide
tcccacatcccctcagatcacccgccccgtcgtacga

SEQ ID NO: 5313 - DNA, 35 bp, Artificial Sequence
  Synthetic oligonucleotide
tacacagtcctagccctgctttttgacccgacctc

SEQ ID NO: 5314 - DNA, 35 bp, Artificial Sequence
  Synthetic oligonucleotide
agactacctcctgcttggccagtattctttccgtt

SEQ ID NO: 5315 - DNA, 35 bp, Artificial Sequence
  Synthetic oligonucleotide
gcaccacgaactgctcagcccggccactgtcttcc

SEQ ID NO: 5316 - DNA, 36 bp, Artificial Sequence
  Synthetic oligonucleotide
tacgtgctgaccactgctccatgaactgctctttga

SEQ ID NO: 5317 - DNA, 37 bp, Artificial Sequence
  Synthetic oligonucleotide
tgccacactctgcaacccccaccacagcccacgccga

SEQ ID NO: 5318 - DNA, 35 bp, Artificial Sequence
  Synthetic oligonucleotide
acccgcctgaccctctgtgatccgccttcttgatt

SEQ ID NO: 5319 - DNA, 34 bp, Artificial Sequence
  Synthetic oligonucleotide
tccccccctcaggcatgactccactattaaccat

SEQ ID NO: 5320 - DNA, 35 bp, Artificial Sequence
  Synthetic oligonucleotide
tcgaccggtcggccttttttccttcttgcacaacc

SEQ ID NO: 5321 - DNA, 35 bp, Artificial Sequence
  Synthetic oligonucleotide
gtcacacctgttgccctcacgtaaaacgctattcc

SEQ ID NO: 5322 - DNA, 37 bp, Artificial Sequence
  Synthetic oligonucleotide
tcatcccctcgccactttcaacgtttcaaacgtttga

SEQ ID NO: 5323 - DNA, 35 bp, Artificial Sequence
  Synthetic oligonucleotide
tagagccaccaccttgcgatcgcccgtagttacac

SEQ ID NO: 5324 - DNA, 35 bp, Artificial Sequence
  Synthetic oligonucleotide
gcgcaagtgccctcgaatcatctacgtttcccctg

SEQ ID NO: 5325 - DNA, 35 bp, Artificial Sequence
  Synthetic oligonucleotide
gacaccccgacgttgatctatttgccgttctcctg

SEQ ID NO: 5326 - DNA, 34 bp, Artificial Sequence
  Synthetic oligonucleotide
aaaccacccgctgttacgacctccttcatgaacc

SEQ ID NO: 5327 - DNA, 35 bp, Artificial Sequence
  Synthetic oligonucleotide
gtggggaccggggggggaagatcagggaaccattg

SEQ ID NO: 5328 - DNA, 35 bp, Artificial Sequence
  Synthetic oligonucleotide
tctcaccatcctcattcgcatccacgcccgttgga

SEQ ID NO: 5329 - DNA, 35 bp, Artificial Sequence
  Synthetic oligonucleotide
tccccctcgcagcactgtccaggctgcccctctgt

SEQ ID NO: 5330 - DNA, 38 bp, Artificial Sequence
  Synthetic oligonucleotide
gtgtgcgagtggggtaaggggattgggaagggggctga

SEQ ID NO: 5331 - DNA, 35 bp, Artificial Sequence
  Synthetic oligonucleotide
accaccgcactggttacgtccgtccatcccacatt

SEQ ID NO: 5332 - DNA, 35 bp, Artificial Sequence
  Synthetic oligonucleotide
ttagtgccacatgagaacccagcccagtccccttc

SEQ ID NO: 5333 - DNA, 36 bp, Artificial Sequence
  Synthetic oligonucleotide
tccaccaccgacatcatcttacatagtagggccata

SEQ ID NO: 5334 - DNA, 35 bp, Artificial Sequence
  Synthetic oligonucleotide
tgctgcgcccgtaccacgttttgtctggattccgc

SEQ ID NO: 5335 - DNA, 35 bp, Artificial Sequence
  Synthetic oligonucleotide
tcctgctccatcctccctgtagctattgtttttgt

SEQ ID NO: 5336 - DNA, 34 bp, Artificial Sequence
  Synthetic oligonucleotide
acccatcgcaccttttatccttcggtttatgccc

SEQ ID NO: 5337 - DNA, 38 bp, Artificial Sequence
  Synthetic oligonucleotide
gcgctggtggaggcgcacgtgagggggaatgggtttga

SEQ ID NO: 5338 - DNA, 35 bp, Artificial Sequence
  Synthetic oligonucleotide
actggtaaccgcctgcctggccttctacgcccatc

SEQ ID NO: 5339 - DNA, 35 bp, Artificial Sequence
  Synthetic oligonucleotide
gtactgcccccgatccccccgttcaacgaccagtc

SEQ ID NO: 5340 - DNA, 35 bp, Artificial Sequence
  Synthetic oligonucleotide
ttgcccgcccgcccgctcctatattccacacctgg

SEQ ID NO: 5341 - DNA, 35 bp, Artificial Sequence
  Synthetic oligonucleotide
tgcgctcttgacgatcctctaatgtcctgctcgcc

SEQ ID NO: 5342 - DNA, 35 bp, Artificial Sequence
  Synthetic oligonucleotide
tgcaacgcaatccgccgcaacgaattccgggcctc

SEQ ID NO: 5343 - DNA, 35 bp, Artificial Sequence
  Synthetic oligonucleotide
gttgcccataaggcagagcacccccctcttccacg

SEQ ID NO: 5344 - DNA, 35 bp, Artificial Sequence
  Synthetic oligonucleotide
acgcacgggtacacggtctttgctaattccctcct

SEQ ID NO: 5345 - DNA, 35 bp, Artificial Sequence
  Synthetic oligonucleotide
atacgctcccctgttccatattctagtactgctca

SEQ ID NO: 5346 - DNA, 35 bp, Artificial Sequence
  Synthetic oligonucleotide
ttgtccacttagaacatgttaccgtgtccacatcc

SEQ ID NO: 5347 - DNA, 36 bp, Artificial Sequence
  Synthetic oligonucleotide
tcacaccgcaatgcatacattacctccgatcccgga

SEQ ID NO: 5348 - DNA, 35 bp, Artificial Sequence
  Synthetic oligonucleotide
tgccactcactcggttggagccccctcgtccttgt

SEQ ID NO: 5349 - DNA, 35 bp, Artificial Sequence
  Synthetic oligonucleotide
gcactgcaagccctgttaatcttgtggtcacacct

SEQ ID NO: 5350 - DNA, 35 bp, Artificial Sequence
  Synthetic oligonucleotide
ttgacccggttctactagccccactcgccccccgg

SEQ ID NO: 5351 - DNA, 34 bp, Artificial Sequence
  Synthetic oligonucleotide
gcaacgtgggtgccagttgttaactcatttgtcc

SEQ ID NO: 5352 - DNA, 35 bp, Artificial Sequence
  Synthetic oligonucleotide
taacccaccctctcatgcctaaaccacgtcgctgg

SEQ ID NO: 5353 - DNA, 35 bp, Artificial Sequence
  Synthetic oligonucleotide
tagctcgcccctgtacatcgatcgcctagccactc

SEQ ID NO: 5354 - DNA, 36 bp, Artificial Sequence
  Synthetic oligonucleotide
gatgcactctgccacatgacaagcaactcatactca

SEQ ID NO: 5355 - DNA, 38 bp, Artificial Sequence
  Synthetic oligonucleotide
tacgaacccacacctgtgctaagccatgtcctgcttga

SEQ ID NO: 5356 - DNA, 37 bp, Artificial Sequence
  Synthetic oligonucleotide
gaccccgccctcgatgctacagcgagcctacccatga

SEQ ID NO: 5357 - DNA, 35 bp, Artificial Sequence
  Synthetic oligonucleotide
ttcgcattcgcccttcacttcagtacctgttccac

SEQ ID NO: 5358 - DNA, 35 bp, Artificial Sequence
  Synthetic oligonucleotide
tccatcgctccacctggtacagtctctgccactcg

SEQ ID NO: 5359 - DNA, 35 bp, Artificial Sequence
  Synthetic oligonucleotide
gccgcacaaccaccctcgtctgtaatgcgatctct

SEQ ID NO: 5360 - DNA, 35 bp, Artificial Sequence
  Synthetic oligonucleotide
tagacacccgaccgcccttgaggctgcgtaacccc

SEQ ID NO: 5361 - DNA, 35 bp, Artificial Sequence
  Synthetic oligonucleotide
gaagcgccgcaaactgtgcctttaacgccgtctcc

SEQ ID NO: 5362 - DNA, 35 bp, Artificial Sequence
  Synthetic oligonucleotide
gtcccaagcctctatccgcgttcactttcagtctc

SEQ ID NO: 5363 - DNA, 36 bp, Artificial Sequence
  Synthetic oligonucleotide
gccccaccccgtgacgcttggacaatatcgaaacca

SEQ ID NO: 5364 - DNA, 37 bp, Artificial Sequence
  Synthetic oligonucleotide
gtagccagtgggaagggaggggacggtcgagggtaga

SEQ ID NO: 5365 - DNA, 35 bp, Artificial Sequence
  Synthetic oligonucleotide
atgtccgaattaaccccacgctacatttgcccgac

SEQ ID NO: 5366 - DNA, 37 bp, Artificial Sequence
  Synthetic oligonucleotide
tcacccacgggttgccctgttccacactctgtcctga

SEQ ID NO: 5367 - DNA, 36 bp, Artificial Sequence
  Synthetic oligonucleotide
gcgctccatccgtcctgcaaacctcgactcgcgaaa

SEQ ID NO: 5368 - DNA, 36 bp, Artificial Sequence
  Synthetic oligonucleotide
tacgtccgccacccgtctccctatattgcatgcgaa

SEQ ID NO: 5369 - DNA, 35 bp, Artificial Sequence
  Synthetic oligonucleotide
actgcccgacgcactttttacagtacccctatgcc

SEQ ID NO: 5370 - DNA, 35 bp, Artificial Sequence
  Synthetic oligonucleotide
gaccatccaatccccctggtcgagagacttccgcc

SEQ ID NO: 5371 - DNA, 35 bp, Artificial Sequence
  Synthetic oligonucleotide
tgctcaagcggctccatccctcagtcagttccccc

SEQ ID NO: 5372 - DNA, 36 bp, Artificial Sequence
  Synthetic oligonucleotide
gtacaaccctcggacggtccgaaacacatgccaaca

SEQ ID NO: 5373 - DNA, 38 bp, Artificial Sequence
  Synthetic oligonucleotide
tacgcaccgatccccctagcgctcaaggaccctgctga

SEQ ID NO: 5374 - DNA, 37 bp, Artificial Sequence
  Synthetic oligonucleotide
gactggtgggcaggggacggggagggagcgggcttga

SEQ ID NO: 5375 - DNA, 35 bp, Artificial Sequence
  Synthetic oligonucleotide
gtgtaggaggaggggggcactagggcaaacaattt

SEQ ID NO: 5376 - DNA, 36 bp, Artificial Sequence
  Synthetic oligonucleotide
tctgccccactatgcctcaccctgctcgttgaacaa

SEQ ID NO: 5377 - DNA, 35 bp, Artificial Sequence
  Synthetic oligonucleotide
aatgcacccccagtccttccgccgttcacctccca

SEQ ID NO: 5378 - DNA, 35 bp, Artificial Sequence
  Synthetic oligonucleotide
gccccccccgaccttctccacagtatgggttgttc

SEQ ID NO: 5379 - DNA, 38 bp, Artificial Sequence
  Synthetic oligonucleotide
taggtcacggcaactgttcctcctgcctccctctgtga

SEQ ID NO: 5380 - DNA, 35 bp, Artificial Sequence
  Synthetic oligonucleotide
tgtctacccccacgcccaatctcgctgttagcaca

SEQ ID NO: 5381 - DNA, 35 bp, Artificial Sequence
  Synthetic oligonucleotide
accccggcccgcacgccgacccaccacctataagc

SEQ ID NO: 5382 - DNA, 34 bp, Artificial Sequence
  Synthetic oligonucleotide
tgatacccgcaatctcccgtgattcttcaaccat

SEQ ID NO: 5383 - DNA, 35 bp, Artificial Sequence
  Synthetic oligonucleotide
atcgccaatgatccctgcgattcgtatctctcttc

SEQ ID NO: 5384 - DNA, 35 bp, Artificial Sequence
  Synthetic oligonucleotide
tgcgcacccaccttatatcgaggccaaacccttcc

SEQ ID NO: 5385 - DNA, 35 bp, Artificial Sequence
  Synthetic oligonucleotide
gcccttgcgcccgactattgtcacctggtcttcgc

SEQ ID NO: 5386 - DNA, 38 bp, Artificial Sequence
  Synthetic oligonucleotide
agcgggacacgaacgggtgggatgggggtacaaaatga

SEQ ID NO: 5387 - DNA, 36 bp, Artificial Sequence
  Synthetic oligonucleotide
ggacccattcgccacgttattgcacacggatcatca

SEQ ID NO: 5388 - DNA, 35 bp, Artificial Sequence
  Synthetic oligonucleotide
actcggggaggacgggtgtggggaggggctactgt

SEQ ID NO: 5389 - DNA, 35 bp, Artificial Sequence
  Synthetic oligonucleotide
gcccctcacaggaccgaaactggctcatcactgct

SEQ ID NO: 5390 - DNA, 35 bp, Artificial Sequence
  Synthetic oligonucleotide
gtgcatgccacagcgcccgcgtacctcctgttgag

SEQ ID NO: 5391 - DNA, 35 bp, Artificial Sequence
  Synthetic oligonucleotide
tacaccctggcctcataatcaacgtagcactattg

SEQ ID NO: 5392 - DNA, 35 bp, Artificial Sequence
  Synthetic oligonucleotide
acccacccggtaattggaataacgctcatttcacc

SEQ ID NO: 5393 - DNA, 36 bp, Artificial Sequence
  Synthetic oligonucleotide
ttacccccgccatttctctcgagcgcacccccagga

SEQ ID NO: 5394 - DNA, 35 bp, Artificial Sequence
  Synthetic oligonucleotide
tccatgccacataccctccccctggtcgtttcgcg

SEQ ID NO: 5395 - DNA, 35 bp, Artificial Sequence
  Synthetic oligonucleotide
tacacccccaaacgttgcattactagcatacacct

SEQ ID NO: 5396 - DNA, 37 bp, Artificial Sequence
  Synthetic oligonucleotide
agaccgtatccccgcactcttcgtaaacacttggtga

SEQ ID NO: 5397 - DNA, 38 bp, Artificial Sequence
  Synthetic oligonucleotide
tagccatccgcgccttgctttcacctcgttattcctga

SEQ ID NO: 5398 - DNA, 36 bp, Artificial Sequence
  Synthetic oligonucleotide
acggaacactccactgcattccccccgtttaatcgg

SEQ ID NO: 5399 - DNA, 35 bp, Artificial Sequence
  Synthetic oligonucleotide
gcattgcacctatctcgccgctgaccttctggcta

SEQ ID NO: 5400 - DNA, 37 bp, Artificial Sequence
  Synthetic oligonucleotide
tccctctgcacataccccgcgtcagtcacccccttga

SEQ ID NO: 5401 - DNA, 35 bp, Artificial Sequence
  Synthetic oligonucleotide
acctcacctggcatggttaataatccccccatgtt

SEQ ID NO: 5402 - DNA, 35 bp, Artificial Sequence
  Synthetic oligonucleotide
tcccgcccatctataaggtcaatgctttctctctt

SEQ ID NO: 5403 - DNA, 38 bp, Artificial Sequence
  Synthetic oligonucleotide
gtgggcccacacagttacttttacacctgctttactga

SEQ ID NO: 5404 - DNA, 35 bp, Artificial Sequence
  Synthetic oligonucleotide
gcctatcctccacatctagtacctaggcaacatgc

SEQ ID NO: 5405 - DNA, 35 bp, Artificial Sequence
  Synthetic oligonucleotide
tccagtgcctgctccatgtcacgttcttttatcac

SEQ ID NO: 5406 - DNA, 35 bp, Artificial Sequence
  Synthetic oligonucleotide
gagcaccttcgcccccttgatctcttgtaactgtc

SEQ ID NO: 5407 - DNA, 37 bp, Artificial Sequence
  Synthetic oligonucleotide
gcacaccgcccctaacatgcatgtactgacttcacga

SEQ ID NO: 5408 - DNA, 35 bp, Artificial Sequence
  Synthetic oligonucleotide
acgtacgtggagaacgagggtaaatggggagtggg

SEQ ID NO: 5409 - DNA, 35 bp, Artificial Sequence
  Synthetic oligonucleotide
atggataagccatcgcaccctgtcccatctgttct

SEQ ID NO: 5410 - DNA, 35 bp, Artificial Sequence
  Synthetic oligonucleotide
gagcctacaacagctcgcactcacgccttatcccg

SEQ ID NO: 5411 - DNA, 36 bp, Artificial Sequence
  Synthetic oligonucleotide
tgcctagcgccctttgtcttcgtgcctatcttttca

SEQ ID NO: 5412 - DNA, 38 bp, Artificial Sequence
  Synthetic oligonucleotide
tacagcccctcccgcgtgtgcacttaacgcctgcctga

SEQ ID NO: 5413 - DNA, 37 bp, Artificial Sequence
  Synthetic oligonucleotide
accgtcccgccacgtttcgtcttatcccttagttgga

SEQ ID NO: 5414 - DNA, 37 bp, Artificial Sequence
  Synthetic oligonucleotide
aacccgccacccggtgctcgcctactctccgtaagga

SEQ ID NO: 5415 - DNA, 35 bp, Artificial Sequence
  Synthetic oligonucleotide
aaccgacgccgcactcaacatccgctaccccctcg

SEQ ID NO: 5416 - DNA, 35 bp, Artificial Sequence
  Synthetic oligonucleotide
gtctgcccctccacgtacaccaaaacacagtccgt

SEQ ID NO: 5417 - DNA, 35 bp, Artificial Sequence
  Synthetic oligonucleotide
gtgggggccctgctgctatttgtcccggcttctac

SEQ ID NO: 5418 - DNA, 35 bp, Artificial Sequence
  Synthetic oligonucleotide
acaccctcacatggattgtcgatcttatctgcctc

SEQ ID NO: 5419 - DNA, 35 bp, Artificial Sequence
  Synthetic oligonucleotide
tatgtcctcagcctccctagcccgccgctccatgg

SEQ ID NO: 5420 - DNA, 35 bp, Artificial Sequence
  Synthetic oligonucleotide
gttatcccacctccgcagcctcgttctaggccatc

SEQ ID NO: 5421 - DNA, 34 bp, Artificial Sequence
  Synthetic oligonucleotide
tagatgccgccctaaatatgcctggctaccctga

SEQ ID NO: 5422 - DNA, 35 bp, Artificial Sequence
  Synthetic oligonucleotide
ttctccgtccatccgttgcccgtactttggtctta

SEQ ID NO: 5423 - DNA, 35 bp, Artificial Sequence
  Synthetic oligonucleotide
atcccccgagcgagcccactatgtttgtccacctt

SEQ ID NO: 5424 - DNA, 35 bp, Artificial Sequence
  Synthetic oligonucleotide
gcattgcacccgacctgattcaccccatatcttct

SEQ ID NO: 5425 - DNA, 37 bp, Artificial Sequence
  Synthetic oligonucleotide
tccctcaccgcaatcccttatattcgtcgcctcgcga

SEQ ID NO: 5426 - DNA, 35 bp, Artificial Sequence
  Synthetic oligonucleotide
gatcaacaagaccggggtgcaggaagggcgggaga

SEQ ID NO: 5427 - DNA, 35 bp, Artificial Sequence
  Synthetic oligonucleotide
gactgctcactgtctctttagtcccctctcttatg

SEQ ID NO: 5428 - DNA, 38 bp, Artificial Sequence
  Synthetic oligonucleotide
gccccatcacgttcgcgtctaccactgcacctccgtga

SEQ ID NO: 5429 - DNA, 35 bp, Artificial Sequence
  Synthetic oligonucleotide
tccctcatccacctctcgaagtacataacggtcca

SEQ ID NO: 5430 - DNA, 36 bp, Artificial Sequence
  Synthetic oligonucleotide
gttgtgggagggtacagggagggcaattagagagga

SEQ ID NO: 5431 - DNA, 35 bp, Artificial Sequence
  Synthetic oligonucleotide
gtcaactgcaccggcccccgttccctctcgttatc

SEQ ID NO: 5432 - DNA, 35 bp, Artificial Sequence
  Synthetic oligonucleotide
taccgtccgccacagcctccaatagtcccttcgtc

SEQ ID NO: 5433 - DNA, 35 bp, Artificial Sequence
  Synthetic oligonucleotide
tccatccgcaaactcctgagttaacactttgactc

SEQ ID NO: 5434 - DNA, 37 bp, Artificial Sequence
  Synthetic oligonucleotide
actacccaccccatctgaggctaccagccatttcgga

SEQ ID NO: 5435 - DNA, 35 bp, Artificial Sequence
  Synthetic oligonucleotide
acaaccagtctctcacacgtttcatgtccttcagc

SEQ ID NO: 5436 - DNA, 37 bp, Artificial Sequence
  Synthetic oligonucleotide
tcgatctccctcacacacttattgaagtcatccctga

SEQ ID NO: 5437 - DNA, 35 bp, Artificial Sequence
  Synthetic oligonucleotide
gctggtcacatccatccgctcccagacgttaatct

SEQ ID NO: 5438 - DNA, 36 bp, Artificial Sequence
  Synthetic oligonucleotide
gagccgccctagccccgcccggcctgagcccattca

SEQ ID NO: 5439 - DNA, 38 bp, Artificial Sequence
  Synthetic oligonucleotide
acaacccatccccaattccttctgtctgcaccacgtga

SEQ ID NO: 5440 - DNA, 35 bp, Artificial Sequence
  Synthetic oligonucleotide
tgtcaccatcacatcattcttgcactgcagtccat

SEQ ID NO: 5441 - DNA, 35 bp, Artificial Sequence
  Synthetic oligonucleotide
aacccaacctcaggacagttcgcccattttgtccc

SEQ ID NO: 5442 - DNA, 35 bp, Artificial Sequence
  Synthetic oligonucleotide
aagacgacgtacccacaccacatgtctcttgcctt

SEQ ID NO: 5443 - DNA, 35 bp, Artificial Sequence
  Synthetic oligonucleotide
taagccatacggtgactaccgaccctgctccattc

SEQ ID NO: 5444 - DNA, 36 bp, Artificial Sequence
  Synthetic oligonucleotide
tacatccgtcgggccccacaccaacccttgtgccta

SEQ ID NO: 5445 - DNA, 35 bp, Artificial Sequence
  Synthetic oligonucleotide
atcaacccggccacaccgcgatcctcgaacttacg

SEQ ID NO: 5446 - DNA, 37 bp, Artificial Sequence
  Synthetic oligonucleotide
ttcacccgacagcccttgctcctgatcgcaccaacga

SEQ ID NO: 5447 - DNA, 36 bp, Artificial Sequence
  Synthetic oligonucleotide
accccgtcccatgcccatttacagatgtgcgctcga

SEQ ID NO: 5448 - DNA, 36 bp, Artificial Sequence
  Synthetic oligonucleotide
aggaatacccctcgcatcacctgcactgtgacctaa

SEQ ID NO: 5449 - DNA, 35 bp, Artificial Sequence
  Synthetic oligonucleotide
gtccatctcaagaccacaccgcctccctgtccgtc

SEQ ID NO: 5450 - DNA, 37 bp, Artificial Sequence
  Synthetic oligonucleotide
acccgccaaatccttgcatccatcgccacttgcttga

SEQ ID NO: 5451 - DNA, 36 bp, Artificial Sequence
  Synthetic oligonucleotide
atccaccgaccaatacctatttgacattccctgtgt

SEQ ID NO: 5452 - DNA, 37 bp, Artificial Sequence
  Synthetic oligonucleotide
gtcccgcccccgatccggtttcattaagcctcttcga

SEQ ID NO: 5453 - DNA, 35 bp, Artificial Sequence
  Synthetic oligonucleotide
gtcgcctgaccgtgcatcccgttctgtaactccac

SEQ ID NO: 5454 - DNA, 38 bp, Artificial Sequence
  Synthetic oligonucleotide
ggggcgaaccagtcaaatatgtcgggtgggaggggtga

SEQ ID NO: 5455 - DNA, 35 bp, Artificial Sequence
  Synthetic oligonucleotide
gccacccgccctcttgctcgaagattataccgtac

SEQ ID NO: 5456 - DNA, 35 bp, Artificial Sequence
  Synthetic oligonucleotide
taccccgacgaagcccgtctactatagccctcact

SEQ ID NO: 5457 - DNA, 36 bp, Artificial Sequence
  Synthetic oligonucleotide
cctcagctccttgttcccccgtctatgtagtctcca

SEQ ID NO: 5458 - DNA, 34 bp, Artificial Sequence
  Synthetic oligonucleotide
gtgactcatccgtttgacgccttgttcctgcctt

SEQ ID NO: 5459 - DNA, 35 bp, Artificial Sequence
  Synthetic oligonucleotide
tcagacagttccccgcccactcgcagtttacccat

SEQ ID NO: 5460 - DNA, 35 bp, Artificial Sequence
  Synthetic oligonucleotide
caaacgtactgccgatcgatcttttggcgctattc

SEQ ID NO: 5461 - DNA, 36 bp, Artificial Sequence
  Synthetic oligonucleotide
acaccagccccgcgcgattatatgctcctacttcta

SEQ ID NO: 5462 - DNA, 35 bp, Artificial Sequence
  Synthetic oligonucleotide
atgcccgcgcacttacgtcgctacccatctcttgg

SEQ ID NO: 5463 - DNA, 35 bp, Artificial Sequence
  Synthetic oligonucleotide
tcccctcggggctggaacgtttcatcgctacctct

SEQ ID NO: 5464 - DNA, 35 bp, Artificial Sequence
  Synthetic oligonucleotide
gactcccaccaccaccgtgtttttatcgaggtact

SEQ ID NO: 5465 - DNA, 35 bp, Artificial Sequence
  Synthetic oligonucleotide
gcacatcgactatagcctcccgaccccacccctcg

SEQ ID NO: 5466 - DNA, 37 bp, Artificial Sequence
  Synthetic oligonucleotide
tagaacctcacaactgtattgccgtgcccccagccga

SEQ ID NO: 5467 - DNA, 35 bp, Artificial Sequence
  Synthetic oligonucleotide
acagtacgcccccttttccgctagcccactgctat

SEQ ID NO: 5468 - DNA, 37 bp, Artificial Sequence
  Synthetic oligonucleotide
tgtccacacatgcactgaaacctcagcccgcccacga

SEQ ID NO: 5469 - DNA, 35 bp, Artificial Sequence
  Synthetic oligonucleotide
atgtcccccaaaccgtaatcattcgtggctacgac

SEQ ID NO: 5470 - DNA, 35 bp, Artificial Sequence
  Synthetic oligonucleotide
gtccaccgtaccgacgcatttactcattctccacg

SEQ ID NO: 5471 - DNA, 35 bp, Artificial Sequence
  Synthetic oligonucleotide
gcctctagccctgagtgcccgttgtccatacgccc

SEQ ID NO: 5472 - DNA, 37 bp, Artificial Sequence
  Synthetic oligonucleotide
ttgaacccgccgttccccatgtcgaggcctctcttga

SEQ ID NO: 5473 - DNA, 35 bp, Artificial Sequence
  Synthetic oligonucleotide
tctgaccccacgtcctctcttgttcaggctgttct

SEQ ID NO: 5474 - DNA, 35 bp, Artificial Sequence
  Synthetic oligonucleotide
gatcgcaccccgttccgccttgatcgcagaccctc

SEQ ID NO: 5475 - DNA, 38 bp, Artificial Sequence
  Synthetic oligonucleotide
aacacgtacacacacacccgagcagtcataccaagtga

SEQ ID NO: 5476 - DNA, 37 bp, Artificial Sequence
  Synthetic oligonucleotide
tgccccctcattgtctgttttatcgacaccttgacga

SEQ ID NO: 5477 - DNA, 36 bp, Artificial Sequence
  Synthetic oligonucleotide
gtgagcccttccccaccgacgtttctgtccctacaa

SEQ ID NO: 5478 - DNA, 36 bp, Artificial Sequence
  Synthetic oligonucleotide
atgcccgccccacacaaccccgggctacatgaccca

SEQ ID NO: 5479 - DNA, 35 bp, Artificial Sequence
  Synthetic oligonucleotide
gtttacgtcgcctccaccgtcttcctctactgccc

SEQ ID NO: 5480 - DNA, 36 bp, Artificial Sequence
  Synthetic oligonucleotide
tacccacacaatgccctaaacagttcccgctctaga

SEQ ID NO: 5481 - DNA, 35 bp, Artificial Sequence
  Synthetic oligonucleotide
atgcacagccgcgcaatcggtttcttttgtcctgt

SEQ ID NO: 5482 - DNA, 35 bp, Artificial Sequence
  Synthetic oligonucleotide
gcctccgaccgccgcacattaggtctctatcgatc

SEQ ID NO: 5483 - DNA, 35 bp, Artificial Sequence
  Synthetic oligonucleotide
tgagcgccctcctctcattgccgtatttggtctgg

SEQ ID NO: 5484 - DNA, 38 bp, Artificial Sequence
  Synthetic oligonucleotide
aacccacctcgatgctatctgtttcgtcaaattcctga

SEQ ID NO: 5485 - DNA, 36 bp, Artificial Sequence
  Synthetic oligonucleotide
tccactaccagcctgtgggcaaactccatccaatca

SEQ ID NO: 5486 - DNA, 35 bp, Artificial Sequence
  Synthetic oligonucleotide
gaacgggaggaaacacaggaggggagtaaagcggg

SEQ ID NO: 5487 - DNA, 35 bp, Artificial Sequence
  Synthetic oligonucleotide
gatacccccattatgactatgaccctacacctcga

SEQ ID NO: 5488 - DNA, 35 bp, Artificial Sequence
  Synthetic oligonucleotide
gcccaccttaccgcgcctcccctattgaaaagcag

SEQ ID NO: 5489 - DNA, 37 bp, Artificial Sequence
  Synthetic oligonucleotide
acttgagcatgcggaagtcttcgatcctcacctctga

SEQ ID NO: 5490 - DNA, 36 bp, Artificial Sequence
  Synthetic oligonucleotide
gtggtaggaggatggagggtggaacaggagggggaa

SEQ ID NO: 5491 - DNA, 36 bp, Artificial Sequence
  Synthetic oligonucleotide
taggggacggggattgcaaccggggtgagtgggaaa

SEQ ID NO: 5492 - DNA, 35 bp, Artificial Sequence
  Synthetic oligonucleotide
gtccgtccgacagtctttcctgtccttatcttggt

SEQ ID NO: 5493 - DNA, 35 bp, Artificial Sequence
  Synthetic oligonucleotide
ggacaccatattctacccctcgtttgagcccatgc

SEQ ID NO: 5494 - DNA, 35 bp, Artificial Sequence
  Synthetic oligonucleotide
atgtgccaccgtccacctagctcactctgttcctc

SEQ ID NO: 5495 - DNA, 36 bp, Artificial Sequence
  Synthetic oligonucleotide
gccgcaccccccgtctcatctcctttagccagtaca

SEQ ID NO: 5496 - DNA, 35 bp, Artificial Sequence
  Synthetic oligonucleotide
atcgccgctggccgtatttcatttgccgccatccc

SEQ ID NO: 5497 - DNA, 35 bp, Artificial Sequence
  Synthetic oligonucleotide
acacgccctcaccttcgcgtcgacgagctaccctg

SEQ ID NO: 5498 - DNA, 35 bp, Artificial Sequence
  Synthetic oligonucleotide
tagaccgcaccgtcgcatacttcaaccctttcgct

SEQ ID NO: 5499 - DNA, 36 bp, Artificial Sequence
  Synthetic oligonucleotide
tcatttccaccgcctatcatcctacacagtagacaa

SEQ ID NO: 5500 - DNA, 35 bp, Artificial Sequence
  Synthetic oligonucleotide
ttcgacgatcctcacgagcattctggtccacctct

SEQ ID NO: 5501 - DNA, 35 bp, Artificial Sequence
  Synthetic oligonucleotide
tcaccacagcctggtgtcgcctcccctagtaccaa

SEQ ID NO: 5502 - DNA, 36 bp, Artificial Sequence
  Synthetic oligonucleotide
acacctccatcctgtaatgatttgggcctactagta

SEQ ID NO: 5503 - DNA, 36 bp, Artificial Sequence
  Synthetic oligonucleotide
tgtttgccccacaacgcctctccgtatcgatagcta

SEQ ID NO: 5504 - DNA, 35 bp, Artificial Sequence
  Synthetic oligonucleotide
tccgaccacacgcgattccgttacttcattgatac

SEQ ID NO: 5505 - DNA, 37 bp, Artificial Sequence
  Synthetic oligonucleotide
gcccaccgctcccttcgcccacgttgccagttacgga

SEQ ID NO: 5506 - DNA, 35 bp, Artificial Sequence
  Synthetic oligonucleotide
tgctccgtcactcctatacacccgcttcctatccg

SEQ ID NO: 5507 - DNA, 35 bp, Artificial Sequence
  Synthetic oligonucleotide
tgcgacctatccaatgtctagtaacacaatcgcac

SEQ ID NO: 5508 - DNA, 35 bp, Artificial Sequence
  Synthetic oligonucleotide
cggagatgcctgcctcacacctaacctgacgccca

SEQ ID NO: 5509 - DNA, 35 bp, Artificial Sequence
  Synthetic oligonucleotide
tccagcgcatgctttttaatccttctgtctggtct

SEQ ID NO: 5510 - DNA, 35 bp, Artificial Sequence
  Synthetic oligonucleotide
tatgcatcgcgaacatccccctgtccagcctaatt

SEQ ID NO: 5511 - DNA, 35 bp, Artificial Sequence
  Synthetic oligonucleotide
tcccccacatgtatatcatgcatcgccatctgcct

SEQ ID NO: 5512 - DNA, 36 bp, Artificial Sequence
  Synthetic oligonucleotide
aagacaggacgcaggcttatatcacccgccccccca

SEQ ID NO: 5513 - DNA, 36 bp, Artificial Sequence
  Synthetic oligonucleotide
tcccgtgccacacattatcgagttcaatcacttcga

SEQ ID NO: 5514 - DNA, 37 bp, Artificial Sequence
  Synthetic oligonucleotide
acgcaggaaggggcgggacatggggaaggctgttgga

SEQ ID NO: 5515 - DNA, 35 bp, Artificial Sequence
  Synthetic oligonucleotide
gaatccacgccgtcctagttcctcgaagctttcct

SEQ ID NO: 5516 - DNA, 35 bp, Artificial Sequence
  Synthetic oligonucleotide
gacccgccgcgggcatcacttctaagtcctccgct

SEQ ID NO: 5517 - DNA, 36 bp, Artificial Sequence
  Synthetic oligonucleotide
gaacacccaccgatcaatcaagagccccgcactcca

SEQ ID NO: 5518 - DNA, 35 bp, Artificial Sequence
  Synthetic oligonucleotide
gtgggaggggtctaagttgtcgggtggggaaaata

SEQ ID NO: 5519 - DNA, 38 bp, Artificial Sequence
  Synthetic oligonucleotide
gtgttgcctgcatgccgtaccacccctgctatacctga

SEQ ID NO: 5520 - DNA, 36 bp, Artificial Sequence
  Synthetic oligonucleotide
tgcctcactcagtcgttctcgccgcattctccatca

SEQ ID NO: 5521 - DNA, 35 bp, Artificial Sequence
  Synthetic oligonucleotide
ataccccaagcggggtcacttgtccctttcactcg

SEQ ID NO: 5522 - DNA, 35 bp, Artificial Sequence
  Synthetic oligonucleotide
gtggagagcaagggggagttggtgggccgaggaat

SEQ ID NO: 5523 - DNA, 35 bp, Artificial Sequence
  Synthetic oligonucleotide
gtccacgagattctagctgggcttcttacattttc

SEQ ID NO: 5524 - DNA, 35 bp, Artificial Sequence
  Synthetic oligonucleotide
ttgcatggtcacacaccgcacccggctaccaccta

SEQ ID NO: 5525 - DNA, 35 bp, Artificial Sequence
  Synthetic oligonucleotide
ttccacaccaacgtgtaacctggtacgctatcacc

SEQ ID NO: 5526 - DNA, 35 bp, Artificial Sequence
  Synthetic oligonucleotide
acatccccgctatcatgaaatcctggctgcttgcc

SEQ ID NO: 5527 - DNA, 35 bp, Artificial Sequence
  Synthetic oligonucleotide
aatccccccacttgttgcccccgaaactgctccgc

SEQ ID NO: 5528 - DNA, 35 bp, Artificial Sequence
  Synthetic oligonucleotide
gcatgtccatctcctgtacgttctgtccgacccaa

SEQ ID NO: 5529 - DNA, 35 bp, Artificial Sequence
  Synthetic oligonucleotide
gcaccaggcgctccccctcctctattagcccttca

SEQ ID NO: 5530 - DNA, 35 bp, Artificial Sequence
  Synthetic oligonucleotide
tgacacgtgaaaccccgctatcacactgcactacc

SEQ ID NO: 5531 - DNA, 35 bp, Artificial Sequence
  Synthetic oligonucleotide
tgccacccccgtttcctctgcccttaaatgggact

SEQ ID NO: 5532 - DNA, 38 bp, Artificial Sequence
  Synthetic oligonucleotide
gcccccgccccacatcaccggagcagtcgcccttatga

SEQ ID NO: 5533 - DNA, 38 bp, Artificial Sequence
  Synthetic oligonucleotide
gccatcgtacctttgccatcagctgcccttatccttga

SEQ ID NO: 5534 - DNA, 36 bp, Artificial Sequence
  Synthetic oligonucleotide
gtgttcccgtcctcttctcgtcatggtgatcgccca

SEQ ID NO: 5535 - DNA, 38 bp, Artificial Sequence
  Synthetic oligonucleotide
ttgccacccgcccatgccgacttccctacttccattga

SEQ ID NO: 5536 - DNA, 35 bp, Artificial Sequence
  Synthetic oligonucleotide
ccgtacggcggttacatctgccttatggttacttt

SEQ ID NO: 5537 - DNA, 35 bp, Artificial Sequence
  Synthetic oligonucleotide
gccatctgcctccctgccaccagtattatctcgcc

SEQ ID NO: 5538 - DNA, 36 bp, Artificial Sequence
  Synthetic oligonucleotide
atgtcccctccgccaaggtccatcacagtcatcgta

SEQ ID NO: 5539 - DNA, 35 bp, Artificial Sequence
  Synthetic oligonucleotide
gccccgccgcgcactccgttttggctgcttacatt

SEQ ID NO: 5540 - DNA, 35 bp, Artificial Sequence
  Synthetic oligonucleotide
tcagtccacagccctatccaatcctggcttttatc

SEQ ID NO: 5541 - DNA, 38 bp, Artificial Sequence
  Synthetic oligonucleotide
gatagggacggggggggaaaactaagggagtcaactga

SEQ ID NO: 5542 - DNA, 35 bp, Artificial Sequence
  Synthetic oligonucleotide
gagccactctgactggttccacattgccactccta

SEQ ID NO: 5543 - DNA, 35 bp, Artificial Sequence
  Synthetic oligonucleotide
tccgattacgcctccgaagttacgactctgccctt

SEQ ID NO: 5544 - DNA, 35 bp, Artificial Sequence
  Synthetic oligonucleotide
gcacccgctggtaggcccactcatatctatagccc

SEQ ID NO: 5545 - DNA, 35 bp, Artificial Sequence
  Synthetic oligonucleotide
ttagtccccgacgcagttttctgtttggcccccac

SEQ ID NO: 5546 - DNA, 35 bp, Artificial Sequence
  Synthetic oligonucleotide
gtgcactcgctcgccccgtgactcaatcccacact

SEQ ID NO: 5547 - DNA, 35 bp, Artificial Sequence
  Synthetic oligonucleotide
atcccctgcccggacctagtacacgatcttccagc

SEQ ID NO: 5548 - DNA, 37 bp, Artificial Sequence
  Synthetic oligonucleotide
atacacgcaccaccaaccttgtcttacagagcccgga

SEQ ID NO: 5549 - DNA, 35 bp, Artificial Sequence
  Synthetic oligonucleotide
tagagcgtagcccagcctccgaccatcctggcccc

SEQ ID NO: 5550 - DNA, 35 bp, Artificial Sequence
  Synthetic oligonucleotide
acagtggggtggtggggaggccgacgacaagggtg

SEQ ID NO: 5551 - DNA, 35 bp, Artificial Sequence
  Synthetic oligonucleotide
taggtcctacactgacctgtatcattcaccctgcc

SEQ ID NO: 5552 - DNA, 35 bp, Artificial Sequence
  Synthetic oligonucleotide
atacgcggtacatcgacgtatggccgaatccttcc

SEQ ID NO: 5553 - DNA, 35 bp, Artificial Sequence
  Synthetic oligonucleotide
acgcaatcctccgccgtccaacccttcttttggca

SEQ ID NO: 5554 - DNA, 35 bp, Artificial Sequence
  Synthetic oligonucleotide
gtccacctaacaatgttacatgcactcttaccaat

SEQ ID NO: 5555 - DNA, 35 bp, Artificial Sequence
  Synthetic oligonucleotide
gtccacctcacctacgtgcggtcacatatctctct

SEQ ID NO: 5556 - DNA, 37 bp, Artificial Sequence
  Synthetic oligonucleotide
tgctcaccgccattgcttatttctggcctgaatttga

SEQ ID NO: 5557 - DNA, 35 bp, Artificial Sequence
  Synthetic oligonucleotide
attcgcctgcccgccacgttcacaaccacatctgg

SEQ ID NO: 5558 - DNA, 35 bp, Artificial Sequence
  Synthetic oligonucleotide
tcctccgcccccaaagtgctctatttaagcctaca

SEQ ID NO: 5559 - DNA, 35 bp, Artificial Sequence
  Synthetic oligonucleotide
tacatgccaccatcacaacggccaacacctcgggg

SEQ ID NO: 5560 - DNA, 35 bp, Artificial Sequence
  Synthetic oligonucleotide
atcggagcaatcgcccacgccatttccttcccatc

SEQ ID NO: 5561 - DNA, 35 bp, Artificial Sequence
  Synthetic oligonucleotide
ttgtgccccctcctcatttcgcctggtagcccaca

SEQ ID NO: 5562 - DNA, 35 bp, Artificial Sequence
  Synthetic oligonucleotide
acacaccgactctctacccgtagactgttcctgtc

SEQ ID NO: 5563 - DNA, 35 bp, Artificial Sequence
  Synthetic oligonucleotide
gcacgccccttgctcggtattcgtgtgcgttctct

SEQ ID NO: 5564 - DNA, 36 bp, Artificial Sequence
  Synthetic oligonucleotide
tcctcacgcccactacgccgaactggacgatgtcca

SEQ ID NO: 5565 - DNA, 35 bp, Artificial Sequence
  Synthetic oligonucleotide
aaccgccataacatatgtagtactctgcctcccca

SEQ ID NO: 5566 - DNA, 35 bp, Artificial Sequence
  Synthetic oligonucleotide
atcctgtcccgagtctcctgcgcaccaccatggcc

SEQ ID NO: 5567 - DNA, 38 bp, Artificial Sequence
  Synthetic oligonucleotide
atgccgaagcagggaaggttactagcggggggtgatga

SEQ ID NO: 5568 - DNA, 36 bp, Artificial Sequence
  Synthetic oligonucleotide
ataccacgccctgccttgcacctaagttctgcatta

SEQ ID NO: 5569 - DNA, 35 bp, Artificial Sequence
  Synthetic oligonucleotide
aactcatcacgctctctgcggtgctttgcctacta

SEQ ID NO: 5570 - DNA, 35 bp, Artificial Sequence
  Synthetic oligonucleotide
tccacctaaccgctaccgaccgtttatacacgcca

SEQ ID NO: 5571 - DNA, 37 bp, Artificial Sequence
  Synthetic oligonucleotide
gacacggactcagcctcatctctgccctgcccatgga

SEQ ID NO: 5572 - DNA, 35 bp, Artificial Sequence
  Synthetic oligonucleotide
atcgctcacaactgaatgacattatatctcgcccc

SEQ ID NO: 5573 - DNA, 35 bp, Artificial Sequence
  Synthetic oligonucleotide
tcaccctcggagtttcaagttttcgcctggttgtc

SEQ ID NO: 5574 - DNA, 38 bp, Artificial Sequence
  Synthetic oligonucleotide
tccgaccactctgcattctattctgcgactgcccgtga

SEQ ID NO: 5575 - DNA, 35 bp, Artificial Sequence
  Synthetic oligonucleotide
gctgccgtactcatcccatgtcatttggctatccc

SEQ ID NO: 5576 - DNA, 35 bp, Artificial Sequence
  Synthetic oligonucleotide
accttgccgcaccatcttaatacgccccgcccgat

SEQ ID NO: 5577 - DNA, 36 bp, Artificial Sequence
  Synthetic oligonucleotide
ttgtccggccttcctgcccgtgtccactcccactca

SEQ ID NO: 5578 - DNA, 36 bp, Artificial Sequence
  Synthetic oligonucleotide
accggactggtcgcccgcttcttcaaagtgcctctc

SEQ ID NO: 5579 - DNA, 35 bp, Artificial Sequence
  Synthetic oligonucleotide
gagacacgggagaaaaaaggggtcagggtgggcta

SEQ ID NO: 5580 - DNA, 36 bp, Artificial Sequence
  Synthetic oligonucleotide
tccgaacgccccttgtctaagtctcgccccattgta

SEQ ID NO: 5581 - DNA, 37 bp, Artificial Sequence
  Synthetic oligonucleotide
ggagacgtggggcggaacggaggctagtgaaggttga

SEQ ID NO: 5582 - DNA, 35 bp, Artificial Sequence
  Synthetic oligonucleotide
atatgccccctcgctcgactttgcctagttcgcct

SEQ ID NO: 5583 - DNA, 36 bp, Artificial Sequence
  Synthetic oligonucleotide
taccgacactcctgccctagcctacgactctgctca

SEQ ID NO: 5584 - DNA, 35 bp, Artificial Sequence
  Synthetic oligonucleotide
ataccccatgccttgatctcgttcgtggcccctgc

SEQ ID NO: 5585 - DNA, 36 bp, Artificial Sequence
  Synthetic oligonucleotide
ttccacggcccgcctgttttgccccctgcgatttca

SEQ ID NO: 5586 - DNA, 36 bp, Artificial Sequence
  Synthetic oligonucleotide
cagccatcccgctcgctactctgatcaccggtcggc

SEQ ID NO: 5587 - DNA, 35 bp, Artificial Sequence
  Synthetic oligonucleotide
accagcccaatatcataggttacctcccctaccac

SEQ ID NO: 5588 - DNA, 36 bp, Artificial Sequence
  Synthetic oligonucleotide
tcacgccccgcgagcttccctggttacctttgctat

SEQ ID NO: 5589 - DNA, 35 bp, Artificial Sequence
  Synthetic oligonucleotide
accgaatacgctgagggtctaccgccatccttatc

SEQ ID NO: 5590 - DNA, 35 bp, Artificial Sequence
  Synthetic oligonucleotide
gctcactctccgtgctcgccgcatttctgttgctc

SEQ ID NO: 5591 - DNA, 37 bp, Artificial Sequence
  Synthetic oligonucleotide
gctgcctgcccatatgctacccgccgtccaagtacga

SEQ ID NO: 5592 - DNA, 35 bp, Artificial Sequence
  Synthetic oligonucleotide
taggagcgaacagctctcctccacctcacgtgccc

SEQ ID NO: 5593 - DNA, 36 bp, Artificial Sequence
  Synthetic oligonucleotide
gcgacaccctcctcacacacactgcgacctaagtca

SEQ ID NO: 5594 - DNA, 36 bp, Artificial Sequence
  Synthetic oligonucleotide
gaaccccccctatcgtgcctcggagcctgctttcga

SEQ ID NO: 5595 - DNA, 35 bp, Artificial Sequence
  Synthetic oligonucleotide
ggacaacctcctctcatcttggctaggcttctttc

SEQ ID NO: 5596 - DNA, 36 bp, Artificial Sequence
  Synthetic oligonucleotide
tacggtgggagatcggaaaaggggtggggtggcaca

SEQ ID NO: 5597 - DNA, 36 bp, Artificial Sequence
  Synthetic oligonucleotide
tccattgcgtccaatttttgtttcgcgccaccctga

SEQ ID NO: 5598 - DNA, 36 bp, Artificial Sequence
  Synthetic oligonucleotide
atgctccactagacatcactatgacccagctttcca

SEQ ID NO: 5599 - DNA, 37 bp, Artificial Sequence
  Synthetic oligonucleotide
gggtggggtatgattcgttgcttggggactctgggga

SEQ ID NO: 5600 - DNA, 35 bp, Artificial Sequence
  Synthetic oligonucleotide
tatgcacctcacgcagccagccaccattattctac

SEQ ID NO: 5601 - DNA, 38 bp, Artificial Sequence
  Synthetic oligonucleotide
tcccaacgcccccactgtacgttagtactctgacctga

SEQ ID NO: 5602 - DNA, 38 bp, Artificial Sequence
  Synthetic oligonucleotide
accgcaaggagccgccgttagccacctgttcaccttga

SEQ ID NO: 5603 - DNA, 35 bp, Artificial Sequence
  Synthetic oligonucleotide
accacacccccgcgccaagtactcttacggcctca

SEQ ID NO: 5604 - DNA, 37 bp, Artificial Sequence
  Synthetic oligonucleotide
tctcagcacagttctgcgtcatcgccttcttttccga

SEQ ID NO: 5605 - DNA, 37 bp, Artificial Sequence
  Synthetic oligonucleotide
aaccccgcaccacacacgcagcagccgaccttcgcga

SEQ ID NO: 5606 - DNA, 36 bp, Artificial Sequence
  Synthetic oligonucleotide
tcgaatgggagagtggcatgggggagagggggagga

SEQ ID NO: 5607 - DNA, 33 bp, Artificial Sequence
  Synthetic oligonucleotide
atgtcacgctgctccgcccaccacattttgacg

SEQ ID NO: 5608 - DNA, 36 bp, Artificial Sequence
  Synthetic oligonucleotide
gaccacgtcctatcttcctttcggtgacgatccaca

SEQ ID NO: 5609 - DNA, 37 bp, Artificial Sequence
  Synthetic oligonucleotide
ggtacgtggggagtagcaaagggggtgtgactgggga

SEQ ID NO: 5610 - DNA, 36 bp, Artificial Sequence
  Synthetic oligonucleotide
tttggccacccagctcaccgcggtacctgttcctca

SEQ ID NO: 5611 - DNA, 35 bp, Artificial Sequence
  Synthetic oligonucleotide
atccacccctgatcactgcctgggcctttcatgga

SEQ ID NO: 5612 - DNA, 35 bp, Artificial Sequence
  Synthetic oligonucleotide
gcctcaggccgttttgcgccatccgcaggctcccc

SEQ ID NO: 5613 - DNA, 35 bp, Artificial Sequence
  Synthetic oligonucleotide
acaacgccggctccccttagatatatgccacacct

SEQ ID NO: 5614 - DNA, 36 bp, Artificial Sequence
  Synthetic oligonucleotide
tatgaccgacgccttccgcctgggatttgccacata

SEQ ID NO: 5615 - DNA, 36 bp, Artificial Sequence
  Synthetic oligonucleotide
acacccatccgctgagaattgtacttgtgtgcacaa

SEQ ID NO: 5616 - DNA, 35 bp, Artificial Sequence
  Synthetic oligonucleotide
agcccatgactttgctgcaatactccactgccgac

SEQ ID NO: 5617 - DNA, 35 bp, Artificial Sequence
  Synthetic oligonucleotide
gaaggtggtgataggcatgaagtgggtgggaatat

SEQ ID NO: 5618 - DNA, 35 bp, Artificial Sequence
  Synthetic oligonucleotide
gagaagcgcgcgctctgttacgtaccgcccccctc

SEQ ID NO: 5619 - DNA, 35 bp, Artificial Sequence
  Synthetic oligonucleotide
tcctccacccaccccctccgtggcacatcttggtt

SEQ ID NO: 5620 - DNA, 35 bp, Artificial Sequence
  Synthetic oligonucleotide
cagaatcacagcaattctgttccatggtccatccc

SEQ ID NO: 5621 - DNA, 35 bp, Artificial Sequence
  Synthetic oligonucleotide
ttaccctcattgtgcccgcgttccaaccactctgg

SEQ ID NO: 5622 - DNA, 36 bp, Artificial Sequence
  Synthetic oligonucleotide
ggatcaccgcctgtcctgttctgccgtactttaaga

SEQ ID NO: 5623 - DNA, 35 bp, Artificial Sequence
  Synthetic oligonucleotide
taggatgtcccgccccccccgttacctgtccttgc

SEQ ID NO: 5624 - DNA, 35 bp, Artificial Sequence
  Synthetic oligonucleotide
tcctccacgcgaccagttccattgccacaccttgc

SEQ ID NO: 5625 - DNA, 38 bp, Artificial Sequence
  Synthetic oligonucleotide
gcctgcacacacctgcctaagccccgttcttcatctga

SEQ ID NO: 5626 - DNA, 35 bp, Artificial Sequence
  Synthetic oligonucleotide
ttcgacgtcacaccagctgccctcccctttgcaat

SEQ ID NO: 5627 - DNA, 36 bp, Artificial Sequence
  Synthetic oligonucleotide
gatgtccgccctcaattgctttatccctgtgaacga

SEQ ID NO: 5628 - DNA, 35 bp, Artificial Sequence
  Synthetic oligonucleotide
tgccctcgaaggtcttaatcctgctcccacctatc

SEQ ID NO: 5629 - DNA, 35 bp, Artificial Sequence
  Synthetic oligonucleotide
gcccacctccgaattattgaattggtttgcccaaa

SEQ ID NO: 5630 - DNA, 36 bp, Artificial Sequence
  Synthetic oligonucleotide
tcatcccgtcccgaacccgtcctgacttatgccaca

SEQ ID NO: 5631 - DNA, 35 bp, Artificial Sequence
  Synthetic oligonucleotide
gattgggggagtggtgggcgagggcgggagtgggt

SEQ ID NO: 5632 - DNA, 36 bp, Artificial Sequence
  Synthetic oligonucleotide
acaccaccgtacggacaataattctacctgttctca

SEQ ID NO: 5633 - DNA, 35 bp, Artificial Sequence
  Synthetic oligonucleotide
gcaggctccgttcaccatgctttctcgaatatccc

SEQ ID NO: 5634 - DNA, 35 bp, Artificial Sequence
  Synthetic oligonucleotide
tactccaccagtgcatagttccgtccctttctagg

SEQ ID NO: 5635 - DNA, 35 bp, Artificial Sequence
  Synthetic oligonucleotide
ataccaactgccccggcacactgcatctgctcctt

SEQ ID NO: 5636 - DNA, 31 bp, Artificial Sequence
  Synthetic oligonucleotide
aaagagtggctggggtggggaggaaggggca

SEQ ID NO: 5637 - DNA, 35 bp, Artificial Sequence
  Synthetic oligonucleotide
tatcacccccgcggtcgctacatccatagttttgc

SEQ ID NO: 5638 - DNA, 35 bp, Artificial Sequence
  Synthetic oligonucleotide
atcccccatccaaccgtgcttcccgacagcaaacc

SEQ ID NO: 5639 - DNA, 36 bp, Artificial Sequence
  Synthetic oligonucleotide
atccacgtagccctggtcagcacccgttccgcccga

SEQ ID NO: 5640 - DNA, 36 bp, Artificial Sequence
  Synthetic oligonucleotide
tcagcctggcctcaaggatcgccctccctccgctca

SEQ ID NO: 5641 - DNA, 35 bp, Artificial Sequence
  Synthetic oligonucleotide
tacttgccatcacgtcgttctcacggcctgctcta

SEQ ID NO: 5642 - DNA, 35 bp, Artificial Sequence
  Synthetic oligonucleotide
tgtgcaccgtcggccactaacacacaccattcagc

SEQ ID NO: 5643 - DNA, 35 bp, Artificial Sequence
  Synthetic oligonucleotide
tacagcccttatcccgtctacatcttggcttggcc

SEQ ID NO: 5644 - DNA, 36 bp, Artificial Sequence
  Synthetic oligonucleotide
accacgaccgtctcaacccctgtgcttatctcgcca

SEQ ID NO: 5645 - DNA, 36 bp, Artificial Sequence
  Synthetic oligonucleotide
aaagtaggggaggaggccatgggagaaggggaacaa

SEQ ID NO: 5646 - DNA, 37 bp, Artificial Sequence
  Synthetic oligonucleotide
gtccccgcaccacctcttgtagacgcctttaatctga

SEQ ID NO: 5647 - DNA, 38 bp, Artificial Sequence
  Synthetic oligonucleotide
cacgtgcgtgcgtaccactttgacacctccctgcctga

SEQ ID NO: 5648 - DNA, 38 bp, Artificial Sequence
  Synthetic oligonucleotide
tcccagatccgcggatcccgtttgactacacctcctga

SEQ ID NO: 5649 - DNA, 35 bp, Artificial Sequence
  Synthetic oligonucleotide
ttagcatcccactccgtcgttcgtttccctcttgg

SEQ ID NO: 5650 - DNA, 35 bp, Artificial Sequence
  Synthetic oligonucleotide
accccgttccacctaagtcctgcccttgcagcacg

SEQ ID NO: 5651 - DNA, 35 bp, Artificial Sequence
  Synthetic oligonucleotide
aacaagggcgggaaatggggggcaaatacacggcg

SEQ ID NO: 5652 - DNA, 36 bp, Artificial Sequence
  Synthetic oligonucleotide
tcgtacgcacatccgcacttttgtctcaccactcga

SEQ ID NO: 5653 - DNA, 36 bp, Artificial Sequence
  Synthetic oligonucleotide
gccaccttagtattgcttcccttgtctcgtatccta

SEQ ID NO: 5654 - DNA, 35 bp, Artificial Sequence
  Synthetic oligonucleotide
aagagcgtgctgcaaccccgtcttcccttggcgcc

SEQ ID NO: 5655 - DNA, 36 bp, Artificial Sequence
  Synthetic oligonucleotide
acccacctcaatccttcctacctaatgtgctaggca

SEQ ID NO: 5656 - DNA, 36 bp, Artificial Sequence
  Synthetic oligonucleotide
tgtgttcccgccctgactcttttcgcttactgttta

SEQ ID NO: 5657 - DNA, 38 bp, Artificial Sequence
  Synthetic oligonucleotide
gacccccttccctgctatatagttctgcacccgtgtga

SEQ ID NO: 5658 - DNA, 37 bp, Artificial Sequence
  Synthetic oligonucleotide
tcagcacactgtcttgccttcgacctgcctctcccga

SEQ ID NO: 5659 - DNA, 35 bp, Artificial Sequence
  Synthetic oligonucleotide
tactgccgccaccagtgttctgtccccatttgcgc

SEQ ID NO: 5660 - DNA, 35 bp, Artificial Sequence
  Synthetic oligonucleotide
gtgatcggccaaggggagtagtggggggtggtgtg

SEQ ID NO: 5661 - DNA, 38 bp, Artificial Sequence
  Synthetic oligonucleotide
tcaccatcccgcggggccgttccctctacgctatatga

SEQ ID NO: 5662 - DNA, 36 bp, Artificial Sequence
  Synthetic oligonucleotide
gtcaacactgcactgctttgtatttccttgatttaa

SEQ ID NO: 5663 - DNA, 35 bp, Artificial Sequence
  Synthetic oligonucleotide
tgccaccgcccctgtattatctcctacccatacag

SEQ ID NO: 5664 - DNA, 35 bp, Artificial Sequence
  Synthetic oligonucleotide
acgcccaccgcatttgaacccaagcccggctgttt

SEQ ID NO: 5665 - DNA, 36 bp, Artificial Sequence
  Synthetic oligonucleotide
gcatccgtccaccatccgcccggccagtccgtttca

SEQ ID NO: 5666 - DNA, 35 bp, Artificial Sequence
  Synthetic oligonucleotide
gctgcttgcagtagctttcatttccttcaccctcg

SEQ ID NO: 5667 - DNA, 35 bp, Artificial Sequence
  Synthetic oligonucleotide
gtaacaccgacttcgctctatgctgacctctttac

SEQ ID NO: 5668 - DNA, 35 bp, Artificial Sequence
  Synthetic oligonucleotide
atgacccgacatcctgcttacaattagtacatgct

SEQ ID NO: 5669 - DNA, 38 bp, Artificial Sequence
  Synthetic oligonucleotide
atcgcgcctacagcgtggtttcatctcccctttcgtga

SEQ ID NO: 5670 - DNA, 37 bp, Artificial Sequence
  Synthetic oligonucleotide
gtggggggacggggggagagaggggcgacgaggttga

SEQ ID NO: 5671 - DNA, 35 bp, Artificial Sequence
  Synthetic oligonucleotide
gacgatgtcgtaaacacaactccgccctttgccca

SEQ ID NO: 5672 - DNA, 35 bp, Artificial Sequence
  Synthetic oligonucleotide
accctccacactcagtggcatcaccctgaccctgt

SEQ ID NO: 5673 - DNA, 35 bp, Artificial Sequence
  Synthetic oligonucleotide
tcgagtcccgtgccgtaccctgtttttcccccgaa

SEQ ID NO: 5674 - DNA, 35 bp, Artificial Sequence
  Synthetic oligonucleotide
acaccatgctctacccggaccaacagacataccac

SEQ ID NO: 5675 - DNA, 35 bp, Artificial Sequence
  Synthetic oligonucleotide
agtgtgcaccccctgaccgcagtgacagcccctcc

SEQ ID NO: 5676 - DNA, 36 bp, Artificial Sequence
  Synthetic oligonucleotide
gacgaggtaccagtggaggggaagggggtattagaa

SEQ ID NO: 5677 - DNA, 35 bp, Artificial Sequence
  Synthetic oligonucleotide
tgcaaagccctgactttagtagcttataccctccc

SEQ ID NO: 5678 - DNA, 37 bp, Artificial Sequence
  Synthetic oligonucleotide
gctcgctgccggttaacagccatcctacccaacccga

SEQ ID NO: 5679 - DNA, 37 bp, Artificial Sequence
  Synthetic oligonucleotide
tgtgcaccacctccatgctacaaccgacaattaggga

SEQ ID NO: 5680 - DNA, 38 bp, Artificial Sequence
  Synthetic oligonucleotide
tccatctccagcccttaccgccctgtcctaaatgttga

SEQ ID NO: 5681 - DNA, 36 bp, Artificial Sequence
  Synthetic oligonucleotide
gttgtctcccccccacatcgtgtcccgaaccgacga

SEQ ID NO: 5682 - DNA, 37 bp, Artificial Sequence
  Synthetic oligonucleotide
gtgccatctgcctcaatattctaacgacccccaccga

SEQ ID NO: 5683 - DNA, 35 bp, Artificial Sequence
  Synthetic oligonucleotide
gttccactgcccatgttgctactttaattcgccat

SEQ ID NO: 5684 - DNA, 36 bp, Artificial Sequence
  Synthetic oligonucleotide
gatcccgacgaaccgtcgacatgacctgacccctca

SEQ ID NO: 5685 - DNA, 35 bp, Artificial Sequence
  Synthetic oligonucleotide
tccgatcgctacctttgcttggggactcactatct

SEQ ID NO: 5686 - DNA, 35 bp, Artificial Sequence
  Synthetic oligonucleotide
actatagcacggcggccgcacccttgtccaccccg

SEQ ID NO: 5687 - DNA, 35 bp, Artificial Sequence
  Synthetic oligonucleotide
gacaaccacctaagcccgcccgcctggagtgtcac

SEQ ID NO: 5688 - DNA, 34 bp, Artificial Sequence
  Synthetic oligonucleotide
tgtgatccgcaagatctgatcacatgccttccct

SEQ ID NO: 5689 - DNA, 37 bp, Artificial Sequence
  Synthetic oligonucleotide
cgcctgccaacccgccgtccccaataacacgtcccga

SEQ ID NO: 5690 - DNA, 36 bp, Artificial Sequence
  Synthetic oligonucleotide
tccgctccccacgggtctacactgggttctacctca

SEQ ID NO: 5691 - DNA, 35 bp, Artificial Sequence
  Synthetic oligonucleotide
ccgatccggtcattgctcccgacgtaccacctacc

SEQ ID NO: 5692 - DNA, 35 bp, Artificial Sequence
  Synthetic oligonucleotide
gactgtcccccggttcttggcgctcttgggccctt

SEQ ID NO: 5693 - DNA, 35 bp, Artificial Sequence
  Synthetic oligonucleotide
acccggaacaccccgacgcgaatttaccgacaaca

SEQ ID NO: 5694 - DNA, 35 bp, Artificial Sequence
  Synthetic oligonucleotide
gtgtaggccccacttgttgcgcagctcttccacct

SEQ ID NO: 5695 - DNA, 35 bp, Artificial Sequence
  Synthetic oligonucleotide
ggacactctgccttgtttgttttgttcgctcatgt

SEQ ID NO: 5696 - DNA, 35 bp, Artificial Sequence
  Synthetic oligonucleotide
cttccacccctcccagcgagagcgagcccgttgtc

SEQ ID NO: 5697 - DNA, 35 bp, Artificial Sequence
  Synthetic oligonucleotide
gatcaccctcctgcctgtcgattcgtccgcctctt

SEQ ID NO: 5698 - DNA, 34 bp, Artificial Sequence
  Synthetic oligonucleotide
gtgatccccaccaggtccgcccgaccacaccact

SEQ ID NO: 5699 - DNA, 35 bp, Artificial Sequence
  Synthetic oligonucleotide
gccaccctgcggattcgtttctcaccacccgtgtc

SEQ ID NO: 5700 - DNA, 35 bp, Artificial Sequence
  Synthetic oligonucleotide
acaccacatcatcgattcgcggaccgcactcccct

SEQ ID NO: 5701 - DNA, 37 bp, Artificial Sequence
  Synthetic oligonucleotide
gaaggggccactcggggggagggtttccactagggga

SEQ ID NO: 5702 - DNA, 35 bp, Artificial Sequence
  Synthetic oligonucleotide
gtttccgccccatttccgtgactactcaccatgta

SEQ ID NO: 5703 - DNA, 38 bp, Artificial Sequence
  Synthetic oligonucleotide
agcacctgttcctccgccgacttagtgccttccattga

SEQ ID NO: 5704 - DNA, 36 bp, Artificial Sequence
  Synthetic oligonucleotide
attctccccagtatgttacgcatcgctagtgcctca

SEQ ID NO: 5705 - DNA, 35 bp, Artificial Sequence
  Synthetic oligonucleotide
accaccctccgagcctcgttctgtccgttgttacc

SEQ ID NO: 5706 - DNA, 35 bp, Artificial Sequence
  Synthetic oligonucleotide
tccccctgaccgcacttctagacgactgccacaca

SEQ ID NO: 5707 - DNA, 35 bp, Artificial Sequence
  Synthetic oligonucleotide
tgagacgccgcactctcgcctggcccttccctgtc

SEQ ID NO: 5708 - DNA, 36 bp, Artificial Sequence
  Synthetic oligonucleotide
tcgagacacaacccactgacttcttagctgacatta

SEQ ID NO: 5709 - DNA, 36 bp, Artificial Sequence
  Synthetic oligonucleotide
tacccatcgggtgcctaacacatcttcctgtcctta

SEQ ID NO: 5710 - DNA, 37 bp, Artificial Sequence
  Synthetic oligonucleotide
agcatcagccacttcgccgtccaccctttcatgcaga

SEQ ID NO: 5711 - DNA, 35 bp, Artificial Sequence
  Synthetic oligonucleotide
tacatagccactcctctggaatgttttctagccta

SEQ ID NO: 5712 - DNA, 37 bp, Artificial Sequence
  Synthetic oligonucleotide
tgcacgacaaatcgtcttctttcgcgctctcccgtga

SEQ ID NO: 5713 - DNA, 36 bp, Artificial Sequence
  Synthetic oligonucleotide
gtacccgcccatgctgccttccattcgtacatacta

SEQ ID NO: 5714 - DNA, 36 bp, Artificial Sequence
  Synthetic oligonucleotide
gtgtggaccgaggggggggctatctgacggagggtg

SEQ ID NO: 5715 - DNA, 34 bp, Artificial Sequence
  Synthetic oligonucleotide
tgcctcgcctgtccccacttgcttgtttttggct

SEQ ID NO: 5716 - DNA, 35 bp, Artificial Sequence
  Synthetic oligonucleotide
gaccaccgcaaggtatcggtttcataacacttctc

SEQ ID NO: 5717 - DNA, 35 bp, Artificial Sequence
  Synthetic oligonucleotide
gcccttgaccaactccctacctgcacgaggtagtc

SEQ ID NO: 5718 - DNA, 35 bp, Artificial Sequence
  Synthetic oligonucleotide
gcgagaggggagcaaacacagggaaacagtaaagc

SEQ ID NO: 5719 - DNA, 36 bp, Artificial Sequence
  Synthetic oligonucleotide
tacgggtgggcaatcggtggggtaaggaaatagggg

SEQ ID NO: 5720 - DNA, 37 bp, Artificial Sequence
  Synthetic oligonucleotide
gcctcgcccctgttgccctttcgctcactttcgacga

SEQ ID NO: 5721 - DNA, 35 bp, Artificial Sequence
  Synthetic oligonucleotide
actcaacatacccagccgctcccaccggacgctcc

SEQ ID NO: 5722 - DNA, 36 bp, Artificial Sequence
  Synthetic oligonucleotide
taccacccctgcctaagccagccaaaatctcttgaa

SEQ ID NO: 5723 - DNA, 35 bp, Artificial Sequence
  Synthetic oligonucleotide
gtggagtcaacgcatcgtcgccgccctcgctccct

SEQ ID NO: 5724 - DNA, 38 bp, Artificial Sequence
  Synthetic oligonucleotide
accttcaccatccgctcgtgctgtttttggcctattga

SEQ ID NO: 5725 - DNA, 35 bp, Artificial Sequence
  Synthetic oligonucleotide
tgaaaccccgcctatgcaacatccatggcgcctcc

SEQ ID NO: 5726 - DNA, 35 bp, Artificial Sequence
  Synthetic oligonucleotide
gcccccgcccattcggcacatcctcaccgtctccc

SEQ ID NO: 5727 - DNA, 35 bp, Artificial Sequence
  Synthetic oligonucleotide
acatactgcccctgattcgccgatttccctggaca

SEQ ID NO: 5728 - DNA, 35 bp, Artificial Sequence
  Synthetic oligonucleotide
ggatggaaccaccgacccctgccttctgctcattc

SEQ ID NO: 5729 - DNA, 35 bp, Artificial Sequence
  Synthetic oligonucleotide
gatcggacccttgctgattcgttctcgtttgtcca

SEQ ID NO: 5730 - DNA, 35 bp, Artificial Sequence
  Synthetic oligonucleotide
gttgcactgctgttatgtcacctctcggcacaccc

SEQ ID NO: 5731 - DNA, 35 bp, Artificial Sequence
  Synthetic oligonucleotide
tgctcgcactgtccccctcacgcgtagttatacct

SEQ ID NO: 5732 - DNA, 35 bp, Artificial Sequence
  Synthetic oligonucleotide
gatgtgcctcaatgccgctcgtacgttccaccgct

SEQ ID NO: 5733 - DNA, 35 bp, Artificial Sequence
  Synthetic oligonucleotide
gactgccagaggcccacgccctactttttcccacc

SEQ ID NO: 5734 - DNA, 35 bp, Artificial Sequence
  Synthetic oligonucleotide
tcttcactcccaccgctgaccgacccacctgtgcg

SEQ ID NO: 5735 - DNA, 37 bp, Artificial Sequence
  Synthetic oligonucleotide
agtacgtcccttctgtactccaccactgcttatcgga

SEQ ID NO: 5736 - DNA, 37 bp, Artificial Sequence
  Synthetic oligonucleotide
gctccatccagccgttcctactctcttcccatgatga

SEQ ID NO: 5737 - DNA, 35 bp, Artificial Sequence
  Synthetic oligonucleotide
ttccgttccgctcccctcattcataggtcttcctg

SEQ ID NO: 5738 - DNA, 36 bp, Artificial Sequence
  Synthetic oligonucleotide
tgtgacatcctgatgcgtctctacctgtcttaccta

SEQ ID NO: 5739 - DNA, 35 bp, Artificial Sequence
  Synthetic oligonucleotide
acaatggccaccacgcacctgtaactacacgcctt

SEQ ID NO: 5740 - DNA, 35 bp, Artificial Sequence
  Synthetic oligonucleotide
atggccacataccaccgccactaggtccgttatca

SEQ ID NO: 5741 - DNA, 32 bp, Artificial Sequence
  Synthetic oligonucleotide
atggttgcctgccacctgtcccgtattcatct

SEQ ID NO: 5742 - DNA, 35 bp, Artificial Sequence
  Synthetic oligonucleotide
gccacctatgaacctgatactgccacctttctcaa

SEQ ID NO: 5743 - DNA, 35 bp, Artificial Sequence
  Synthetic oligonucleotide
tccgacgtcgcccttcctgattattccagccggac

SEQ ID NO: 5744 - DNA, 36 bp, Artificial Sequence
  Synthetic oligonucleotide
ttaacggtgcgcaccatctccacttagcgccctcca

SEQ ID NO: 5745 - DNA, 35 bp, Artificial Sequence
  Synthetic oligonucleotide
gactggctcacttgcccgcgctctaggccctctac

SEQ ID NO: 5746 - DNA, 35 bp, Artificial Sequence
  Synthetic oligonucleotide
gaacacgcccacgaacagtaaccgttaccacccac

SEQ ID NO: 5747 - DNA, 37 bp, Artificial Sequence
  Synthetic oligonucleotide
taacccgcgccacttctatttctgccctccacaagga

SEQ ID NO: 5748 - DNA, 38 bp, Artificial Sequence
  Synthetic oligonucleotide
tcacctaccactggcgccgctcccctccgtagatctga

SEQ ID NO: 5749 - DNA, 35 bp, Artificial Sequence
  Synthetic oligonucleotide
tgtacgactacagccctttctcctgcatttgcgcc

SEQ ID NO: 5750 - DNA, 35 bp, Artificial Sequence
  Synthetic oligonucleotide
atcgccactcctgtcccgccccttcaaacagaagg

SEQ ID NO: 5751 - DNA, 35 bp, Artificial Sequence
  Synthetic oligonucleotide
tcagagggggaggaggatttaacaccgaagaagta

SEQ ID NO: 5752 - DNA, 35 bp, Artificial Sequence
  Synthetic oligonucleotide
acccccgactccttggcatctatggccatcattta

SEQ ID NO: 5753 - DNA, 35 bp, Artificial Sequence
  Synthetic oligonucleotide
tctccacaacatttgtgctcttcatttgctgctac

SEQ ID NO: 5754 - DNA, 38 bp, Artificial Sequence
  Synthetic oligonucleotide
ttcctccgcaccacgttgccctgtccgtcccttactga

SEQ ID NO: 5755 - DNA, 36 bp, Artificial Sequence
  Synthetic oligonucleotide
tgtgcgcccacttatgcaacggacccttttatctta

SEQ ID NO: 5756 - DNA, 37 bp, Artificial Sequence
  Synthetic oligonucleotide
tcgcccaccccaccacatcaagactcgtatctttgga

SEQ ID NO: 5757 - DNA, 35 bp, Artificial Sequence
  Synthetic oligonucleotide
gatggcgttagggcggggggaaaggtggtcaagtg

SEQ ID NO: 5758 - DNA, 35 bp, Artificial Sequence
  Synthetic oligonucleotide
tcgccaccacgttttttgcttaatgttacctccca

SEQ ID NO: 5759 - DNA, 38 bp, Artificial Sequence
  Synthetic oligonucleotide
acctccacccgcatactgaaggacccattagtccgtga

SEQ ID NO: 5760 - DNA, 36 bp, Artificial Sequence
  Synthetic oligonucleotide
tccatccctgttgtcgtttccgtaccctgtggtaca

SEQ ID NO: 5761 - DNA, 37 bp, Artificial Sequence
  Synthetic oligonucleotide
tcatagggtgggaatgggtaggtacggcgtggggaga

SEQ ID NO: 5762 - DNA, 35 bp, Artificial Sequence
  Synthetic oligonucleotide
tgaggccattcgctcgcacctatgcccttctgttt

SEQ ID NO: 5763 - DNA, 35 bp, Artificial Sequence
  Synthetic oligonucleotide
gccggacgcccgtccgttcttgacgacctccattc

SEQ ID NO: 5764 - DNA, 37 bp, Artificial Sequence
  Synthetic oligonucleotide
atgtcgaggggaaggaggagggtaaggaactagccga

SEQ ID NO: 5765 - DNA, 35 bp, Artificial Sequence
  Synthetic oligonucleotide
tcatcatagcccgctcgcagtgccaccactcccgt

SEQ ID NO: 5766 - DNA, 35 bp, Artificial Sequence
  Synthetic oligonucleotide
gcccgccgccccatcatccagcctgtcgaatgccg

SEQ ID NO: 5767 - DNA, 35 bp, Artificial Sequence
  Synthetic oligonucleotide
atgacacgctcaatgaaactgtaccgcctcacgcc

SEQ ID NO: 5768 - DNA, 35 bp, Artificial Sequence
  Synthetic oligonucleotide
tagaaccccggttggaacgtaaccctggctaccac

SEQ ID NO: 5769 - DNA, 35 bp, Artificial Sequence
  Synthetic oligonucleotide
gccctcagcaagcctgcattacatccttccttgca

SEQ ID NO: 5770 - DNA, 37 bp, Artificial Sequence
  Synthetic oligonucleotide
gatgccgtacctgcgcgcgcataacacacccccatga

SEQ ID NO: 5771 - DNA, 35 bp, Artificial Sequence
  Synthetic oligonucleotide
gagccgcactcacctgtcttgcctgcgcacactac

SEQ ID NO: 5772 - DNA, 35 bp, Artificial Sequence
  Synthetic oligonucleotide
gatgcacgacggccaatttttttcgctacacggtc

SEQ ID NO: 5773 - DNA, 35 bp, Artificial Sequence
  Synthetic oligonucleotide
gccacaccgtccctggctttttccgttcagtaccc

SEQ ID NO: 5774 - DNA, 35 bp, Artificial Sequence
  Synthetic oligonucleotide
tttacccacccatgctgcctctcacactgttgata

SEQ ID NO: 5775 - DNA, 35 bp, Artificial Sequence
  Synthetic oligonucleotide
agtctgaaagcactgcacaccaccagaacacgttc

SEQ ID NO: 5776 - DNA, 36 bp, Artificial Sequence
  Synthetic oligonucleotide
gacaaaccgctatgcgcatatgcatctacttccaca

SEQ ID NO: 5777 - DNA, 36 bp, Artificial Sequence
  Synthetic oligonucleotide
actaccccacgtctcaaagctaacctgcctcgccca

SEQ ID NO: 5778 - DNA, 35 bp, Artificial Sequence
  Synthetic oligonucleotide
tctagccgtagcccttccgtaaagacccagccctc

SEQ ID NO: 5779 - DNA, 37 bp, Artificial Sequence
  Synthetic oligonucleotide
atgccgcaagtcgtcattcagcacaccctaccctaga

SEQ ID NO: 5780 - DNA, 35 bp, Artificial Sequence
  Synthetic oligonucleotide
agttccaccgccccatgaattccagtcgcctgacc

SEQ ID NO: 5781 - DNA, 37 bp, Artificial Sequence
  Synthetic oligonucleotide
acgccctccctctgggcctgctatcctaccaccatga

SEQ ID NO: 5782 - DNA, 35 bp, Artificial Sequence
  Synthetic oligonucleotide
acttgcacgaccacccgcatacatctctggtccac

SEQ ID NO: 5783 - DNA, 37 bp, Artificial Sequence
  Synthetic oligonucleotide
tgaacctgacgccctgtacttgccttataactgccga

SEQ ID NO: 5784 - DNA, 35 bp, Artificial Sequence
  Synthetic oligonucleotide
aagcacgaactctcctgatccagcccaacgttgcc

SEQ ID NO: 5785 - DNA, 35 bp, Artificial Sequence
  Synthetic oligonucleotide
gaccccgctctccgaagtattggccatcaccgacc

SEQ ID NO: 5786 - DNA, 35 bp, Artificial Sequence
  Synthetic oligonucleotide
tccgccccacctagtgcgactcactagacacacca

SEQ ID NO: 5787 - DNA, 34 bp, Artificial Sequence
  Synthetic oligonucleotide
atgcggacaacgccgctcatctgcctattatttc

SEQ ID NO: 5788 - DNA, 36 bp, Artificial Sequence
  Synthetic oligonucleotide
acaacccacccgccggtcctgatcagtatgcccata

SEQ ID NO: 5789 - DNA, 36 bp, Artificial Sequence
  Synthetic oligonucleotide
ttcccatccccgtgctcctgtgactaacgtcctcta

SEQ ID NO: 5790 - DNA, 37 bp, Artificial Sequence
  Synthetic oligonucleotide
gagatgcggagtggggtgggtgggggcaaattaacga

SEQ ID NO: 5791 - DNA, 35 bp, Artificial Sequence
  Synthetic oligonucleotide
gcactgcctttctcgtctcacgcctgggacctccc

SEQ ID NO: 5792 - DNA, 38 bp, Artificial Sequence
  Synthetic oligonucleotide
accctatccccagaactgcccttgtgacggcctcgtga

SEQ ID NO: 5793 - DNA, 37 bp, Artificial Sequence
  Synthetic oligonucleotide
atccatcaccactgatccagccgtgctttccactcga

SEQ ID NO: 5794 - DNA, 38 bp, Artificial Sequence
  Synthetic oligonucleotide
actcccgccaggcgcccgttcccgtacttgttatctga

SEQ ID NO: 5795 - DNA, 35 bp, Artificial Sequence
  Synthetic oligonucleotide
acccgactctcgaatgcctttaagccgaaccacct

SEQ ID NO: 5796 - DNA, 35 bp, Artificial Sequence
  Synthetic oligonucleotide
tccctgcacgccttttcctccgtgtccttgcttga

SEQ ID NO: 5797 - DNA, 35 bp, Artificial Sequence
  Synthetic oligonucleotide
tccaccacacaatcctcccgagacatgggggccac

SEQ ID NO: 5798 - DNA, 35 bp, Artificial Sequence
  Synthetic oligonucleotide
gtctccgcactatcatataacgccctttggaactt

SEQ ID NO: 5799 - DNA, 35 bp, Artificial Sequence
  Synthetic oligonucleotide
gctgtcccccgccccgtgaattaccagcctatatc

SEQ ID NO: 5800 - DNA, 35 bp, Artificial Sequence
  Synthetic oligonucleotide
aacttccgtcggtactgcttgccaatctctctgcc

SEQ ID NO: 5801 - DNA, 37 bp, Artificial Sequence
  Synthetic oligonucleotide
gtgcaaccttgagctctattacatctcgccccttcga

SEQ ID NO: 5802 - DNA, 38 bp, Artificial Sequence
  Synthetic oligonucleotide
gacgggaaggcggagagggtggggattggagtgattga

SEQ ID NO: 5803 - DNA, 35 bp, Artificial Sequence
  Synthetic oligonucleotide
gcgaacccttcagtccttattccctgggcgcttac

SEQ ID NO: 5804 - DNA, 36 bp, Artificial Sequence
  Synthetic oligonucleotide
ttcagccccgctcactctacggatatctgttcctta

SEQ ID NO: 5805 - DNA, 35 bp, Artificial Sequence
  Synthetic oligonucleotide
tggacccgataacatctgctctatcctacctccgg

SEQ ID NO: 5806 - DNA, 35 bp, Artificial Sequence
  Synthetic oligonucleotide
tacactcgccatttcacgctaccccaagcctcgtg

SEQ ID NO: 5807 - DNA, 35 bp, Artificial Sequence
  Synthetic oligonucleotide
gtaccccacggttggccttaacacccctctcctga

SEQ ID NO: 5808 - DNA, 35 bp, Artificial Sequence
  Synthetic oligonucleotide
ttcggaaaccgccctgtccgacctctaatgactcg

SEQ ID NO: 5809 - DNA, 35 bp, Artificial Sequence
  Synthetic oligonucleotide
tctatcccccgaatgtatcgactggtctccttttt

SEQ ID NO: 5810 - DNA, 35 bp, Artificial Sequence
  Synthetic oligonucleotide
taccgcctcgcactggttacccacgcatatctatc

SEQ ID NO: 5811 - DNA, 36 bp, Artificial Sequence
  Synthetic oligonucleotide
gactccgccgaacctttatgccatctgtctgacgta

SEQ ID NO: 5812 - DNA, 38 bp, Artificial Sequence
  Synthetic oligonucleotide
actcacatgccactgcgattgaattgcactacccttga

SEQ ID NO: 5813 - DNA, 36 bp, Artificial Sequence
  Synthetic oligonucleotide
acacccgcacaccccatgatttcttcttgccagcaa

SEQ ID NO: 5814 - DNA, 38 bp, Artificial Sequence
  Synthetic oligonucleotide
accacccactatgacatcccaagctgtaggtccactga

SEQ ID NO: 5815 - DNA, 35 bp, Artificial Sequence
  Synthetic oligonucleotide
tcccaccctagcacacggatacgtggcggtcttac

SEQ ID NO: 5816 - DNA, 35 bp, Artificial Sequence
  Synthetic oligonucleotide
accccgcagaagtctcaaaacttgccatatgccac

SEQ ID NO: 5817 - DNA, 35 bp, Artificial Sequence
  Synthetic oligonucleotide
acgccctcgctgcttgaacaacactttatccttcc

SEQ ID NO: 5818 - DNA, 36 bp, Artificial Sequence
  Synthetic oligonucleotide
gagtgcatccccgcccacgaccctaccgagcctata

SEQ ID NO: 5819 - DNA, 35 bp, Artificial Sequence
  Synthetic oligonucleotide
tccacgcccgatctctatcttttcgtcttttccag

SEQ ID NO: 5820 - DNA, 35 bp, Artificial Sequence
  Synthetic oligonucleotide
atgccatccttcatctattaggcactgcctaccgt

SEQ ID NO: 5821 - DNA, 35 bp, Artificial Sequence
  Synthetic oligonucleotide
ttagccggcctactcccgccctatatgatggccac

SEQ ID NO: 5822 - DNA, 36 bp, Artificial Sequence
  Synthetic oligonucleotide
gacccttcgccccccaccgttcgctgtgcttgttta

SEQ ID NO: 5823 - DNA, 35 bp, Artificial Sequence
  Synthetic oligonucleotide
atgcgacaactcctcacgctacgtcacccgcacac

SEQ ID NO: 5824 - DNA, 37 bp, Artificial Sequence
  Synthetic oligonucleotide
gttaccgaccactaccaactgccacagccgcatacga

SEQ ID NO: 5825 - DNA, 35 bp, Artificial Sequence
  Synthetic oligonucleotide
gagccgtcgactatgccacccttcccgccgaacgc

SEQ ID NO: 5826 - DNA, 35 bp, Artificial Sequence
  Synthetic oligonucleotide
atcaccgcttgccacatttgaactacgcctccgct

SEQ ID NO: 5827 - DNA, 36 bp, Artificial Sequence
  Synthetic oligonucleotide
ttacccgcccactggcttgaccctctgactttgtga

SEQ ID NO: 5828 - DNA, 35 bp, Artificial Sequence
  Synthetic oligonucleotide
ttcgcgacacccgaacgtttgtcacacctacccta

SEQ ID NO: 5829 - DNA, 36 bp, Artificial Sequence
  Synthetic oligonucleotide
tcaacgcccctccactctcacatgcgctacacgaga

SEQ ID NO: 5830 - DNA, 35 bp, Artificial Sequence
  Synthetic oligonucleotide
ttcacggaccgcccactcatttgctcgaccaactc

SEQ ID NO: 5831 - DNA, 35 bp, Artificial Sequence
  Synthetic oligonucleotide
aatcacacgcccggttacatatacccgctctatcc

SEQ ID NO: 5832 - DNA, 35 bp, Artificial Sequence
  Synthetic oligonucleotide
ccaggagcccctcccatgtcatcctattgtcgtcc

SEQ ID NO: 5833 - DNA, 35 bp, Artificial Sequence
  Synthetic oligonucleotide
ttaacgccgccacaactctgctaacgcacagctcc

SEQ ID NO: 5834 - DNA, 37 bp, Artificial Sequence
  Synthetic oligonucleotide
tgcccataacgcactgcttcccgcacctccgcctgga

SEQ ID NO: 5835 - DNA, 35 bp, Artificial Sequence
  Synthetic oligonucleotide
atccgcacctacaaaacccttggctagttctacct

SEQ ID NO: 5836 - DNA, 34 bp, Artificial Sequence
  Synthetic oligonucleotide
tcaacgctgaactctgctgctaccgagtctcctc

SEQ ID NO: 5837 - DNA, 35 bp, Artificial Sequence
  Synthetic oligonucleotide
atgccacagccctctcttgacctctcttacgcgtg

SEQ ID NO: 5838 - DNA, 35 bp, Artificial Sequence
  Synthetic oligonucleotide
gccacctcattataacccatagccacctttgtctg

SEQ ID NO: 5839 - DNA, 36 bp, Artificial Sequence
  Synthetic oligonucleotide
tccacttcccatgacatgacgcctgttttcatacaa

SEQ ID NO: 5840 - DNA, 37 bp, Artificial Sequence
  Synthetic oligonucleotide
tgccgcgcccgttcgtccgtacttcacccctgcctga

SEQ ID NO: 5841 - DNA, 37 bp, Artificial Sequence
  Synthetic oligonucleotide
gacaacctcacaccacggacatcgacgtcctcattga

SEQ ID NO: 5842 - DNA, 37 bp, Artificial Sequence
  Synthetic oligonucleotide
tacaccccgaatggcctgtgcttatgttctctcctga

SEQ ID NO: 5843 - DNA, 35 bp, Artificial Sequence
  Synthetic oligonucleotide
gtccgacctgtcacatgcccccccctgcagctgcc

SEQ ID NO: 5844 - DNA, 37 bp, Artificial Sequence
  Synthetic oligonucleotide
gttgccccgcaccatccttcctctgcctattaatgga

SEQ ID NO: 5845 - DNA, 35 bp, Artificial Sequence
  Synthetic oligonucleotide
gtccacaggcacttggtatgctcgccccccgcaca

SEQ ID NO: 5846 - DNA, 36 bp, Artificial Sequence
  Synthetic oligonucleotide
tccagccttagaagcgcttcccgaccacctttcata

SEQ ID NO: 5847 - DNA, 36 bp, Artificial Sequence
  Synthetic oligonucleotide
acgactcacacgaagacctctctctcctcagcagaa

SEQ ID NO: 5848 - DNA, 35 bp, Artificial Sequence
  Synthetic oligonucleotide
ggatacacagcttgactgcagaccactcctccacc

SEQ ID NO: 5849 - DNA, 38 bp, Artificial Sequence
  Synthetic oligonucleotide
acaaacagccgtcctaccaccctcggctccagccttga

SEQ ID NO: 5850 - DNA, 35 bp, Artificial Sequence
  Synthetic oligonucleotide
gtgtgaggagaggggtgatctagcgtggtgagggg

SEQ ID NO: 5851 - DNA, 35 bp, Artificial Sequence
  Synthetic oligonucleotide
gtgcaacattccacatcgtatctaacttcttgtct

SEQ ID NO: 5852 - DNA, 36 bp, Artificial Sequence
  Synthetic oligonucleotide
acatgcccctgacgcgccttggcaatcccttgacca

SEQ ID NO: 5853 - DNA, 37 bp, Artificial Sequence
  Synthetic oligonucleotide
gagtcgcaccctgattctatccctgtcatttgctgga

SEQ ID NO: 5854 - DNA, 35 bp, Artificial Sequence
  Synthetic oligonucleotide
tagccgcatggcgtcactttcccaccctcgctgca

SEQ ID NO: 5855 - DNA, 35 bp, Artificial Sequence
  Synthetic oligonucleotide
tcctacccacggcatggcaatctctcgtccgcccg

SEQ ID NO: 5856 - DNA, 36 bp, Artificial Sequence
  Synthetic oligonucleotide
tgcgaatgcacatggcataaacaattcctaccccca

SEQ ID NO: 5857 - DNA, 35 bp, Artificial Sequence
  Synthetic oligonucleotide
tcagccgccgcacccggtaggactcaccactctgc

SEQ ID NO: 5858 - DNA, 35 bp, Artificial Sequence
  Synthetic oligonucleotide
acagagcccgcttgattttttgggccttccacccc

SEQ ID NO: 5859 - DNA, 37 bp, Artificial Sequence
  Synthetic oligonucleotide
gcgccactcccttgaaattgcctctcgtttgcaccga

SEQ ID NO: 5860 - DNA, 34 bp, Artificial Sequence
  Synthetic oligonucleotide
acacacgccgaaacactgcaacacctaccattga

SEQ ID NO: 5861 - DNA, 37 bp, Artificial Sequence
  Synthetic oligonucleotide
gatggagggagaaggtggggaggcgtatagggggtga

SEQ ID NO: 5862 - DNA, 35 bp, Artificial Sequence
  Synthetic oligonucleotide
gtcgccctgcccataactacgtgcaaatcacgtac

SEQ ID NO: 5863 - DNA, 35 bp, Artificial Sequence
  Synthetic oligonucleotide
gcaccctcgacgtgcccgttacttttgcaccacta

SEQ ID NO: 5864 - DNA, 37 bp, Artificial Sequence
  Synthetic oligonucleotide
accctccccgacccgttctgcccactgggatacatga

SEQ ID NO: 5865 - DNA, 36 bp, Artificial Sequence
  Synthetic oligonucleotide
attggaatgggtggacggggctgagggggtagggta

SEQ ID NO: 5866 - DNA, 35 bp, Artificial Sequence
  Synthetic oligonucleotide
agcaacgctaatgtccccgcgttaccgtttccatc

SEQ ID NO: 5867 - DNA, 35 bp, Artificial Sequence
  Synthetic oligonucleotide
ttcatagctcggaattgcctcatccaccgccgcac

SEQ ID NO: 5868 - DNA, 35 bp, Artificial Sequence
  Synthetic oligonucleotide
ttcgacccctcagggcgctttgctctactcccgtt

SEQ ID NO: 5869 - DNA, 35 bp, Artificial Sequence
  Synthetic oligonucleotide
accctgtgtcgcgcttatgtccgcctctttgtaca

SEQ ID NO: 5870 - DNA, 35 bp, Artificial Sequence
  Synthetic oligonucleotide
tccgccttgtgccaggttcgccaccactcctccgc

SEQ ID NO: 5871 - DNA, 35 bp, Artificial Sequence
  Synthetic oligonucleotide
ttgcccaacccggactcgcaacaagaacaactatc

SEQ ID NO: 5872 - DNA, 36 bp, Artificial Sequence
  Synthetic oligonucleotide
attgcgcacctaccactccgcctgccgtaccggaca

SEQ ID NO: 5873 - DNA, 37 bp, Artificial Sequence
  Synthetic oligonucleotide
tcatcctgccgcccccgttttttattctgccatcgga

SEQ ID NO: 5874 - DNA, 35 bp, Artificial Sequence
  Synthetic oligonucleotide
attcacatcctccgcccacgcatgcaacgcatcat

SEQ ID NO: 5875 - DNA, 35 bp, Artificial Sequence
  Synthetic oligonucleotide
gttgcacagccccagttgtgcacctctacccatgc

SEQ ID NO: 5876 - DNA, 35 bp, Artificial Sequence
  Synthetic oligonucleotide
gtcaccatgcacaattgaccgcctatggcccgttc

SEQ ID NO: 5877 - DNA, 35 bp, Artificial Sequence
  Synthetic oligonucleotide
gacaccagctgctattaggtccttcaacaacgcgc

SEQ ID NO: 5878 - DNA, 35 bp, Artificial Sequence
  Synthetic oligonucleotide
tacttcgacagcatcgccttgatcgtcctgctttc

SEQ ID NO: 5879 - DNA, 35 bp, Artificial Sequence
  Synthetic oligonucleotide
gcgcaagccgtcgtcttatcccgcgttcacctctc

SEQ ID NO: 5880 - DNA, 35 bp, Artificial Sequence
  Synthetic oligonucleotide
tcacctccgtctgacccctcctccgccgccctggt

SEQ ID NO: 5881 - DNA, 38 bp, Artificial Sequence
  Synthetic oligonucleotide
gttcgttccagcggtccagcacgcaccctcctccatga

SEQ ID NO: 5882 - DNA, 35 bp, Artificial Sequence
  Synthetic oligonucleotide
tccacaaccgctataccacgttcaagcactatctc

SEQ ID NO: 5883 - DNA, 35 bp, Artificial Sequence
  Synthetic oligonucleotide
acccttgcccgcaggatctgtccccacttcacaac

SEQ ID NO: 5884 - DNA, 34 bp, Artificial Sequence
  Synthetic oligonucleotide
gtcccacctaagcgcgtactcctgcggccctcct

SEQ ID NO: 5885 - DNA, 36 bp, Artificial Sequence
  Synthetic oligonucleotide
gacgaaggcatgggggcggttagggcggagaagcaa

SEQ ID NO: 5886 - DNA, 35 bp, Artificial Sequence
  Synthetic oligonucleotide
tgaagccctgttcggcatgccacgctacaacttcc

SEQ ID NO: 5887 - DNA, 35 bp, Artificial Sequence
  Synthetic oligonucleotide
gtctgacgccgtcggccgttctacctccttgttcc

SEQ ID NO: 5888 - DNA, 35 bp, Artificial Sequence
  Synthetic oligonucleotide
acatctgcctcagctcttacgttctgttccgttca

SEQ ID NO: 5889 - DNA, 32 bp, Artificial Sequence
  Synthetic oligonucleotide
tcccaatcgctcctaggccctcttgaattgct

SEQ ID NO: 5890 - DNA, 38 bp, Artificial Sequence
  Synthetic oligonucleotide
ttgcccgccatgtaccgattacaccacacctcacttga

SEQ ID NO: 5891 - DNA, 36 bp, Artificial Sequence
  Synthetic oligonucleotide
acaacccccgccgttactgccccaatactgccccta

SEQ ID NO: 5892 - DNA, 35 bp, Artificial Sequence
  Synthetic oligonucleotide
tattcccgagcgcagaactgatcttcactgccctt

SEQ ID NO: 5893 - DNA, 38 bp, Artificial Sequence
  Synthetic oligonucleotide
tcaacccctgcccacattgggtcttacgtttcttttga

SEQ ID NO: 5894 - DNA, 35 bp, Artificial Sequence
  Synthetic oligonucleotide
gagacatctcccccgtgaccggcgcctttacccac

SEQ ID NO: 5895 - DNA, 35 bp, Artificial Sequence
  Synthetic oligonucleotide
gttggacgaggttatgcatggtaggggtggtggga

SEQ ID NO: 5896 - DNA, 36 bp, Artificial Sequence
  Synthetic oligonucleotide
ttgcgggcgggaggggagaggggagtgtacttcgta

SEQ ID NO: 5897 - DNA, 36 bp, Artificial Sequence
  Synthetic oligonucleotide
atgcccgacaatgtcgatttacctgcccctccttta

SEQ ID NO: 5898 - DNA, 37 bp, Artificial Sequence
  Synthetic oligonucleotide
taccccgtccgggcccatccctcatcttatgacctga

SEQ ID NO: 5899 - DNA, 35 bp, Artificial Sequence
  Synthetic oligonucleotide
atccaaccccgcggactgtccctaccgacagctcc

SEQ ID NO: 5900 - DNA, 35 bp, Artificial Sequence
  Synthetic oligonucleotide
gccttggccggcacattcacctatgtttctccttg

SEQ ID NO: 5901 - DNA, 35 bp, Artificial Sequence
  Synthetic oligonucleotide
tccaaaccctggactgggcctttgacaacccccca

SEQ ID NO: 5902 - DNA, 35 bp, Artificial Sequence
  Synthetic oligonucleotide
tcatccagtcccccgtacgtcgaattatgtccccg

SEQ ID NO: 5903 - DNA, 34 bp, Artificial Sequence
  Synthetic oligonucleotide
agttactgcctgccaccatcttgccctgcttgca

SEQ ID NO: 5904 - DNA, 36 bp, Artificial Sequence
  Synthetic oligonucleotide
tactacatcagggcggtctaaacgcctgtactctca

SEQ ID NO: 5905 - DNA, 37 bp, Artificial Sequence
  Synthetic oligonucleotide
gcctggggaagactacggggataggggagggaaaaga

SEQ ID NO: 5906 - DNA, 35 bp, Artificial Sequence
  Synthetic oligonucleotide
tgttgcaatccccctagtgctactgtccctcgaac

SEQ ID NO: 5907 - DNA, 36 bp, Artificial Sequence
  Synthetic oligonucleotide
gaccactcacactggggcatagaattctcgcctaaa

SEQ ID NO: 5908 - DNA, 35 bp, Artificial Sequence
  Synthetic oligonucleotide
acgtctcatctgccgcccgcctataacgtgcttac

SEQ ID NO: 5909 - DNA, 35 bp, Artificial Sequence
  Synthetic oligonucleotide
gaccctacggcctacgtctaactccctgcctttgc

SEQ ID NO: 5910 - DNA, 35 bp, Artificial Sequence
  Synthetic oligonucleotide
acccactgccagctgctgctgtcgaacctctccgc

SEQ ID NO: 5911 - DNA, 35 bp, Artificial Sequence
  Synthetic oligonucleotide
tgacttcactcacacctgccatcatccctgccgtc

SEQ ID NO: 5912 - DNA, 36 bp, Artificial Sequence
  Synthetic oligonucleotide
ggtcactgcgcctgcgtttaccgtcgcccgccccaa

SEQ ID NO: 5913 - DNA, 35 bp, Artificial Sequence
  Synthetic oligonucleotide
tgcttcactgcctccctgtcgtccatgacatcatc

SEQ ID NO: 5914 - DNA, 36 bp, Artificial Sequence
  Synthetic oligonucleotide
gtgctatgccccagttagcctttttgttctcgttca

SEQ ID NO: 5915 - DNA, 34 bp, Artificial Sequence
  Synthetic oligonucleotide
tacagcaccgacctccctcttccgtgtcgtaacc

SEQ ID NO: 5916 - DNA, 35 bp, Artificial Sequence
  Synthetic oligonucleotide
cgagaccctctgttttcctgccgcttgcggaaccc

SEQ ID NO: 5917 - DNA, 35 bp, Artificial Sequence
  Synthetic oligonucleotide
tgccaagggcctacttttgtcttcactcttcgcca

SEQ ID NO: 5918 - DNA, 35 bp, Artificial Sequence
  Synthetic oligonucleotide
gctcatgcacactccagcctatggccgacgatcct

SEQ ID NO: 5919 - DNA, 35 bp, Artificial Sequence
  Synthetic oligonucleotide
gtcacaccgcgattcgagtcacacacccctgcttt

SEQ ID NO: 5920 - DNA, 36 bp, Artificial Sequence
  Synthetic oligonucleotide
tcaccactcgtatcattgcgttatcataaatgtcca

SEQ ID NO: 5921 - DNA, 35 bp, Artificial Sequence
  Synthetic oligonucleotide
gaagagtgggaggggaaggggagtgcgatggtcta

SEQ ID NO: 5922 - DNA, 36 bp, Artificial Sequence
  Synthetic oligonucleotide
ggtcactgcctcgctcccacgacctctactttagga

SEQ ID NO: 5923 - DNA, 36 bp, Artificial Sequence
  Synthetic oligonucleotide
gtccagccccacgccgtagtacctcagaccatgcta

SEQ ID NO: 5924 - DNA, 36 bp, Artificial Sequence
  Synthetic oligonucleotide
acgacaactgctccccgtcgccttttacctgccgca

SEQ ID NO: 5925 - DNA, 36 bp, Artificial Sequence
  Synthetic oligonucleotide
gacccatgcctttgacctgcactgtcgccctcacta

SEQ ID NO: 5926 - DNA, 38 bp, Artificial Sequence
  Synthetic oligonucleotide
gtgcccacccccgcgaatctgtctgcctaagcccttga

SEQ ID NO: 5927 - DNA, 37 bp, Artificial Sequence
  Synthetic oligonucleotide
gcatgaggggtgggaacggcaaggggtgctagcgcga

SEQ ID NO: 5928 - DNA, 38 bp, Artificial Sequence
  Synthetic oligonucleotide
gacggtcgcactctgtatccaactcactcgcctcttga

SEQ ID NO: 5929 - DNA, 37 bp, Artificial Sequence
  Synthetic oligonucleotide
aagatcaccgcccctgcatgccatcagcacaccccga

SEQ ID NO: 5930 - DNA, 36 bp, Artificial Sequence
  Synthetic oligonucleotide
agccgacgcactgcacgcctcccctgtatcacctaa

SEQ ID NO: 5931 - DNA, 35 bp, Artificial Sequence
  Synthetic oligonucleotide
gccgaccgccgggaaaattatcgctaacgtgccac

SEQ ID NO: 5932 - DNA, 38 bp, Artificial Sequence
  Synthetic oligonucleotide
atgctggtggagcaggagagtaggggtaggaggaatga

SEQ ID NO: 5933 - DNA, 38 bp, Artificial Sequence
  Synthetic oligonucleotide
gtcacccgaacctgtgctaaaccctgatgcctctttga

SEQ ID NO: 5934 - DNA, 35 bp, Artificial Sequence
  Synthetic oligonucleotide
tgccaccttgacctatccgcttcccattgttcgag

SEQ ID NO: 5935 - DNA, 35 bp, Artificial Sequence
  Synthetic oligonucleotide
tacctccgacgtgctcctgttattgttacttaaca

SEQ ID NO: 5936 - DNA, 36 bp, Artificial Sequence
  Synthetic oligonucleotide
gatgggactacggtgagggggaggagggtgcgataa

SEQ ID NO: 5937 - DNA, 35 bp, Artificial Sequence
  Synthetic oligonucleotide
taacagctgagcattctccactacgccctctacgt

SEQ ID NO: 5938 - DNA, 35 bp, Artificial Sequence
  Synthetic oligonucleotide
tacccactcaccgccgccccatgagctacactatc

SEQ ID NO: 5939 - DNA, 35 bp, Artificial Sequence
  Synthetic oligonucleotide
tccgacgccacaaagtctatacctgctgttagcca

SEQ ID NO: 5940 - DNA, 36 bp, Artificial Sequence
  Synthetic oligonucleotide
agccactccgttacgcttggtacccactcacttcta

SEQ ID NO: 5941 - DNA, 35 bp, Artificial Sequence
  Synthetic oligonucleotide
ggagcccagtcgccattgccctcaccgcactttat

SEQ ID NO: 5942 - DNA, 35 bp, Artificial Sequence
  Synthetic oligonucleotide
ttgccgacctcgcacttgaccttagcatattcctc

SEQ ID NO: 5943 - DNA, 35 bp, Artificial Sequence
  Synthetic oligonucleotide
gcaagccacctgatcgctctacgccccacgccttt

SEQ ID NO: 5944 - DNA, 35 bp, Artificial Sequence
  Synthetic oligonucleotide
ttacgcctcgcttccacccacataggcctcctact

SEQ ID NO: 5945 - DNA, 35 bp, Artificial Sequence
  Synthetic oligonucleotide
gagcccccatcgctatcaccactgcctttctggaa

SEQ ID NO: 5946 - DNA, 36 bp, Artificial Sequence
  Synthetic oligonucleotide
taatcagcccctttcgccttcgcccctggtccatga

SEQ ID NO: 5947 - DNA, 35 bp, Artificial Sequence
  Synthetic oligonucleotide
gtcgactcaccctattgtgccggtttacttactat

SEQ ID NO: 5948 - DNA, 38 bp, Artificial Sequence
  Synthetic oligonucleotide
gccccacgcacgtatgtttccttagctttcctacctga

SEQ ID NO: 5949 - DNA, 37 bp, Artificial Sequence
  Synthetic oligonucleotide
agcgggaaggagcgatagggggcaggattaagggtga

SEQ ID NO: 5950 - DNA, 38 bp, Artificial Sequence
  Synthetic oligonucleotide
aatcacatgccacccgtgatttgccattccttccctga

SEQ ID NO: 5951 - DNA, 35 bp, Artificial Sequence
  Synthetic oligonucleotide
gtccctggcctccacatcttattcatgtacctttc

SEQ ID NO: 5952 - DNA, 35 bp, Artificial Sequence
  Synthetic oligonucleotide
ttgctcctcagcccgaccacactgtgctgttcgtt

SEQ ID NO: 5953 - DNA, 35 bp, Artificial Sequence
  Synthetic oligonucleotide
acacgggccaccctcgcatagaatagttccctacc

SEQ ID NO: 5954 - DNA, 38 bp, Artificial Sequence
  Synthetic oligonucleotide
taacagggataggaaggcggtggaggaaaacgtggtga

SEQ ID NO: 5955 - DNA, 36 bp, Artificial Sequence
  Synthetic oligonucleotide
gctgagaggacgcggtggtgggttgggcgggtagga

SEQ ID NO: 5956 - DNA, 35 bp, Artificial Sequence
  Synthetic oligonucleotide
tccacgcaatgttctacgcctatctggaaactgct

SEQ ID NO: 5957 - DNA, 35 bp, Artificial Sequence
  Synthetic oligonucleotide
tgtaccctgcccggattatgcgctacctgctttac

SEQ ID NO: 5958 - DNA, 35 bp, Artificial Sequence
  Synthetic oligonucleotide
tccatgactgtctcatattagccaccggaactccc

SEQ ID NO: 5959 - DNA, 35 bp, Artificial Sequence
  Synthetic oligonucleotide
gtttcccccagaccctaatgcgccctaacgttgcc

SEQ ID NO: 5960 - DNA, 35 bp, Artificial Sequence
  Synthetic oligonucleotide
gtgacattctcccgctcttttgtagccctctcctg

SEQ ID NO: 5961 - DNA, 35 bp, Artificial Sequence
  Synthetic oligonucleotide
gccctatgcggcgtgattatacaccactttccttc

SEQ ID NO: 5962 - DNA, 35 bp, Artificial Sequence
  Synthetic oligonucleotide
ggacaccagaccaatgtttcgccgctcgactcctt

SEQ ID NO: 5963 - DNA, 35 bp, Artificial Sequence
  Synthetic oligonucleotide
tccacatcccgggtccgactctaacgccaaattag

SEQ ID NO: 5964 - DNA, 37 bp, Artificial Sequence
  Synthetic oligonucleotide
gtccgaccccccgcgcatccaccctccatcgtacgga

SEQ ID NO: 5965 - DNA, 36 bp, Artificial Sequence
  Synthetic oligonucleotide
gcaacgcacatggctgtcttttcttcttaactttaa

SEQ ID NO: 5966 - DNA, 37 bp, Artificial Sequence
  Synthetic oligonucleotide
gtgcccctcacaaccctccatcgttacgtacttcgga

SEQ ID NO: 5967 - DNA, 36 bp, Artificial Sequence
  Synthetic oligonucleotide
ggattcaccgcccacatatgcacacccagctcccca

SEQ ID NO: 5968 - DNA, 38 bp, Artificial Sequence
  Synthetic oligonucleotide
tgtacgtccagcccctcgcgtttcttcactgcctgtga

SEQ ID NO: 5969 - DNA, 35 bp, Artificial Sequence
  Synthetic oligonucleotide
gaacgcgtaggggggcgcgcgggggaacaaagggg

SEQ ID NO: 5970 - DNA, 35 bp, Artificial Sequence
  Synthetic oligonucleotide
tcccgactcctcacccgtttctgcggtgcacgctc

SEQ ID NO: 5971 - DNA, 36 bp, Artificial Sequence
  Synthetic oligonucleotide
tcactcccggtctccatggtcttaatcgctctcgta

SEQ ID NO: 5972 - DNA, 37 bp, Artificial Sequence
  Synthetic oligonucleotide
accccaaactcctgcattcaagcctttcctgtaggga

SEQ ID NO: 5973 - DNA, 35 bp, Artificial Sequence
  Synthetic oligonucleotide
tgccactcggccgacacgcttaatacgcaccatct

SEQ ID NO: 5974 - DNA, 35 bp, Artificial Sequence
  Synthetic oligonucleotide
tacgacgccactgctcccaaagaacaaattaccgc

SEQ ID NO: 5975 - DNA, 35 bp, Artificial Sequence
  Synthetic oligonucleotide
tgcatcctccaaactgtttccacgaataccgacca

SEQ ID NO: 5976 - DNA, 36 bp, Artificial Sequence
  Synthetic oligonucleotide
gccaccacctttcctctgctgtatgcgtttacctta

SEQ ID NO: 5977 - DNA, 38 bp, Artificial Sequence
  Synthetic oligonucleotide
acccgcaccctccgtcttcgctatgggccttttcttga

SEQ ID NO: 5978 - DNA, 35 bp, Artificial Sequence
  Synthetic oligonucleotide
tgaccgtgcgcatatcgtatcgtcctgccctggtc

SEQ ID NO: 5979 - DNA, 37 bp, Artificial Sequence
  Synthetic oligonucleotide
ataggtgaagggcggtatgaaagggggccgtggggga

SEQ ID NO: 5980 - DNA, 35 bp, Artificial Sequence
  Synthetic oligonucleotide
gcatgcccacatagcaccatcctacacctccgtaa

SEQ ID NO: 5981 - DNA, 35 bp, Artificial Sequence
  Synthetic oligonucleotide
tcccccatccagttggcgctaccgtaatctcactg

SEQ ID NO: 5982 - DNA, 36 bp, Artificial Sequence
  Synthetic oligonucleotide
gaccgatccgcctccattagctcgctgtatcctaca

SEQ ID NO: 5983 - DNA, 37 bp, Artificial Sequence
  Synthetic oligonucleotide
gttgcatccttgtaccaccccgataacatcggcctga

SEQ ID NO: 5984 - DNA, 35 bp, Artificial Sequence
  Synthetic oligonucleotide
atgccgtcgggcctcgcgcatggccactaccttcc

SEQ ID NO: 5985 - DNA, 35 bp, Artificial Sequence
  Synthetic oligonucleotide
ttgcacaaccgctcatgttcacacagctacaccat

SEQ ID NO: 5986 - DNA, 38 bp, Artificial Sequence
  Synthetic oligonucleotide
acaaagcgcgcacgcatattcacaccatcacgccctga

SEQ ID NO: 5987 - DNA, 35 bp, Artificial Sequence
  Synthetic oligonucleotide
tccctgtgccaccttatgtactgtaccggccctta

SEQ ID NO: 5988 - DNA, 35 bp, Artificial Sequence
  Synthetic oligonucleotide
acattcccgcccattggacacgacgcctcccacat

SEQ ID NO: 5989 - DNA, 37 bp, Artificial Sequence
  Synthetic oligonucleotide
tctccacccccacgcgtgcattttatctgttcacgga

SEQ ID NO: 5990 - DNA, 37 bp, Artificial Sequence
  Synthetic oligonucleotide
acctgccctcccgagctttttgccgacttctgtacga

SEQ ID NO: 5991 - DNA, 35 bp, Artificial Sequence
  Synthetic oligonucleotide
gatccaccatcatcccattgaccagccttgtcttc

SEQ ID NO: 5992 - DNA, 35 bp, Artificial Sequence
  Synthetic oligonucleotide
aagcaggcgcctgccccggtgtcccccgctccttc

SEQ ID NO: 5993 - DNA, 35 bp, Artificial Sequence
  Synthetic oligonucleotide
atgtcgcacatccgcgaatggtccatctctttgct

SEQ ID NO: 5994 - DNA, 35 bp, Artificial Sequence
  Synthetic oligonucleotide
atgccctccaatcgaagttcggccccatctgtacc

SEQ ID NO: 5995 - DNA, 35 bp, Artificial Sequence
  Synthetic oligonucleotide
gtaccggacactccatcccgatcgctctgtctcgc

SEQ ID NO: 5996 - DNA, 36 bp, Artificial Sequence
  Synthetic oligonucleotide
gctcctagccggcatctctttgctctcctgcaccaa

SEQ ID NO: 5997 - DNA, 37 bp, Artificial Sequence
  Synthetic oligonucleotide
aacacgggggagtgaggggaaaggaggtgggaattga

SEQ ID NO: 5998 - DNA, 35 bp, Artificial Sequence
  Synthetic oligonucleotide
tggagagccacatcacttaggtcgacgcccctctc

SEQ ID NO: 5999 - DNA, 38 bp, Artificial Sequence
  Synthetic oligonucleotide
aaggtggtggacaagggggaagaaaggtgtaggtgtga

SEQ ID NO: 6000 - DNA, 35 bp, Artificial Sequence
  Synthetic oligonucleotide
accaccccgaccaaattcccactgtgcgtatacca

SEQ ID NO: 6001 - DNA, 35 bp, Artificial Sequence
  Synthetic oligonucleotide
aaactccgccgccgtgttccgccccccaattaaag

SEQ ID NO: 6002 - DNA, 35 bp, Artificial Sequence
  Synthetic oligonucleotide
gacatggtacactcccgcctcatccccaggggatt

SEQ ID NO: 6003 - DNA, 37 bp, Artificial Sequence
  Synthetic oligonucleotide
gcacggtcaatctatcacactgacctcttcctttcga

SEQ ID NO: 6004 - DNA, 35 bp, Artificial Sequence
  Synthetic oligonucleotide
taacacgtcggagccagtttccattctgcctttcc

SEQ ID NO: 6005 - DNA, 35 bp, Artificial Sequence
  Synthetic oligonucleotide
aaccaccactagctttttaacgtccacgccaccga

SEQ ID NO: 6006 - DNA, 34 bp, Artificial Sequence
  Synthetic oligonucleotide
tttgtccccgcgctttttgcataaacgctcccta

SEQ ID NO: 6007 - DNA, 37 bp, Artificial Sequence
  Synthetic oligonucleotide
agccaccaccgaacttaatacgggcctcactctttga

SEQ ID NO: 6008 - DNA, 35 bp, Artificial Sequence
  Synthetic oligonucleotide
gaacgggagagagggcggaggactggggagcatgg

SEQ ID NO: 6009 - DNA, 35 bp, Artificial Sequence
  Synthetic oligonucleotide
gccccgtgagccccttctagctacccatgccactg

SEQ ID NO: 6010 - DNA, 35 bp, Artificial Sequence
  Synthetic oligonucleotide
gtgcaacacctttccccgtccctgcgctcgctaaa

SEQ ID NO: 6011 - DNA, 36 bp, Artificial Sequence
  Synthetic oligonucleotide
atcccctcgccgtgataccacactccatccgaagga

SEQ ID NO: 6012 - DNA, 36 bp, Artificial Sequence
  Synthetic oligonucleotide
tgcaagtggaaaggggtacggggggcaagtgataaa

SEQ ID NO: 6013 - DNA, 36 bp, Artificial Sequence
  Synthetic oligonucleotide
gttgcacgagcctaattgtgcacccattttcttgta

SEQ ID NO: 6014 - DNA, 35 bp, Artificial Sequence
  Synthetic oligonucleotide
tccgccatcccatttagcatagcggtacttcccga

SEQ ID NO: 6015 - DNA, 35 bp, Artificial Sequence
  Synthetic oligonucleotide
tcttgcccccacacacatggcgcaagcccctcccc

SEQ ID NO: 6016 - DNA, 35 bp, Artificial Sequence
  Synthetic oligonucleotide
gtgacactgtctcgccttcgttcgttttcttccgt

SEQ ID NO: 6017 - DNA, 37 bp, Artificial Sequence
  Synthetic oligonucleotide
gacccgggatggggtgacaaggtggcgggggaatgga

SEQ ID NO: 6018 - DNA, 35 bp, Artificial Sequence
  Synthetic oligonucleotide
acatgcccctctggctgatttattacctggccccg

SEQ ID NO: 6019 - DNA, 36 bp, Artificial Sequence
  Synthetic oligonucleotide
gacacctatcccacctctgatgcacactggcttcaa

SEQ ID NO: 6020 - DNA, 35 bp, Artificial Sequence
  Synthetic oligonucleotide
agccatcgatagcttctcgtacactcacccgttca

SEQ ID NO: 6021 - DNA, 34 bp, Artificial Sequence
  Synthetic oligonucleotide
tccgacgtaatgcatccaccgcgcgtacccatca

SEQ ID NO: 6022 - DNA, 35 bp, Artificial Sequence
  Synthetic oligonucleotide
gcgaccgtccttcgtcgcgccccttttgtctattt

SEQ ID NO: 6023 - DNA, 36 bp, Artificial Sequence
  Synthetic oligonucleotide
ggacactggccttcctgcattgccgtaaccttcgta

SEQ ID NO: 6024 - DNA, 35 bp, Artificial Sequence
  Synthetic oligonucleotide
gtacgcaatcccaccttttgttcttggactgactc

SEQ ID NO: 6025 - DNA, 36 bp, Artificial Sequence
  Synthetic oligonucleotide
tcaaggctacctcccacgcaagtactcttcaccata

SEQ ID NO: 6026 - DNA, 35 bp, Artificial Sequence
  Synthetic oligonucleotide
tgaccgcccccttgtttttcgccgactgtgatgtt

SEQ ID NO: 6027 - DNA, 36 bp, Artificial Sequence
  Synthetic oligonucleotide
tgctaccccagctgttcctccaccttggtgtgccca

SEQ ID NO: 6028 - DNA, 35 bp, Artificial Sequence
  Synthetic oligonucleotide
tgaacgtctgcattgccccatgaatcacgcctcac

SEQ ID NO: 6029 - DNA, 35 bp, Artificial Sequence
  Synthetic oligonucleotide
gacgaatgacccgaccggtcacgatagccccttct

SEQ ID NO: 6030 - DNA, 35 bp, Artificial Sequence
  Synthetic oligonucleotide
tcgaagtccattgctgctctcactttctgcctatc

SEQ ID NO: 6031 - DNA, 35 bp, Artificial Sequence
  Synthetic oligonucleotide
gtgtgcgcctgcactaactcgctcttttgcttcgc

SEQ ID NO: 6032 - DNA, 35 bp, Artificial Sequence
  Synthetic oligonucleotide
gctcgaccgcatcaccggcactgtacacctaccca

SEQ ID NO: 6033 - DNA, 37 bp, Artificial Sequence
  Synthetic oligonucleotide
gcacctccaaccactgtactttatgtctagtccccga

SEQ ID NO: 6034 - DNA, 35 bp, Artificial Sequence
  Synthetic oligonucleotide
tgtagcacagcaaccctccagtccgcatcacttgg

SEQ ID NO: 6035 - DNA, 35 bp, Artificial Sequence
  Synthetic oligonucleotide
tcactcacatcttccttgctaaccgtgccatggtt

SEQ ID NO: 6036 - DNA, 35 bp, Artificial Sequence
  Synthetic oligonucleotide
ttgctactgccacagccctttctgacttccgctct

SEQ ID NO: 6037 - DNA, 35 bp, Artificial Sequence
  Synthetic oligonucleotide
gaaccatcccacgcagctccgtgtaccctgtcccc

SEQ ID NO: 6038 - DNA, 35 bp, Artificial Sequence
  Synthetic oligonucleotide
tgcccctcgagctctccgcatccggcttgccatcc

SEQ ID NO: 6039 - DNA, 35 bp, Artificial Sequence
  Synthetic oligonucleotide
gatcccggcacactaccgccgccagccgccgaatc

SEQ ID NO: 6040 - DNA, 36 bp, Artificial Sequence
  Synthetic oligonucleotide
tcgaacccgccccctgatcgcgttcctccttaacga

SEQ ID NO: 6041 - DNA, 35 bp, Artificial Sequence
  Synthetic oligonucleotide
actacccccggacagaagcacccttctcctatgag

SEQ ID NO: 6042 - DNA, 36 bp, Artificial Sequence
  Synthetic oligonucleotide
tccacgacgcctttgatgactcattaccatccccaa

SEQ ID NO: 6043 - DNA, 36 bp, Artificial Sequence
  Synthetic oligonucleotide
gcaaccccccctgcgaatgacaactatgcaccttca

SEQ ID NO: 6044 - DNA, 35 bp, Artificial Sequence
  Synthetic oligonucleotide
gagggtggggagggatagtggggtaatgtatggaa

SEQ ID NO: 6045 - DNA, 33 bp, Artificial Sequence
  Synthetic oligonucleotide
gacacctgcgatctcatgaatctctcacacact

SEQ ID NO: 6046 - DNA, 35 bp, Artificial Sequence
  Synthetic oligonucleotide
tctccacggcggacgaccctttcgcgtgcccaccc

SEQ ID NO: 6047 - DNA, 35 bp, Artificial Sequence
  Synthetic oligonucleotide
actgagcacgccacctcctactatgggcctacttc

SEQ ID NO: 6048 - DNA, 37 bp, Artificial Sequence
  Synthetic oligonucleotide
gacacgcgtgcgctttcgtccttacccacccaccaga

SEQ ID NO: 6049 - DNA, 35 bp, Artificial Sequence
  Synthetic oligonucleotide
cctgcctcgtattcactctttgccgcacccacttg

SEQ ID NO: 6050 - DNA, 36 bp, Artificial Sequence
  Synthetic oligonucleotide
tcaccacacctatcgtgcattgtacgtacttgttca

SEQ ID NO: 6051 - DNA, 36 bp, Artificial Sequence
  Synthetic oligonucleotide
tccactccacccgctacatagcccagaacatggcta

SEQ ID NO: 6052 - DNA, 35 bp, Artificial Sequence
  Synthetic oligonucleotide
gcaacacccagcaccgacatctggccctgatacat

SEQ ID NO: 6053 - DNA, 35 bp, Artificial Sequence
  Synthetic oligonucleotide
agctgatcccctgtcctcgtgcttgcatttattcg

SEQ ID NO: 6054 - DNA, 36 bp, Artificial Sequence
  Synthetic oligonucleotide
tccatccgcccttcgtacacgccgagtagaccttga

SEQ ID NO: 6055 - DNA, 35 bp, Artificial Sequence
  Synthetic oligonucleotide
gtgtgacgcgcagagtttccatttagttcccatcc

SEQ ID NO: 6056 - DNA, 35 bp, Artificial Sequence
  Synthetic oligonucleotide
ttgggcggggaggtgggtcaacggtggggcagcaa

SEQ ID NO: 6057 - DNA, 35 bp, Artificial Sequence
  Synthetic oligonucleotide
atgccagccctatttgcatccacatcctgttgccc

SEQ ID NO: 6058 - DNA, 35 bp, Artificial Sequence
  Synthetic oligonucleotide
ccgtagcgatggcccagtcctctgcgtacttttac

SEQ ID NO: 6059 - DNA, 35 bp, Artificial Sequence
  Synthetic oligonucleotide
ttaccgctcccatgttgcaactggcctaacctacc

SEQ ID NO: 6060 - DNA, 37 bp, Artificial Sequence
  Synthetic oligonucleotide
tcacaccatcccgcgcacagttcaggctaaccctcga

SEQ ID NO: 6061 - DNA, 36 bp, Artificial Sequence
  Synthetic oligonucleotide
accaacctggtcacacccgtctccccgttccgttga

SEQ ID NO: 6062 - DNA, 35 bp, Artificial Sequence
  Synthetic oligonucleotide
gacgccaaccctcgacgctgccctggtatcttaat

SEQ ID NO: 6063 - DNA, 38 bp, Artificial Sequence
  Synthetic oligonucleotide
tactcccccaagcctaccccacgtgcacagtcttttga

SEQ ID NO: 6064 - DNA, 35 bp, Artificial Sequence
  Synthetic oligonucleotide
tcccccgccctcaccgttctaacatccgagttctg

SEQ ID NO: 6065 - DNA, 36 bp, Artificial Sequence
  Synthetic oligonucleotide
tccacgaaccatttgcaccacgttacgctcgcctca

SEQ ID NO: 6066 - DNA, 37 bp, Artificial Sequence
  Synthetic oligonucleotide
gtgacatcgcaactctttgacccactgcctaccttga

SEQ ID NO: 6067 - DNA, 34 bp, Artificial Sequence
  Synthetic oligonucleotide
tgcacgcaccccgttcttccctgttcatttcgag

SEQ ID NO: 6068 - DNA, 36 bp, Artificial Sequence
  Synthetic oligonucleotide
gacacagctgctagactttctgtgcccctcccctta

SEQ ID NO: 6069 - DNA, 35 bp, Artificial Sequence
  Synthetic oligonucleotide
ttgccaagacatccgcccgacgcccccgcgattcc

SEQ ID NO: 6070 - DNA, 36 bp, Artificial Sequence
  Synthetic oligonucleotide
tccaccccgctgacggccaacccacattcctctcca

SEQ ID NO: 6071 - DNA, 35 bp, Artificial Sequence
  Synthetic oligonucleotide
tcagccctcatattcaacatcacatggttatccct

SEQ ID NO: 6072 - DNA, 35 bp, Artificial Sequence
  Synthetic oligonucleotide
tgtctcgggccactacatctcgttcattgtaccat

SEQ ID NO: 6073 - DNA, 35 bp, Artificial Sequence
  Synthetic oligonucleotide
gccacttaccgacccgtccgcacctcgtgaccttt

SEQ ID NO: 6074 - DNA, 35 bp, Artificial Sequence
  Synthetic oligonucleotide
aacccctacccgactagcccattgacgcatttacg

SEQ ID NO: 6075 - DNA, 35 bp, Artificial Sequence
  Synthetic oligonucleotide
tcatccctgtccccgcgctccaagctgcactactg

SEQ ID NO: 6076 - DNA, 37 bp, Artificial Sequence
  Synthetic oligonucleotide
aacgggggtgatgggactggggggtaaaggtagtaga

SEQ ID NO: 6077 - DNA, 35 bp, Artificial Sequence
  Synthetic oligonucleotide
tgccggacactgcttcttgcctcaagctttcacac

SEQ ID NO: 6078 - DNA, 35 bp, Artificial Sequence
  Synthetic oligonucleotide
acgcggagccccccctgcacactcgtatatgctgt

SEQ ID NO: 6079 - DNA, 37 bp, Artificial Sequence
  Synthetic oligonucleotide
acgcaggcggaggggcacataggcggtggcggtggga

SEQ ID NO: 6080 - DNA, 35 bp, Artificial Sequence
  Synthetic oligonucleotide
tacagccaggccctgagcctgttattcttccctct

SEQ ID NO: 6081 - DNA, 37 bp, Artificial Sequence
  Synthetic oligonucleotide
tcactcgccactaccgtacatacgaccttttgctgga

SEQ ID NO: 6082 - DNA, 35 bp, Artificial Sequence
  Synthetic oligonucleotide
acccaccccctccggactgcaggatgcgttcgcac

SEQ ID NO: 6083 - DNA, 35 bp, Artificial Sequence
  Synthetic oligonucleotide
gcacccccttccatcttttgcgcatcatgaacggc

SEQ ID NO: 6084 - DNA, 35 bp, Artificial Sequence
  Synthetic oligonucleotide
accatgcggcaccatctgcccttgaccgttcgtgc

SEQ ID NO: 6085 - DNA, 36 bp, Artificial Sequence
  Synthetic oligonucleotide
gacaaaccccggatccgacctttagacgcgcctaca

SEQ ID NO: 6086 - DNA, 37 bp, Artificial Sequence
  Synthetic oligonucleotide
ttactgccccctgccccttagacctacagtctgcgga

SEQ ID NO: 6087 - DNA, 36 bp, Artificial Sequence
  Synthetic oligonucleotide
tgatgtgagaggggggaggcgggttaggcgacaaaa

SEQ ID NO: 6088 - DNA, 35 bp, Artificial Sequence
  Synthetic oligonucleotide
acacgcatgcccctgcttccctcaggcgctaaccc

SEQ ID NO: 6089 - DNA, 35 bp, Artificial Sequence
  Synthetic oligonucleotide
aagccagccgccaccttttattcacccgccaaccc

SEQ ID NO: 6090 - DNA, 35 bp, Artificial Sequence
  Synthetic oligonucleotide
acccctgccacacactgttcacctgcgcctctaag

SEQ ID NO: 6091 - DNA, 38 bp, Artificial Sequence
  Synthetic oligonucleotide
gcattgcccatgtgctttatcctccctgttccgcatga

SEQ ID NO: 6092 - DNA, 35 bp, Artificial Sequence
  Synthetic oligonucleotide
aactatcacgccaccctcagctctgcctatatttg

SEQ ID NO: 6093 - DNA, 37 bp, Artificial Sequence
  Synthetic oligonucleotide
ttagaccgccctcctcctcccctttgttgacaggtga

SEQ ID NO: 6094 - DNA, 37 bp, Artificial Sequence
  Synthetic oligonucleotide
gccacctccccttgtgccctttagtgcgtacccttga

SEQ ID NO: 6095 - DNA, 37 bp, Artificial Sequence
  Synthetic oligonucleotide
ttcaggtgagcacggaggtgggtggaaatggggtgga

SEQ ID NO: 6096 - DNA, 37 bp, Artificial Sequence
  Synthetic oligonucleotide
aatgaccgccactgtgcccacacttctctctcgctga

SEQ ID NO: 6097 - DNA, 35 bp, Artificial Sequence
  Synthetic oligonucleotide
gcattccccaccgccccggagccaccgaccacgct

SEQ ID NO: 6098 - DNA, 37 bp, Artificial Sequence
  Synthetic oligonucleotide
gacccatccatacgtttttgttttcagatccttccga

SEQ ID NO: 6099 - DNA, 38 bp, Artificial Sequence
  Synthetic oligonucleotide
tcgcacctctccggatcgctgaccccccttccctttga

SEQ ID NO: 6100 - DNA, 35 bp, Artificial Sequence
  Synthetic oligonucleotide
gatgcaacgcttgacccctaatcacttcctcgccc

SEQ ID NO: 6101 - DNA, 35 bp, Artificial Sequence
  Synthetic oligonucleotide
ggactgccgcaggtttctcccctactcgcctaacc

SEQ ID NO: 6102 - DNA, 36 bp, Artificial Sequence
  Synthetic oligonucleotide
accactgtccatggccgttatgaccttactcgctca

SEQ ID NO: 6103 - DNA, 35 bp, Artificial Sequence
  Synthetic oligonucleotide
tcctcagtcgctggccttgcttgaacgcactgtcc

SEQ ID NO: 6104 - DNA, 35 bp, Artificial Sequence
  Synthetic oligonucleotide
tcaccactccgtatgtccctattcccagacagcat

SEQ ID NO: 6105 - DNA, 38 bp, Artificial Sequence
  Synthetic oligonucleotide
attccaccgccctccagcctggacgtgactgaaagtga

SEQ ID NO: 6106 - DNA, 35 bp, Artificial Sequence
  Synthetic oligonucleotide
atgcatccaattgccatcgtgactgctcttcactt

SEQ ID NO: 6107 - DNA, 34 bp, Artificial Sequence
  Synthetic oligonucleotide
gcgcccctcccctcagaccgagcacgtcgcctat

SEQ ID NO: 6108 - DNA, 38 bp, Artificial Sequence
  Synthetic oligonucleotide
tcgagagggtggaggggggtggtacagaaggcttgtga

SEQ ID NO: 6109 - DNA, 37 bp, Artificial Sequence
  Synthetic oligonucleotide
gccccaatcgccatgtaattcggtgtccctttcttga

SEQ ID NO: 6110 - DNA, 37 bp, Artificial Sequence
  Synthetic oligonucleotide
aaggaggaacgtaggagcaggaggatcgaggagaaga

SEQ ID NO: 6111 - DNA, 36 bp, Artificial Sequence
  Synthetic oligonucleotide
gatagaggagaagggaagggataggacacgcggtga

SEQ ID NO: 6112 - DNA, 35 bp, Artificial Sequence
  Synthetic oligonucleotide
tacacccccctcgggacagcccccgacttgaccat

SEQ ID NO: 6113 - DNA, 35 bp, Artificial Sequence
  Synthetic oligonucleotide
ttccacgctccaggccggcataccacgttccctct

SEQ ID NO: 6114 - DNA, 36 bp, Artificial Sequence
  Synthetic oligonucleotide
agaacgtcaccgccgtccgtctcctttttgatgcca

SEQ ID NO: 6115 - DNA, 37 bp, Artificial Sequence
  Synthetic oligonucleotide
atgtcgggtgagggtgggaaggggcaacacttggcga

SEQ ID NO: 6116 - DNA, 36 bp, Artificial Sequence
  Synthetic oligonucleotide
tgcgggtacacacgccatacgattgcctgcctttca

SEQ ID NO: 6117 - DNA, 35 bp, Artificial Sequence
  Synthetic oligonucleotide
gtgctcacccctccattacgtgtctgccgagcacc

SEQ ID NO: 6118 - DNA, 38 bp, Artificial Sequence
  Synthetic oligonucleotide
gcccaccactcgcctttgcctgtgacgttacttgttga

SEQ ID NO: 6119 - DNA, 35 bp, Artificial Sequence
  Synthetic oligonucleotide
tgctcgtgcacggtcaccgacttgctttttcccca

SEQ ID NO: 6120 - DNA, 35 bp, Artificial Sequence
  Synthetic oligonucleotide
aggatgacgcaggggggggctcttaaaacgggtgg

SEQ ID NO: 6121 - DNA, 36 bp, Artificial Sequence
  Synthetic oligonucleotide
attgccccgcctacctgcatgtcttactagcccgca

SEQ ID NO: 6122 - DNA, 35 bp, Artificial Sequence
  Synthetic oligonucleotide
gtcaccgatacggtgcctcttcccctgattccaca

SEQ ID NO: 6123 - DNA, 38 bp, Artificial Sequence
  Synthetic oligonucleotide
ttacaccgtccttccgtgccattctcactccgccgtga

SEQ ID NO: 6124 - DNA, 38 bp, Artificial Sequence
  Synthetic oligonucleotide
ttcatgccccagagcgtacacccctccttgccgattga

SEQ ID NO: 6125 - DNA, 35 bp, Artificial Sequence
  Synthetic oligonucleotide
gtccatcgctgctagtaccccgtccttccctgtac

SEQ ID NO: 6126 - DNA, 36 bp, Artificial Sequence
  Synthetic oligonucleotide
ttgtacaccgcctcctgttatgctcactctgaacta

SEQ ID NO: 6127 - DNA, 35 bp, Artificial Sequence
  Synthetic oligonucleotide
atgtccgcatcgctgtttccatctaaccgtgcccc

SEQ ID NO: 6128 - DNA, 35 bp, Artificial Sequence
  Synthetic oligonucleotide
gtgagctacaccaccgcccgtcttttgaccgcccc

SEQ ID NO: 6129 - DNA, 35 bp, Artificial Sequence
  Synthetic oligonucleotide
gcctggtgacactccaatcgaactgccctcttagc

SEQ ID NO: 6130 - DNA, 35 bp, Artificial Sequence
  Synthetic oligonucleotide
tactccatcctgtctcctgtgcctccgcgtagaca

SEQ ID NO: 6131 - DNA, 37 bp, Artificial Sequence
  Synthetic oligonucleotide
actcaactccctatcgcccgcgtgacgccggtactga

SEQ ID NO: 6132 - DNA, 37 bp, Artificial Sequence
  Synthetic oligonucleotide
gcgaagggacgaaggacaaggggaggctgctgggaga

SEQ ID NO: 6133 - DNA, 38 bp, Artificial Sequence
  Synthetic oligonucleotide
tgcacgccttggttcctcccattaccgccccgaaatga

SEQ ID NO: 6134 - DNA, 35 bp, Artificial Sequence
  Synthetic oligonucleotide
tccgacgcatcctaacggctgtaacttctttccac

SEQ ID NO: 6135 - DNA, 35 bp, Artificial Sequence
  Synthetic oligonucleotide
ttgagcgccgcacgtcatactcgttttccatctgt

SEQ ID NO: 6136 - DNA, 35 bp, Artificial Sequence
  Synthetic oligonucleotide
atcgcctcaacaccttctcgtgtacgtaccacctc

SEQ ID NO: 6137 - DNA, 33 bp, Artificial Sequence
  Synthetic oligonucleotide
gatgcccgcctgcttctctcccgccctgtgtga

SEQ ID NO: 6138 - DNA, 35 bp, Artificial Sequence
  Synthetic oligonucleotide
ttaaccccaccgcctcctactatgctgtgctacca

SEQ ID NO: 6139 - DNA, 35 bp, Artificial Sequence
  Synthetic oligonucleotide
taccctctcctgatcttatgacactgttggtccac

SEQ ID NO: 6140 - DNA, 37 bp, Artificial Sequence
  Synthetic oligonucleotide
gacccccccgtttgccatctacagccgctccacgtga

SEQ ID NO: 6141 - DNA, 35 bp, Artificial Sequence
  Synthetic oligonucleotide
tccccaacaggcccccgccaccgctctccttccgc

SEQ ID NO: 6142 - DNA, 36 bp, Artificial Sequence
  Synthetic oligonucleotide
tgcacggaccatctgtctggaataccaccccccaca

SEQ ID NO: 6143 - DNA, 38 bp, Artificial Sequence
  Synthetic oligonucleotide
ttcgaccgcctccaccaagtgtgaacccgcccctatga

SEQ ID NO: 6144 - DNA, 35 bp, Artificial Sequence
  Synthetic oligonucleotide
acagcgaacaccctcggcttctcttctgctcctgt

SEQ ID NO: 6145 - DNA, 35 bp, Artificial Sequence
  Synthetic oligonucleotide
actacatcagccaccaaccgggcgcgcacacctac

SEQ ID NO: 6146 - DNA, 37 bp, Artificial Sequence
  Synthetic oligonucleotide
aatgtgggtggcgggaggcggacgggcgggttttgga

SEQ ID NO: 6147 - DNA, 35 bp, Artificial Sequence
  Synthetic oligonucleotide
gatactatcgcctgttccttgtgtttcacgccctt

SEQ ID NO: 6148 - DNA, 35 bp, Artificial Sequence
  Synthetic oligonucleotide
gatccagcacttgctggctttttgcttcctatcta

SEQ ID NO: 6149 - DNA, 38 bp, Artificial Sequence
  Synthetic oligonucleotide
gtgccccccgactctttgatactgctctcggaccttga

SEQ ID NO: 6150 - DNA, 35 bp, Artificial Sequence
  Synthetic oligonucleotide
tcgatagcgcaccgcttcctactccgccatcaacg

SEQ ID NO: 6151 - DNA, 35 bp, Artificial Sequence
  Synthetic oligonucleotide
atgcgctcccattaggttggcctcgctctttctgg

SEQ ID NO: 6152 - DNA, 35 bp, Artificial Sequence
  Synthetic oligonucleotide
aactgtcaccgtaagcgtcacaccactcgccgcac

SEQ ID NO: 6153 - DNA, 37 bp, Artificial Sequence
  Synthetic oligonucleotide
gtaaccgcgggtaaacggagggggtgggggtacggga

SEQ ID NO: 6154 - DNA, 35 bp, Artificial Sequence
  Synthetic oligonucleotide
tctgcctgctgcccaatggcatcacctaccatcta

SEQ ID NO: 6155 - DNA, 35 bp, Artificial Sequence
  Synthetic oligonucleotide
tacaggtccactccaccttctgttggcctctccac

SEQ ID NO: 6156 - DNA, 35 bp, Artificial Sequence
  Synthetic oligonucleotide
gtgcgctgttccatccggtctttcacactcttcgt

SEQ ID NO: 6157 - DNA, 35 bp, Artificial Sequence
  Synthetic oligonucleotide
gacccctcacatcgttcacatccgaccgtgaccat

SEQ ID NO: 6158 - DNA, 35 bp, Artificial Sequence
  Synthetic oligonucleotide
accgacacttactgcacaccctcttgccctgcatt

SEQ ID NO: 6159 - DNA, 37 bp, Artificial Sequence
  Synthetic oligonucleotide
gataccccgcgccctaccaatcgtttgccccctcaga

SEQ ID NO: 6160 - DNA, 35 bp, Artificial Sequence
  Synthetic oligonucleotide
tcctcacctctgcccccctagtttactccgctgga

SEQ ID NO: 6161 - DNA, 35 bp, Artificial Sequence
  Synthetic oligonucleotide
taagcagcacagcgcccttatcaccgtcccacctt

SEQ ID NO: 6162 - DNA, 35 bp, Artificial Sequence
  Synthetic oligonucleotide
gcctcaggcggtcgttatcctccagccatgcaact

SEQ ID NO: 6163 - DNA, 35 bp, Artificial Sequence
  Synthetic oligonucleotide
accccgacccggttgcccccgtattacgtagtttc

SEQ ID NO: 6164 - DNA, 35 bp, Artificial Sequence
  Synthetic oligonucleotide
ttaccagtgcccttgctcgtaattgcaacaacccc

SEQ ID NO: 6165 - DNA, 38 bp, Artificial Sequence
  Synthetic oligonucleotide
atgcaaccccgcccccagctcacaccaggtatgcctga

SEQ ID NO: 6166 - DNA, 35 bp, Artificial Sequence
  Synthetic oligonucleotide
tcacaacaccgccctgcctaacgtccccgaccccg

SEQ ID NO: 6167 - DNA, 35 bp, Artificial Sequence
  Synthetic oligonucleotide
tgatccctctgactcatataccgtgcccctcaaca

SEQ ID NO: 6168 - DNA, 35 bp, Artificial Sequence
  Synthetic oligonucleotide
gatcaccgcacgcatgttgtcactcccttggtttg

SEQ ID NO: 6169 - DNA, 37 bp, Artificial Sequence
  Synthetic oligonucleotide
gggggcataagggtgggggttcgaggtctaatgggga

SEQ ID NO: 6170 - DNA, 35 bp, Artificial Sequence
  Synthetic oligonucleotide
ggggccctcagacatccccccccgtgcaccaccta

SEQ ID NO: 6171 - DNA, 35 bp, Artificial Sequence
  Synthetic oligonucleotide
gcattgcacatgaaacacccccacgtctactccgg

SEQ ID NO: 6172 - DNA, 35 bp, Artificial Sequence
  Synthetic oligonucleotide
tgcacccccctctagcaccaaggttccacacatgc

SEQ ID NO: 6173 - DNA, 37 bp, Artificial Sequence
  Synthetic oligonucleotide
tgatggaatgcaaggaggggcatgggttggggaagga

SEQ ID NO: 6174 - DNA, 35 bp, Artificial Sequence
  Synthetic oligonucleotide
tcagagacatcttgtgtctcattttcccgttcctc

SEQ ID NO: 6175 - DNA, 35 bp, Artificial Sequence
  Synthetic oligonucleotide
tgagaagggcgcatgggttgaatatggggtgggga

SEQ ID NO: 6176 - DNA, 38 bp, Artificial Sequence
  Synthetic oligonucleotide
gaccacgtgctagttgcaccatccgtacccttctctga

SEQ ID NO: 6177 - DNA, 37 bp, Artificial Sequence
  Synthetic oligonucleotide
tgtcccctccgctgctgcaccttagctctccgcaaga

SEQ ID NO: 6178 - DNA, 34 bp, Artificial Sequence
  Synthetic oligonucleotide
ttgagaacaaccgttacgcctcactcttcctgaa

SEQ ID NO: 6179 - DNA, 35 bp, Artificial Sequence
  Synthetic oligonucleotide
gccagacctcctcctcgctattcacgttggctccg

SEQ ID NO: 6180 - DNA, 37 bp, Artificial Sequence
  Synthetic oligonucleotide
gagccacggtcccatcagtagcatgcccgatttttga

SEQ ID NO: 6181 - DNA, 35 bp, Artificial Sequence
  Synthetic oligonucleotide
aagacacgtgccccccccccttcctggtttagttt

SEQ ID NO: 6182 - DNA, 37 bp, Artificial Sequence
  Synthetic oligonucleotide
agccaccccgctgcccgagttaactgatattcctgga

SEQ ID NO: 6183 - DNA, 35 bp, Artificial Sequence
  Synthetic oligonucleotide
agttgcacggtacacattttcatcgcgttgccctc

SEQ ID NO: 6184 - DNA, 34 bp, Artificial Sequence
  Synthetic oligonucleotide
gaactgccgcctcactcccgttcgattccaatca

SEQ ID NO: 6185 - DNA, 35 bp, Artificial Sequence
  Synthetic oligonucleotide
gtctccctccacatgattgacccccagtggaccca

SEQ ID NO: 6186 - DNA, 36 bp, Artificial Sequence
  Synthetic oligonucleotide
gccacgacctccatgtagtgtcaacattccacccca

SEQ ID NO: 6187 - DNA, 35 bp, Artificial Sequence
  Synthetic oligonucleotide
gtccacctcgagccacaattaccaccttagtggcc

SEQ ID NO: 6188 - DNA, 35 bp, Artificial Sequence
  Synthetic oligonucleotide
gatacgacatcacaccgcttggcctcctgttcgac

SEQ ID NO: 6189 - DNA, 35 bp, Artificial Sequence
  Synthetic oligonucleotide
tcacgttccccccaattgtccgaacatctgcatcg

SEQ ID NO: 6190 - DNA, 38 bp, Artificial Sequence
  Synthetic oligonucleotide
tcgactccgccacactgaccacgcgaatgcctctttga

SEQ ID NO: 6191 - DNA, 35 bp, Artificial Sequence
  Synthetic oligonucleotide
tgtagaccccacgccggacccagctcacttttaca

SEQ ID NO: 6192 - DNA, 35 bp, Artificial Sequence
  Synthetic oligonucleotide
gcaccacagttaccgttgtacgttacaccatgtcc

SEQ ID NO: 6193 - DNA, 35 bp, Artificial Sequence
  Synthetic oligonucleotide
tatgtcgcctctggttatgcaccctttgccatccc

SEQ ID NO: 6194 - DNA, 35 bp, Artificial Sequence
  Synthetic oligonucleotide
atcaccgcagtttccatcctccccgtccgctttcg

SEQ ID NO: 6195 - DNA, 35 bp, Artificial Sequence
  Synthetic oligonucleotide
atgaaccgccgcccccgcttttacgtctctgctac

SEQ ID NO: 6196 - DNA, 35 bp, Artificial Sequence
  Synthetic oligonucleotide
agtcccaccatatgacttgatgatcgccattctct

SEQ ID NO: 6197 - DNA, 36 bp, Artificial Sequence
  Synthetic oligonucleotide
gaggagggaaaatataccaagacgggagggatggga

SEQ ID NO: 6198 - DNA, 38 bp, Artificial Sequence
  Synthetic oligonucleotide
accacgctcctgttcttcggcctcaggactatccttga

SEQ ID NO: 6199 - DNA, 35 bp, Artificial Sequence
  Synthetic oligonucleotide
tcatttccgccccccctggatttcggcgacccttt

SEQ ID NO: 6200 - DNA, 35 bp, Artificial Sequence
  Synthetic oligonucleotide
ggaacactgccgggaaagggagaagggcatctgga

SEQ ID NO: 6201 - DNA, 35 bp, Artificial Sequence
  Synthetic oligonucleotide
gtccaccgcaccaaggtgaggcttttcctgtgccc

SEQ ID NO: 6202 - DNA, 35 bp, Artificial Sequence
  Synthetic oligonucleotide
ggaggggaaagaggaggggagataacgtcgacgaa

SEQ ID NO: 6203 - DNA, 36 bp, Artificial Sequence
  Synthetic oligonucleotide
ctcgccgttatctcgtgtcctgccctgtactgcata

SEQ ID NO: 6204 - DNA, 36 bp, Artificial Sequence
  Synthetic oligonucleotide
acgatgagctctgcacgttcacttcccctgttttca

SEQ ID NO: 6205 - DNA, 35 bp, Artificial Sequence
  Synthetic oligonucleotide
gattcgtgctaactattccgccatccacttcatcg

SEQ ID NO: 6206 - DNA, 35 bp, Artificial Sequence
  Synthetic oligonucleotide
atcacactccacatcatacgactgttgtaacctca

SEQ ID NO: 6207 - DNA, 36 bp, Artificial Sequence
  Synthetic oligonucleotide
ttacgcgccaccaacctcatagctcacaggcctgca

SEQ ID NO: 6208 - DNA, 35 bp, Artificial Sequence
  Synthetic oligonucleotide
ttgtgacaccgaactagcgtggtcgttttcttttt

SEQ ID NO: 6209 - DNA, 35 bp, Artificial Sequence
  Synthetic oligonucleotide
atagcgagcccctgttcccggcctgttcacactct

SEQ ID NO: 6210 - DNA, 38 bp, Artificial Sequence
  Synthetic oligonucleotide
tctgggaggaacgggaagggattggacgtagcacgtga

SEQ ID NO: 6211 - DNA, 36 bp, Artificial Sequence
  Synthetic oligonucleotide
atgggtggagggacgtgggggtaggacagactgatg

SEQ ID NO: 6212 - DNA, 35 bp, Artificial Sequence
  Synthetic oligonucleotide
taacgatcgcggcaccattgccccatcaaccatat

SEQ ID NO: 6213 - DNA, 37 bp, Artificial Sequence
  Synthetic oligonucleotide
acccgcccaccaccgcgcccgacaggacaatagcgga

SEQ ID NO: 6214 - DNA, 35 bp, Artificial Sequence
  Synthetic oligonucleotide
tgtggctccatcctgctcccgtagtacacactcga

SEQ ID NO: 6215 - DNA, 35 bp, Artificial Sequence
  Synthetic oligonucleotide
gttgaaccccgtctgccgctcactcacaccctcga

SEQ ID NO: 6216 - DNA, 37 bp, Artificial Sequence
  Synthetic oligonucleotide
tcgacactgctcgtcatcccacaccgccgctctctga

SEQ ID NO: 6217 - DNA, 35 bp, Artificial Sequence
  Synthetic oligonucleotide
gcaccccaccctaccgacgttcacaggccctgctg

SEQ ID NO: 6218 - DNA, 36 bp, Artificial Sequence
  Synthetic oligonucleotide
tgtactgccccggatcctcctgcccgccatctttca

SEQ ID NO: 6219 - DNA, 38 bp, Artificial Sequence
  Synthetic oligonucleotide
actccagcacgcccttccatgtccctccccagcaatga

SEQ ID NO: 6220 - DNA, 35 bp, Artificial Sequence
  Synthetic oligonucleotide
tccgcactgtcgtcatcttccctacccgccccaga

SEQ ID NO: 6221 - DNA, 37 bp, Artificial Sequence
  Synthetic oligonucleotide
tccagcccggcgtaccccattcagaccacccgcccga

SEQ ID NO: 6222 - DNA, 35 bp, Artificial Sequence
  Synthetic oligonucleotide
gagatggggtaggtgggaaactgggggctgtaggg

SEQ ID NO: 6223 - DNA, 35 bp, Artificial Sequence
  Synthetic oligonucleotide
gaccacgcccacccaaaagcgcctcctcgccattg

SEQ ID NO: 6224 - DNA, 33 bp, Artificial Sequence
  Synthetic oligonucleotide
aatggccagtgtagcccgtaccacccacttgca

SEQ ID NO: 6225 - DNA, 35 bp, Artificial Sequence
  Synthetic oligonucleotide
actaccgcccctccaactgccccgtcagccaagtc

SEQ ID NO: 6226 - DNA, 35 bp, Artificial Sequence
  Synthetic oligonucleotide
tctggccacccgctctgcaatggctctctcgtttc

SEQ ID NO: 6227 - DNA, 35 bp, Artificial Sequence
  Synthetic oligonucleotide
acactcgccccgcttggtaccatcccactgggtct

SEQ ID NO: 6228 - DNA, 35 bp, Artificial Sequence
  Synthetic oligonucleotide
gttgcagttctcccatttccgctgcccccgctgtc

SEQ ID NO: 6229 - DNA, 36 bp, Artificial Sequence
  Synthetic oligonucleotide
agccaacctcaaacgccatttctcgaggccgcccca

SEQ ID NO: 6230 - DNA, 34 bp, Artificial Sequence
  Synthetic oligonucleotide
tccccctgctgccctgctacatccagttatcgta

SEQ ID NO: 6231 - DNA, 35 bp, Artificial Sequence
  Synthetic oligonucleotide
tgagccctctttcaccgcgtccacatccacgcact

SEQ ID NO: 6232 - DNA, 34 bp, Artificial Sequence
  Synthetic oligonucleotide
cactctctcgattgtcacatgccttcatttaaca

SEQ ID NO: 6233 - DNA, 35 bp, Artificial Sequence
  Synthetic oligonucleotide
tacccgcccgctgttctcgtccatagcacttgctg

SEQ ID NO: 6234 - DNA, 38 bp, Artificial Sequence
  Synthetic oligonucleotide
gatcgctccccccgctacgcacagtccacctgtgttga

SEQ ID NO: 6235 - DNA, 35 bp, Artificial Sequence
  Synthetic oligonucleotide
gaccaagtgaagcctcgtgctccgcccacctgccc

SEQ ID NO: 6236 - DNA, 36 bp, Artificial Sequence
  Synthetic oligonucleotide
gacatcatctggcttttttcgcatacccctcgcgta

SEQ ID NO: 6237 - DNA, 35 bp, Artificial Sequence
  Synthetic oligonucleotide
agcgctcgccacctcgacccagccaaagcttttcc

SEQ ID NO: 6238 - DNA, 35 bp, Artificial Sequence
  Synthetic oligonucleotide
tgcgatgtgcctactggtctcccccgtattgctca

SEQ ID NO: 6239 - DNA, 35 bp, Artificial Sequence
  Synthetic oligonucleotide
ttcggacaccctgtactctctgataaccgaaacca

SEQ ID NO: 6240 - DNA, 35 bp, Artificial Sequence
  Synthetic oligonucleotide
acatcgcctcggctttttgcactggtcctcatcct

SEQ ID NO: 6241 - DNA, 35 bp, Artificial Sequence
  Synthetic oligonucleotide
accgtaccacccgagcctaaactttccgctatcag

SEQ ID NO: 6242 - DNA, 36 bp, Artificial Sequence
  Synthetic oligonucleotide
ccgccttgcccttccatgtcccttttgttagctcca

SEQ ID NO: 6243 - DNA, 35 bp, Artificial Sequence
  Synthetic oligonucleotide
gcctccctccgccgccacgagctccgcctttgcgc

SEQ ID NO: 6244 - DNA, 35 bp, Artificial Sequence
  Synthetic oligonucleotide
tcagggtggagggtattggagtagtaaagggggcg

SEQ ID NO: 6245 - DNA, 35 bp, Artificial Sequence
  Synthetic oligonucleotide
gtagcaccctacgtcctgcccgaataccaccctga

SEQ ID NO: 6246 - DNA, 35 bp, Artificial Sequence
  Synthetic oligonucleotide
tcccgatcaattccgttttgttttttgcgccttac

SEQ ID NO: 6247 - DNA, 38 bp, Artificial Sequence
  Synthetic oligonucleotide
gagacgatcgggcggggagggagggaatgtctcagtga

SEQ ID NO: 6248 - DNA, 35 bp, Artificial Sequence
  Synthetic oligonucleotide
agtccgcccatgctactttcaccactcgacttact

SEQ ID NO: 6249 - DNA, 35 bp, Artificial Sequence
  Synthetic oligonucleotide
acaaccaccctggattgagcacatccgccacaacc

SEQ ID NO: 6250 - DNA, 35 bp, Artificial Sequence
  Synthetic oligonucleotide
ttacgcaagtcttcgtcccagccgcccatattcct

SEQ ID NO: 6251 - DNA, 36 bp, Artificial Sequence
  Synthetic oligonucleotide
tagaccacgcacccaagctttgccgccccaagccga

SEQ ID NO: 6252 - DNA, 37 bp, Artificial Sequence
  Synthetic oligonucleotide
atgccattccccaagccgccgctcaccgcaccttcga

SEQ ID NO: 6253 - DNA, 38 bp, Artificial Sequence
  Synthetic oligonucleotide
gactcccgcactatcttatcaggccaatcctcccatga

SEQ ID NO: 6254 - DNA, 36 bp, Artificial Sequence
  Synthetic oligonucleotide
tgatcctcaccatcctccgcgattcaatcacgggta

SEQ ID NO: 6255 - DNA, 35 bp, Artificial Sequence
  Synthetic oligonucleotide
ggaccgcctcgatctccaagccaattcgcccgctg

SEQ ID NO: 6256 - DNA, 35 bp, Artificial Sequence
  Synthetic oligonucleotide
attggccccccacaggtaacactcaacacatcact

SEQ ID NO: 6257 - DNA, 36 bp, Artificial Sequence
  Synthetic oligonucleotide
tccgacctcttctgtcctatccgcaaacgtggtaca

SEQ ID NO: 6258 - DNA, 36 bp, Artificial Sequence
  Synthetic oligonucleotide
acacatcgtgtccgcattacttcccgtctctgttta

SEQ ID NO: 6259 - DNA, 36 bp, Artificial Sequence
  Synthetic oligonucleotide
tcagtgcacgtggccaggcttcatcttcggttacta

SEQ ID NO: 6260 - DNA, 37 bp, Artificial Sequence
  Synthetic oligonucleotide
tttcaccacccgtaccgttcgttaacgtcctaaccga

SEQ ID NO: 6261 - DNA, 35 bp, Artificial Sequence
  Synthetic oligonucleotide
gaatgtctgcctgctcttacgataccctcttgcac

SEQ ID NO: 6262 - DNA, 35 bp, Artificial Sequence
  Synthetic oligonucleotide
gtggtgcatccgctgctctggtcctcaactcctac

SEQ ID NO: 6263 - DNA, 35 bp, Artificial Sequence
  Synthetic oligonucleotide
gccatactcactccaacactacgagcctgctacga

SEQ ID NO: 6264 - DNA, 35 bp, Artificial Sequence
  Synthetic oligonucleotide
gttgactacctcctttccgtaccgtgagcagtacc

SEQ ID NO: 6265 - DNA, 38 bp, Artificial Sequence
  Synthetic oligonucleotide
tcgcacccgcaacccgctacacccccacaagagactga

SEQ ID NO: 6266 - DNA, 35 bp, Artificial Sequence
  Synthetic oligonucleotide
actaccactgtctgtcctggcctatgcacgcctca

SEQ ID NO: 6267 - DNA, 35 bp, Artificial Sequence
  Synthetic oligonucleotide
attgtcgcagcattattgcgcggttcccctcccac

SEQ ID NO: 6268 - DNA, 35 bp, Artificial Sequence
  Synthetic oligonucleotide
gtcgccgtacatagcgtgtcccccgttaactctca

SEQ ID NO: 6269 - DNA, 35 bp, Artificial Sequence
  Synthetic oligonucleotide
acgcatcaagcgcggccgcctttcgtagctccaac

SEQ ID NO: 6270 - DNA, 36 bp, Artificial Sequence
  Synthetic oligonucleotide
ggggtgggtgaggagggttatttggatgccggagta

SEQ ID NO: 6271 - DNA, 35 bp, Artificial Sequence
  Synthetic oligonucleotide
aacctccctctgtgcgacaaccgccccaccgcatt

SEQ ID NO: 6272 - DNA, 35 bp, Artificial Sequence
  Synthetic oligonucleotide
tcatcactccgtttctcacgccaccgctttgaatc

SEQ ID NO: 6273 - DNA, 35 bp, Artificial Sequence
  Synthetic oligonucleotide
tctcaccgcccaatcaacacacattgcgagacccg

SEQ ID NO: 6274 - DNA, 35 bp, Artificial Sequence
  Synthetic oligonucleotide
tgctctcatacgtgcccccacagccttgagcctac

SEQ ID NO: 6275 - DNA, 36 bp, Artificial Sequence
  Synthetic oligonucleotide
gtgctgccacacttatcacccaccgtacgctagcta

SEQ ID NO: 6276 - DNA, 35 bp, Artificial Sequence
  Synthetic oligonucleotide
gtgaaggtgaaggatagaaagggggaaggtgatgg

SEQ ID NO: 6277 - DNA, 35 bp, Artificial Sequence
  Synthetic oligonucleotide
gtaacgtgcccactgatccgtacgttgtctcctta

SEQ ID NO: 6278 - DNA, 35 bp, Artificial Sequence
  Synthetic oligonucleotide
gtatgccgcgatcgtgcaccctaccacctgtccat

SEQ ID NO: 6279 - DNA, 37 bp, Artificial Sequence
  Synthetic oligonucleotide
tcctccaccacttccctagttgccaaacagtcatgga

SEQ ID NO: 6280 - DNA, 35 bp, Artificial Sequence
  Synthetic oligonucleotide
tgtaccccattgattatcgttccgctcccacccgc

SEQ ID NO: 6281 - DNA, 37 bp, Artificial Sequence
  Synthetic oligonucleotide
gtccccaccacccctgtttgttgtcaacgaagtttga

SEQ ID NO: 6282 - DNA, 35 bp, Artificial Sequence
  Synthetic oligonucleotide
atcgcacgtcgacctgtccctgtccttccacgact

SEQ ID NO: 6283 - DNA, 36 bp, Artificial Sequence
  Synthetic oligonucleotide
gcacacccctgtttttgtcacctacaatgagcttca

SEQ ID NO: 6284 - DNA, 36 bp, Artificial Sequence
  Synthetic oligonucleotide
acaccaccaccgtttgaggtcgatactccccgttga

SEQ ID NO: 6285 - DNA, 35 bp, Artificial Sequence
  Synthetic oligonucleotide
ggttccacaacacccccgccgccgtaaccgccgac

SEQ ID NO: 6286 - DNA, 37 bp, Artificial Sequence
  Synthetic oligonucleotide
tcgtaccacctgattcatacaactccgcccatcgtga

SEQ ID NO: 6287 - DNA, 37 bp, Artificial Sequence
  Synthetic oligonucleotide
tcttacgcgcgcctgtaaatctgccttcctcgtgtga

SEQ ID NO: 6288 - DNA, 35 bp, Artificial Sequence
  Synthetic oligonucleotide
accccctgccaggcctgaatagttcgctcttgtac

SEQ ID NO: 6289 - DNA, 35 bp, Artificial Sequence
  Synthetic oligonucleotide
tacgacggcacactactcggtaaactatctgccct

SEQ ID NO: 6290 - DNA, 36 bp, Artificial Sequence
  Synthetic oligonucleotide
gttgcatactgcgccgaccaggatccacctttcgaa

SEQ ID NO: 6291 - DNA, 36 bp, Artificial Sequence
  Synthetic oligonucleotide
agcaccatacacaccagactgtttgggtggacaaaa

SEQ ID NO: 6292 - DNA, 36 bp, Artificial Sequence
  Synthetic oligonucleotide
gactgccgctgccaagacactgccctatcccgagta

SEQ ID NO: 6293 - DNA, 36 bp, Artificial Sequence
  Synthetic oligonucleotide
tcacggagtgggatagtgagcaaaggggagggcaga

SEQ ID NO: 6294 - DNA, 36 bp, Artificial Sequence
  Synthetic oligonucleotide
gacaccacacttccttatcatggacgtttttgccca

SEQ ID NO: 6295 - DNA, 35 bp, Artificial Sequence
  Synthetic oligonucleotide
ttaagccgttgttgcatcatcccgttcctcttggt

SEQ ID NO: 6296 - DNA, 35 bp, Artificial Sequence
  Synthetic oligonucleotide
gcacacggacaacacacaccgagtcatcgttccac

SEQ ID NO: 6297 - DNA, 35 bp, Artificial Sequence
  Synthetic oligonucleotide
gtccacaccgccttcatctgatctcccgatagaac

SEQ ID NO: 6298 - DNA, 35 bp, Artificial Sequence
  Synthetic oligonucleotide
acaccgcactgtatcgcccgctcccaatcacgcgt

SEQ ID NO: 6299 - DNA, 36 bp, Artificial Sequence
  Synthetic oligonucleotide
actcaaccacgccctctgcgcaacaccacgcgcaca

SEQ ID NO: 6300 - DNA, 37 bp, Artificial Sequence
  Synthetic oligonucleotide
tagccccatccggcatcaacttttgcctcagccacga

SEQ ID NO: 6301 - DNA, 37 bp, Artificial Sequence
  Synthetic oligonucleotide
agacgctctgccagcccaagcccctgtacttccgtga

SEQ ID NO: 6302 - DNA, 35 bp, Artificial Sequence
  Synthetic oligonucleotide
atacgccggacctttttgcatgctgccactctttc

SEQ ID NO: 6303 - DNA, 34 bp, Artificial Sequence
  Synthetic oligonucleotide
gacccgccacccctggtgccttaaatgaattcca

SEQ ID NO: 6304 - DNA, 35 bp, Artificial Sequence
  Synthetic oligonucleotide
gcgaccatccgccgcctaatcttgtgtgccccacg

SEQ ID NO: 6305 - DNA, 35 bp, Artificial Sequence
  Synthetic oligonucleotide
tccacacagccatacatactgacgtccactcgttt

SEQ ID NO: 6306 - DNA, 35 bp, Artificial Sequence
  Synthetic oligonucleotide
tatccctcgcccccctctgtcctaccgcttaggca

SEQ ID NO: 6307 - DNA, 35 bp, Artificial Sequence
  Synthetic oligonucleotide
acgcactagccgctttgtctcacttttgcacctta

SEQ ID NO: 6308 - DNA, 35 bp, Artificial Sequence
  Synthetic oligonucleotide
attacgtaccaccacccaccgatagagacgcgggc

SEQ ID NO: 6309 - DNA, 37 bp, Artificial Sequence
  Synthetic oligonucleotide
gtatccgcctaattgctacgtcaccctctaccatgga

SEQ ID NO: 6310 - DNA, 38 bp, Artificial Sequence
  Synthetic oligonucleotide
gtcaacacgtactcgttttctcaatgtccatcacctga

SEQ ID NO: 6311 - DNA, 35 bp, Artificial Sequence
  Synthetic oligonucleotide
gcctactcgcacaccctctatccgcccagacacac

SEQ ID NO: 6312 - DNA, 36 bp, Artificial Sequence
  Synthetic oligonucleotide
gccaaccccacggtagtaagcccgcattcttttaca

SEQ ID NO: 6313 - DNA, 35 bp, Artificial Sequence
  Synthetic oligonucleotide
gacacgttacgctcgtaacacacttgtacctggtt

SEQ ID NO: 6314 - DNA, 37 bp, Artificial Sequence
  Synthetic oligonucleotide
ttgtcccaacgcccggcctgcacattgcttttcctga

SEQ ID NO: 6315 - DNA, 35 bp, Artificial Sequence
  Synthetic oligonucleotide
agcttcacaccgatcgttcctttggtcaccttgtt

SEQ ID NO: 6316 - DNA, 37 bp, Artificial Sequence
  Synthetic oligonucleotide
gaccgtataagagggggtgggaggacaggggtataga

SEQ ID NO: 6317 - DNA, 37 bp, Artificial Sequence
  Synthetic oligonucleotide
tcaaccctgctgccatctgcgcccgttcgccacttga

SEQ ID NO: 6318 - DNA, 35 bp, Artificial Sequence
  Synthetic oligonucleotide
gctgcacgcctcccaggcatccctcactgcttcca

SEQ ID NO: 6319 - DNA, 35 bp, Artificial Sequence
  Synthetic oligonucleotide
tacgcacgaccgattctatctaccacggccaccat

SEQ ID NO: 6320 - DNA, 37 bp, Artificial Sequence
  Synthetic oligonucleotide
gcgccctactcctgactggacccgccacagaccccga

SEQ ID NO: 6321 - DNA, 36 bp, Artificial Sequence
  Synthetic oligonucleotide
gtgggaaagggtaggattttgagcggttaacgggga

SEQ ID NO: 6322 - DNA, 35 bp, Artificial Sequence
  Synthetic oligonucleotide
tagccttacgccatctagagctaacattccattcc

SEQ ID NO: 6323 - DNA, 36 bp, Artificial Sequence
  Synthetic oligonucleotide
acgcgacctgccaatcccgtcattattcgccactca

SEQ ID NO: 6324 - DNA, 35 bp, Artificial Sequence
  Synthetic oligonucleotide
ggagccatagcccctttctttgctgaattatgcct

SEQ ID NO: 6325 - DNA, 35 bp, Artificial Sequence
  Synthetic oligonucleotide
gtctgcctcagcttcgggctatctcaccttcaact

SEQ ID NO: 6326 - DNA, 35 bp, Artificial Sequence
  Synthetic oligonucleotide
tacgcaccaccccttgtcatacctcttcttggcga

SEQ ID NO: 6327 - DNA, 38 bp, Artificial Sequence
  Synthetic oligonucleotide
tctgcctccgccggtacgcacactcactttccctttga

SEQ ID NO: 6328 - DNA, 38 bp, Artificial Sequence
  Synthetic oligonucleotide
tcccagccgcctccgtcgaaccgcttcctatccgctga

SEQ ID NO: 6329 - DNA, 37 bp, Artificial Sequence
  Synthetic oligonucleotide
ggggtgggtcggggtatgctgatcgattgtggggtga

SEQ ID NO: 6330 - DNA, 35 bp, Artificial Sequence
  Synthetic oligonucleotide
accacgcggagggcaaatctttccgcgttcttacc

SEQ ID NO: 6331 - DNA, 35 bp, Artificial Sequence
  Synthetic oligonucleotide
tcgacctctccgtgcctgtatccttgcctcaaccg

SEQ ID NO: 6332 - DNA, 37 bp, Artificial Sequence
  Synthetic oligonucleotide
tacgccgggcctgcaaaccactaagcactcctcccga

SEQ ID NO: 6333 - DNA, 35 bp, Artificial Sequence
  Synthetic oligonucleotide
gcacgcactcactccatgtctccggtcgttatctt

SEQ ID NO: 6334 - DNA, 35 bp, Artificial Sequence
  Synthetic oligonucleotide
cgaagggaagggggttggttagtaggtggggcgac

SEQ ID NO: 6335 - DNA, 36 bp, Artificial Sequence
  Synthetic oligonucleotide
ggacagttcgagctacttgtacatatttccctgcca

SEQ ID NO: 6336 - DNA, 35 bp, Artificial Sequence
  Synthetic oligonucleotide
tggtgcactcgcttctcggttgtctctcccactcc

SEQ ID NO: 6337 - DNA, 35 bp, Artificial Sequence
  Synthetic oligonucleotide
gacacttagcctgcaagtatattgcccacccgctc

SEQ ID NO: 6338 - DNA, 35 bp, Artificial Sequence
  Synthetic oligonucleotide
ggacaccaaagtggccgcagtgtttttgccctttc

SEQ ID NO: 6339 - DNA, 37 bp, Artificial Sequence
  Synthetic oligonucleotide
gttgcgcaatctaaatgaccccactgaaccaccgcga

SEQ ID NO: 6340 - DNA, 37 bp, Artificial Sequence
  Synthetic oligonucleotide
atcacatcacctacctgcaggcacatccgtttcagga

SEQ ID NO: 6341 - DNA, 37 bp, Artificial Sequence
  Synthetic oligonucleotide
actgacagggaagtaacgcaaagggtacgggaaggga

SEQ ID NO: 6342 - DNA, 35 bp, Artificial Sequence
  Synthetic oligonucleotide
acccttccaccttcataatgcaggcacatgagcct

SEQ ID NO: 6343 - DNA, 35 bp, Artificial Sequence
  Synthetic oligonucleotide
ttccacaccatccagatcgtccatttatcccactt

SEQ ID NO: 6344 - DNA, 37 bp, Artificial Sequence
  Synthetic oligonucleotide
tcgcaaccatcgtgccacccaccttctattcgagtga

SEQ ID NO: 6345 - DNA, 35 bp, Artificial Sequence
  Synthetic oligonucleotide
actccaccgcgtgcgggacttcttgcaaacatctt

SEQ ID NO: 6346 - DNA, 35 bp, Artificial Sequence
  Synthetic oligonucleotide
tgaaagtccattgtcctgccgtgccctgattaccc

SEQ ID NO: 6347 - DNA, 35 bp, Artificial Sequence
  Synthetic oligonucleotide
gatccaccgtgcattcccgagggccatgagctcct

SEQ ID NO: 6348 - DNA, 37 bp, Artificial Sequence
  Synthetic oligonucleotide
tcaggccgctcagctctcctgccgacttcctacctga

SEQ ID NO: 6349 - DNA, 36 bp, Artificial Sequence
  Synthetic oligonucleotide
gtgcccaacagtctcctctccattccactgctccca

SEQ ID NO: 6350 - DNA, 35 bp, Artificial Sequence
  Synthetic oligonucleotide
gccatcgacactttctgcttgctcggggccacctc

SEQ ID NO: 6351 - DNA, 35 bp, Artificial Sequence
  Synthetic oligonucleotide
tgcacccggccacgcgatcgggcctttttcctgtc

SEQ ID NO: 6352 - DNA, 35 bp, Artificial Sequence
  Synthetic oligonucleotide
gcctccacggaaaactggttactgccacctaccga

SEQ ID NO: 6353 - DNA, 35 bp, Artificial Sequence
  Synthetic oligonucleotide
acaccccgacccaggctgttcgaggggatcatctc

SEQ ID NO: 6354 - DNA, 35 bp, Artificial Sequence
  Synthetic oligonucleotide
tatatccgccacccaaggttaccacgccgctttct

SEQ ID NO: 6355 - DNA, 35 bp, Artificial Sequence
  Synthetic oligonucleotide
ataccaccctcacagcacgctgcatgcacctcgaa

SEQ ID NO: 6356 - DNA, 35 bp, Artificial Sequence
  Synthetic oligonucleotide
acgcgcgcacaccatctatagaccccatcccggcc

SEQ ID NO: 6357 - DNA, 35 bp, Artificial Sequence
  Synthetic oligonucleotide
tgtgcctcagcatagttagttcacttagtaccatc

SEQ ID NO: 6358 - DNA, 35 bp, Artificial Sequence
  Synthetic oligonucleotide
gccggccccattgcttactgatataccctccctgg

SEQ ID NO: 6359 - DNA, 37 bp, Artificial Sequence
  Synthetic oligonucleotide
acaaccctgctgcttacggccctccgctaccgcgtga

SEQ ID NO: 6360 - DNA, 35 bp, Artificial Sequence
  Synthetic oligonucleotide
ttgtcacgatccacatgcccacccactccattgta

SEQ ID NO: 6361 - DNA, 35 bp, Artificial Sequence
  Synthetic oligonucleotide
gtcgtggacccggcacctttgcaattgttacttct

SEQ ID NO: 6362 - DNA, 38 bp, Artificial Sequence
  Synthetic oligonucleotide
tccatgcacccattcctgcccagggaccacccatttga

SEQ ID NO: 6363 - DNA, 35 bp, Artificial Sequence
  Synthetic oligonucleotide
acccaccacagtaggggactacaccaaacataact

SEQ ID NO: 6364 - DNA, 37 bp, Artificial Sequence
  Synthetic oligonucleotide
ggaccacttgctatcaattacacccctgtccggagga

SEQ ID NO: 6365 - DNA, 35 bp, Artificial Sequence
  Synthetic oligonucleotide
tacgcactctcaccgccacttgccagctttacagg

SEQ ID NO: 6366 - DNA, 36 bp, Artificial Sequence
  Synthetic oligonucleotide
tcagtccgcccctcgcttgtccatcgttggacacca

SEQ ID NO: 6367 - DNA, 35 bp, Artificial Sequence
  Synthetic oligonucleotide
tgcgatgacacgacctgctgcacctccaactcacg

SEQ ID NO: 6368 - DNA, 35 bp, Artificial Sequence
  Synthetic oligonucleotide
gtcgctgatcctctctgtctcgttgaacactatct

SEQ ID NO: 6369 - DNA, 35 bp, Artificial Sequence
  Synthetic oligonucleotide
acgatcaccactcgaatcatacactcgcatccggt

SEQ ID NO: 6370 - DNA, 37 bp, Artificial Sequence
  Synthetic oligonucleotide
tgcccaccgccattgggctcataacatccccagctga

SEQ ID NO: 6371 - DNA, 35 bp, Artificial Sequence
  Synthetic oligonucleotide
atccccaatggtgggatacgatcctccctctcata

SEQ ID NO: 6372 - DNA, 35 bp, Artificial Sequence
  Synthetic oligonucleotide
ttcctacctcacctgttcagcgacatccggccccc

SEQ ID NO: 6373 - DNA, 35 bp, Artificial Sequence
  Synthetic oligonucleotide
tgagcattaccccgttatcctatccgtctttcgcc

SEQ ID NO: 6374 - DNA, 37 bp, Artificial Sequence
  Synthetic oligonucleotide
tccccacgtcgggcccataccttgcccacctctctga

SEQ ID NO: 6375 - DNA, 35 bp, Artificial Sequence
  Synthetic oligonucleotide
atccgccaccacagccgcgggccaccgtcccacac

SEQ ID NO: 6376 - DNA, 36 bp, Artificial Sequence
  Synthetic oligonucleotide
tagtgggagggggagagggtgggggttgagtgtgga

SEQ ID NO: 6377 - DNA, 35 bp, Artificial Sequence
  Synthetic oligonucleotide
gtgcactactgtttacctgtctactggctccatcg

SEQ ID NO: 6378 - DNA, 36 bp, Artificial Sequence
  Synthetic oligonucleotide
atggaagccatcaccacccctagcgccacctgccca

SEQ ID NO: 6379 - DNA, 35 bp, Artificial Sequence
  Synthetic oligonucleotide
tttgccacgccttacctacgcctttcctacggggt

SEQ ID NO: 6380 - DNA, 35 bp, Artificial Sequence
  Synthetic oligonucleotide
acctgactgtcccctccccacattattgccgagcg

SEQ ID NO: 6381 - DNA, 35 bp, Artificial Sequence
  Synthetic oligonucleotide
gtgacctggtgtttatgctgtcctttcttgttttg

SEQ ID NO: 6382 - DNA, 35 bp, Artificial Sequence
  Synthetic oligonucleotide
gtggacacacgccccgactccggataccatactgc

SEQ ID NO: 6383 - DNA, 35 bp, Artificial Sequence
  Synthetic oligonucleotide
aaccacacagtaagcacactaggcgcattatcccc

SEQ ID NO: 6384 - DNA, 36 bp, Artificial Sequence
  Synthetic oligonucleotide
tccacccctcacatcgtcgcagcacaccccccagaa

SEQ ID NO: 6385 - DNA, 37 bp, Artificial Sequence
  Synthetic oligonucleotide
tgagtgcgaggaggaaagggttaggggaatgtcgtga

SEQ ID NO: 6386 - DNA, 35 bp, Artificial Sequence
  Synthetic oligonucleotide
agcaacgggccaccctacgacttacatatccacgc

SEQ ID NO: 6387 - DNA, 38 bp, Artificial Sequence
  Synthetic oligonucleotide
gtgacactgcggcccagccgttgctctgttccccttga

SEQ ID NO: 6388 - DNA, 35 bp, Artificial Sequence
  Synthetic oligonucleotide
gccacagcctccacgccacattccacgttaatcct

SEQ ID NO: 6389 - DNA, 35 bp, Artificial Sequence
  Synthetic oligonucleotide
tgcctacaaactgcctcgacctgtactactattgc

SEQ ID NO: 6390 - DNA, 38 bp, Artificial Sequence
  Synthetic oligonucleotide
attgctgccctcctatgccgttttctgtacttacttga

SEQ ID NO: 6391 - DNA, 38 bp, Artificial Sequence
  Synthetic oligonucleotide
gcgagtggcgcactcgttccatcgtaactgatccttga

SEQ ID NO: 6392 - DNA, 35 bp, Artificial Sequence
  Synthetic oligonucleotide
tacggaaggagggaacgggttggggtagtgatcgg

SEQ ID NO: 6393 - DNA, 35 bp, Artificial Sequence
  Synthetic oligonucleotide
gacactcgccatggcattgccctttctccaggaga

SEQ ID NO: 6394 - DNA, 33 bp, Artificial Sequence
  Synthetic oligonucleotide
gttcaatcacgtacctgtgcaaacccacaattc

SEQ ID NO: 6395 - DNA, 35 bp, Artificial Sequence
  Synthetic oligonucleotide
aaaggtggtgggggaggagggaccaggggataacg

SEQ ID NO: 6396 - DNA, 37 bp, Artificial Sequence
  Synthetic oligonucleotide
acgaaaatggggggtgtggcgggcgggagtacagtga

SEQ ID NO: 6397 - DNA, 36 bp, Artificial Sequence
  Synthetic oligonucleotide
ttgacatccgcaccggaatggtacatactctcctaa

SEQ ID NO: 6398 - DNA, 37 bp, Artificial Sequence
  Synthetic oligonucleotide
agccgccccgagatctatccgcttacctcgcccccga

SEQ ID NO: 6399 - DNA, 36 bp, Artificial Sequence
  Synthetic oligonucleotide
tttgcaaccaccgctgctgcacattatgtccgttca

SEQ ID NO: 6400 - DNA, 35 bp, Artificial Sequence
  Synthetic oligonucleotide
tttgcgcagtgccattctactttctttgcgctttc

SEQ ID NO: 6401 - DNA, 35 bp, Artificial Sequence
  Synthetic oligonucleotide
ggacaaaggcagggagggctgttggggcggggtgg

SEQ ID NO: 6402 - DNA, 35 bp, Artificial Sequence
  Synthetic oligonucleotide
actggcatgggtcggggagggagggtacataccag

SEQ ID NO: 6403 - DNA, 37 bp, Artificial Sequence
  Synthetic oligonucleotide
tccacccctttgttttacgcgtcgcacgacccgccga

SEQ ID NO: 6404 - DNA, 38 bp, Artificial Sequence
  Synthetic oligonucleotide
ataccgcacgggctccttcttcctgccactcacggtga

SEQ ID NO: 6405 - DNA, 38 bp, Artificial Sequence
  Synthetic oligonucleotide
gtgccatcagttgcgctcgtgtgccctctccaccgtga

SEQ ID NO: 6406 - DNA, 38 bp, Artificial Sequence
  Synthetic oligonucleotide
gcacggtccgttgtccaagcccttcctccttcctgtga

SEQ ID NO: 6407 - DNA, 35 bp, Artificial Sequence
  Synthetic oligonucleotide
accccagtgccctggcctgacaattccgattatct

SEQ ID NO: 6408 - DNA, 35 bp, Artificial Sequence
  Synthetic oligonucleotide
aacccgccctcacgaccaccttttgccgtcactcg

SEQ ID NO: 6409 - DNA, 35 bp, Artificial Sequence
  Synthetic oligonucleotide
aagaatgaggggcgagtggtagggggtggaggatg

SEQ ID NO: 6410 - DNA, 35 bp, Artificial Sequence
  Synthetic oligonucleotide
gtccccacttccctgataggcatacatgctattac

SEQ ID NO: 6411 - DNA, 35 bp, Artificial Sequence
  Synthetic oligonucleotide
accgataggtacagccttatttcatcacatactat

SEQ ID NO: 6412 - DNA, 38 bp, Artificial Sequence
  Synthetic oligonucleotide
gactcgcaatatagtgccccacacctcccccacagtga

SEQ ID NO: 6413 - DNA, 35 bp, Artificial Sequence
  Synthetic oligonucleotide
tccagttcggcccctctgtaccctcgccgttgcct

SEQ ID NO: 6414 - DNA, 36 bp, Artificial Sequence
  Synthetic oligonucleotide
ccgagagtcggacagacctgcccccaacccggaaca

SEQ ID NO: 6415 - DNA, 36 bp, Artificial Sequence
  Synthetic oligonucleotide
tacgtgacccgacctgctttctcacctcagttgcca

SEQ ID NO: 6416 - DNA, 35 bp, Artificial Sequence
  Synthetic oligonucleotide
atgcatgctctgcagaccctgccctcatccctagc

SEQ ID NO: 6417 - DNA, 35 bp, Artificial Sequence
  Synthetic oligonucleotide
tacgccccataaccgccacgtaccggactatccat

SEQ ID NO: 6418 - DNA, 36 bp, Artificial Sequence
  Synthetic oligonucleotide
taccaccacagatctcgtacttaccgcgtacctgaa

SEQ ID NO: 6419 - DNA, 35 bp, Artificial Sequence
  Synthetic oligonucleotide
tctcactcagcagcacgcctctgctgttcgttttc

SEQ ID NO: 6420 - DNA, 36 bp, Artificial Sequence
  Synthetic oligonucleotide
gacccgccgcccccgcgtttgccgtcctcatggcta

SEQ ID NO: 6421 - DNA, 37 bp, Artificial Sequence
  Synthetic oligonucleotide
gaactaaggtggagggggagtgtggtgggggtactga

SEQ ID NO: 6422 - DNA, 35 bp, Artificial Sequence
  Synthetic oligonucleotide
ttgttacagccacacccacgtgcgagcccctccct

SEQ ID NO: 6423 - DNA, 36 bp, Artificial Sequence
  Synthetic oligonucleotide
gccgagctgagctgacgagcctttcttcacccccaa

SEQ ID NO: 6424 - DNA, 35 bp, Artificial Sequence
  Synthetic oligonucleotide
gtagaacggggaatggggaaggtgagggaggcagt

SEQ ID NO: 6425 - DNA, 37 bp, Artificial Sequence
  Synthetic oligonucleotide
tttccgccgccacaccaacatccatcagccttctaga

SEQ ID NO: 6426 - DNA, 35 bp, Artificial Sequence
  Synthetic oligonucleotide
acctcgttccgactccgtgtgctgttatcctgttc

SEQ ID NO: 6427 - DNA, 37 bp, Artificial Sequence
  Synthetic oligonucleotide
tgactcgccctgcaaatcttcggcttccttaccccga

SEQ ID NO: 6428 - DNA, 35 bp, Artificial Sequence
  Synthetic oligonucleotide
actcatccgcgatccgtcatttaacacccttcctc

SEQ ID NO: 6429 - DNA, 36 bp, Artificial Sequence
  Synthetic oligonucleotide
accccacccacgcatgaatgtccctcacaaccacta

SEQ ID NO: 6430 - DNA, 35 bp, Artificial Sequence
  Synthetic oligonucleotide
tacacgtcactcttgcctgtcccgagctttgctgc

SEQ ID NO: 6431 - DNA, 36 bp, Artificial Sequence
  Synthetic oligonucleotide
gatcgccccatgcgagtatacctgccttcaacgctc

SEQ ID NO: 6432 - DNA, 35 bp, Artificial Sequence
  Synthetic oligonucleotide
gccctccactcactggctcttactactgagcttat

SEQ ID NO: 6433 - DNA, 37 bp, Artificial Sequence
  Synthetic oligonucleotide
ttgggccccatcgccttgcagaagcactttatcccga

SEQ ID NO: 6434 - DNA, 37 bp, Artificial Sequence
  Synthetic oligonucleotide
gaaagcgaggcggtcggaggggtggcacatgggtgga

SEQ ID NO: 6435 - DNA, 35 bp, Artificial Sequence
  Synthetic oligonucleotide
tccccgcccaaccgatggcttaaatgccgaatcct

SEQ ID NO: 6436 - DNA, 37 bp, Artificial Sequence
  Synthetic oligonucleotide
atgtcacagcgctcacggttcctcccatcccgtctga

SEQ ID NO: 6437 - DNA, 35 bp, Artificial Sequence
  Synthetic oligonucleotide
actccgcaccccgctccatcgagccaccggtttat

SEQ ID NO: 6438 - DNA, 35 bp, Artificial Sequence
  Synthetic oligonucleotide
tctcaccctcccctgttcagcagacacatgcccgc

SEQ ID NO: 6439 - DNA, 35 bp, Artificial Sequence
  Synthetic oligonucleotide
gctcgaagagctgcattgcgcgccgtaccctcgtt

SEQ ID NO: 6440 - DNA, 35 bp, Artificial Sequence
  Synthetic oligonucleotide
agtaacaccccctccatcccaggtagacaaggtcc

SEQ ID NO: 6441 - DNA, 35 bp, Artificial Sequence
  Synthetic oligonucleotide
atgtccaacccgccgtagttgctttccgcttttct

SEQ ID NO: 6442 - DNA, 35 bp, Artificial Sequence
  Synthetic oligonucleotide
agacgccgtttcgtactccccaattgctgctcgcc

SEQ ID NO: 6443 - DNA, 35 bp, Artificial Sequence
  Synthetic oligonucleotide
aaccatgaccgccttacacgggctggatccctttc

SEQ ID NO: 6444 - DNA, 36 bp, Artificial Sequence
  Synthetic oligonucleotide
gatgatccgggggcacggaaaagggaagggagggaa

SEQ ID NO: 6445 - DNA, 35 bp, Artificial Sequence
  Synthetic oligonucleotide
gaccatcgcccatcgccctttcttgtagtgctcct

SEQ ID NO: 6446 - DNA, 35 bp, Artificial Sequence
  Synthetic oligonucleotide
aatttgacccccgccctctgtactggaaccctcgc

SEQ ID NO: 6447 - DNA, 35 bp, Artificial Sequence
  Synthetic oligonucleotide
tcctccgccattacggtatatcggtctcgcccgcc

SEQ ID NO: 6448 - DNA, 35 bp, Artificial Sequence
  Synthetic oligonucleotide
actaccacatggttctgccctcacaactggtgaaa

SEQ ID NO: 6449 - DNA, 36 bp, Artificial Sequence
  Synthetic oligonucleotide
tcccttgcccgttcgtcgacgccacactagtcttca

SEQ ID NO: 6450 - DNA, 36 bp, Artificial Sequence
  Synthetic oligonucleotide
tccagccctacctcgtgcatgctcgccgcctcttaa

SEQ ID NO: 6451 - DNA, 35 bp, Artificial Sequence
  Synthetic oligonucleotide
accttccccagtcgtgctgaattgcacatgatttt

SEQ ID NO: 6452 - DNA, 38 bp, Artificial Sequence
  Synthetic oligonucleotide
gaaccatccggcctttgtccctttcggcccattattga

SEQ ID NO: 6453 - DNA, 34 bp, Artificial Sequence
  Synthetic oligonucleotide
acatccccggcgctcttcgatccatcccttacag

SEQ ID NO: 6454 - DNA, 33 bp, Artificial Sequence
  Synthetic oligonucleotide
tgtaccagctctcccaccgttttgtaactccca

SEQ ID NO: 6455 - DNA, 35 bp, Artificial Sequence
  Synthetic oligonucleotide
gtagccgctgtagccgtatcggtgtctccctccta

SEQ ID NO: 6456 - DNA, 35 bp, Artificial Sequence
  Synthetic oligonucleotide
gaccgcactcgccagcgtgccccctgcctattgtc

SEQ ID NO: 6457 - DNA, 35 bp, Artificial Sequence
  Synthetic oligonucleotide
tcctcccgcggcctacccatctatactctaccggt

SEQ ID NO: 6458 - DNA, 36 bp, Artificial Sequence
  Synthetic oligonucleotide
tatgcccacgcacttcctgaatagcgataccttcca

SEQ ID NO: 6459 - DNA, 35 bp, Artificial Sequence
  Synthetic oligonucleotide
gacgcaaatccgagtatcgcctctcctttcctgga

SEQ ID NO: 6460 - DNA, 35 bp, Artificial Sequence
  Synthetic oligonucleotide
gcttacccacggcgggaccctcccatgtcttccac

SEQ ID NO: 6461 - DNA, 35 bp, Artificial Sequence
  Synthetic oligonucleotide
gccatctatcgctgtgctactctcccgttttttgc

SEQ ID NO: 6462 - DNA, 36 bp, Artificial Sequence
  Synthetic oligonucleotide
gctccgccactgttttccttcctgcaccaatttgca

SEQ ID NO: 6463 - DNA, 35 bp, Artificial Sequence
  Synthetic oligonucleotide
ttagggccccctccactgcgcacccacatgtactc

SEQ ID NO: 6464 - DNA, 36 bp, Artificial Sequence
  Synthetic oligonucleotide
caggcctcaccgctctgctaacaaacttgccactca

SEQ ID NO: 6465 - DNA, 35 bp, Artificial Sequence
  Synthetic oligonucleotide
acccatccgcctcacagtttgaagcacgatgctca

SEQ ID NO: 6466 - DNA, 35 bp, Artificial Sequence
  Synthetic oligonucleotide
gtagactagccggccgttcactcgccttccattgc

SEQ ID NO: 6467 - DNA, 37 bp, Artificial Sequence
  Synthetic oligonucleotide
gtctgcccacctaccgaccgcctcagcccgccctcga

SEQ ID NO: 6468 - DNA, 35 bp, Artificial Sequence
  Synthetic oligonucleotide
tcgaagcccaacacatgtctgaagccacctgccac

SEQ ID NO: 6469 - DNA, 38 bp, Artificial Sequence
  Synthetic oligonucleotide
gccacgtaagccctatacatcggcccattgttcactga

SEQ ID NO: 6470 - DNA, 37 bp, Artificial Sequence
  Synthetic oligonucleotide
tcaaccccctctgaaccgactcctagccccgcgcgga

SEQ ID NO: 6471 - DNA, 35 bp, Artificial Sequence
  Synthetic oligonucleotide
gtactatccgccctcattcatgtgttgccttcgtc

SEQ ID NO: 6472 - DNA, 34 bp, Artificial Sequence
  Synthetic oligonucleotide
tatgtcacagcgcacatccgtcctgtgcgaacct

SEQ ID NO: 6473 - DNA, 37 bp, Artificial Sequence
  Synthetic oligonucleotide
tctgagtcagtttccccaagctccctgccctctcaga

SEQ ID NO: 6474 - DNA, 35 bp, Artificial Sequence
  Synthetic oligonucleotide
gtcacaacaacgctgcacccattacaaaaccttgc

SEQ ID NO: 6475 - DNA, 35 bp, Artificial Sequence
  Synthetic oligonucleotide
acagaccactttgactgcacacttctgccttttac

SEQ ID NO: 6476 - DNA, 35 bp, Artificial Sequence
  Synthetic oligonucleotide
ttcatccagtccccctcacgctgtcgcccctatgc

SEQ ID NO: 6477 - DNA, 35 bp, Artificial Sequence
  Synthetic oligonucleotide
gaccccatcacctgaggctacttcacaagtccttc

SEQ ID NO: 6478 - DNA, 35 bp, Artificial Sequence
  Synthetic oligonucleotide
ggtccaccgcccgcagctgaaaactatctctctcc

SEQ ID NO: 6479 - DNA, 35 bp, Artificial Sequence
  Synthetic oligonucleotide
aatgacgccacccctgtgtcctgccaattttccac

SEQ ID NO: 6480 - DNA, 35 bp, Artificial Sequence
  Synthetic oligonucleotide
ggacacgtacggaggcaaagcggggaggggggtaa

SEQ ID NO: 6481 - DNA, 37 bp, Artificial Sequence
  Synthetic oligonucleotide
tgtcccaaccgcagtctctacccgtccgctcacctga

SEQ ID NO: 6482 - DNA, 38 bp, Artificial Sequence
  Synthetic oligonucleotide
accacaacccagaatgcgatttcagcaggtcctgctga

SEQ ID NO: 6483 - DNA, 36 bp, Artificial Sequence
  Synthetic oligonucleotide
agacgcccctctcagtttcttcacatacagctagca

SEQ ID NO: 6484 - DNA, 36 bp, Artificial Sequence
  Synthetic oligonucleotide
tccgacaccacgctgaatggcaaagctaactaccca

SEQ ID NO: 6485 - DNA, 36 bp, Artificial Sequence
  Synthetic oligonucleotide
gcacgggtagggagggtttgttggggccagcttgaa

SEQ ID NO: 6486 - DNA, 36 bp, Artificial Sequence
  Synthetic oligonucleotide
taactcatacggcctgtttcattccccgttcgccca

SEQ ID NO: 6487 - DNA, 37 bp, Artificial Sequence
  Synthetic oligonucleotide
gtgtgggggggaggaggataatagtggcaatattaga

SEQ ID NO: 6488 - DNA, 35 bp, Artificial Sequence
  Synthetic oligonucleotide
tgtgctcgcccgatacttttgttttgtttccactc

SEQ ID NO: 6489 - DNA, 35 bp, Artificial Sequence
  Synthetic oligonucleotide
tggtcacacgccgacgttcatcgcgccgcccttct

SEQ ID NO: 6490 - DNA, 35 bp, Artificial Sequence
  Synthetic oligonucleotide
gaatccagcccctgacgatatacttcacctcgacg

SEQ ID NO: 6491 - DNA, 38 bp, Artificial Sequence
  Synthetic oligonucleotide
acctgcccgccgaaccacctcgaagcgcacatccctga

SEQ ID NO: 6492 - DNA, 36 bp, Artificial Sequence
  Synthetic oligonucleotide
gaccccacctcgccggttctgtgagcccggtaccaa

SEQ ID NO: 6493 - DNA, 37 bp, Artificial Sequence
  Synthetic oligonucleotide
gagcccctctgaaattcgttactcgatcttgccctga

SEQ ID NO: 6494 - DNA, 35 bp, Artificial Sequence
  Synthetic oligonucleotide
tccacctgacgccaagggcataatgcaatacctcc

SEQ ID NO: 6495 - DNA, 35 bp, Artificial Sequence
  Synthetic oligonucleotide
tcccccaaccgatttacactgccggcgtatgccgc

SEQ ID NO: 6496 - DNA, 37 bp, Artificial Sequence
  Synthetic oligonucleotide
gaggggagtaggggggatttcgagcggggagatggga

SEQ ID NO: 6497 - DNA, 37 bp, Artificial Sequence
  Synthetic oligonucleotide
acccgccgcccatctgatcgaagccctgcgcattgga

SEQ ID NO: 6498 - DNA, 35 bp, Artificial Sequence
  Synthetic oligonucleotide
acacgatcgacccggtttcccgtggcaatgccccc

SEQ ID NO: 6499 - DNA, 35 bp, Artificial Sequence
  Synthetic oligonucleotide
ttgccgccctgttccagctttctccagttcaacgc

SEQ ID NO: 6500 - DNA, 35 bp, Artificial Sequence
  Synthetic oligonucleotide
acgacattcagtgtcgctgcatacactcctctcgc

SEQ ID NO: 6501 - DNA, 36 bp, Artificial Sequence
  Synthetic oligonucleotide
tgcatttgcggaacactggctcaacaacaccatcca

SEQ ID NO: 6502 - DNA, 36 bp, Artificial Sequence
  Synthetic oligonucleotide
gataccccgcccagtcattttgcgcccacaactcta

SEQ ID NO: 6503 - DNA, 35 bp, Artificial Sequence
  Synthetic oligonucleotide
tttagccgacctctggccgtactgcaactttgcac

SEQ ID NO: 6504 - DNA, 35 bp, Artificial Sequence
  Synthetic oligonucleotide
tgaccttctccgtacatgttggcttctatctcccc

SEQ ID NO: 6505 - DNA, 35 bp, Artificial Sequence
  Synthetic oligonucleotide
gagccagcactcctttcctctctagcagtttggcc

SEQ ID NO: 6506 - DNA, 35 bp, Artificial Sequence
  Synthetic oligonucleotide
ttccacccgaaggatcgcgctttctatccccttgg

SEQ ID NO: 6507 - DNA, 35 bp, Artificial Sequence
  Synthetic oligonucleotide
tccgcatcctctgtctccttatagtcccaggtatt

SEQ ID NO: 6508 - DNA, 35 bp, Artificial Sequence
  Synthetic oligonucleotide
atctgccccaaatgaccttcctgtcgctgaccccg

SEQ ID NO: 6509 - DNA, 36 bp, Artificial Sequence
  Synthetic oligonucleotide
agccacattcgaatgcaccacatcagccctaccgca

SEQ ID NO: 6510 - DNA, 35 bp, Artificial Sequence
  Synthetic oligonucleotide
gacatgcacgcggttcctcgccttacaccttcttg

SEQ ID NO: 6511 - DNA, 36 bp, Artificial Sequence
  Synthetic oligonucleotide
atccaccgctgatggcatcttctccgtccacgccaa

SEQ ID NO: 6512 - DNA, 35 bp, Artificial Sequence
  Synthetic oligonucleotide
gtcaaccgtccctgagtccgctctcttgtaccctt

SEQ ID NO: 6513 - DNA, 35 bp, Artificial Sequence
  Synthetic oligonucleotide
tcaccctcaaacaccgctggatcatggctgacctc

SEQ ID NO: 6514 - DNA, 35 bp, Artificial Sequence
  Synthetic oligonucleotide
tacacatccacatcacgcatacgggctatcactat

SEQ ID NO: 6515 - DNA, 37 bp, Artificial Sequence
  Synthetic oligonucleotide
actgacacggttcgggaaaggggggaaggcggaatga

SEQ ID NO: 6516 - DNA, 36 bp, Artificial Sequence
  Synthetic oligonucleotide
tgccatgttgatcttttgactctcgcgctccaccca

SEQ ID NO: 6517 - DNA, 35 bp, Artificial Sequence
  Synthetic oligonucleotide
aacagcacaattctatccgcgaccctttccgccac

SEQ ID NO: 6518 - DNA, 35 bp, Artificial Sequence
  Synthetic oligonucleotide
ggggtacgttgggggcgggtagagttaggggaata

SEQ ID NO: 6519 - DNA, 35 bp, Artificial Sequence
  Synthetic oligonucleotide
gaacgagagtgtggagtgaggtggtgaggggtgtg

SEQ ID NO: 6520 - DNA, 35 bp, Artificial Sequence
  Synthetic oligonucleotide
tgccttggccggtggagagcgggttgggagggtgt

SEQ ID NO: 6521 - DNA, 37 bp, Artificial Sequence
  Synthetic oligonucleotide
tgtgacaccatcaacatagccgctaactgaaccttga

SEQ ID NO: 6522 - DNA, 37 bp, Artificial Sequence
  Synthetic oligonucleotide
tacactgagggcggtacgagcgttggggccagcggga

SEQ ID NO: 6523 - DNA, 35 bp, Artificial Sequence
  Synthetic oligonucleotide
acaccctccgtaagcctatttgtgcttgtcttgtc

SEQ ID NO: 6524 - DNA, 35 bp, Artificial Sequence
  Synthetic oligonucleotide
gtggcgggagaagtaggggcgggaagggttgagta

SEQ ID NO: 6525 - DNA, 35 bp, Artificial Sequence
  Synthetic oligonucleotide
tcacggtccgaaactcgcgaggcgacccgttctac

SEQ ID NO: 6526 - DNA, 35 bp, Artificial Sequence
  Synthetic oligonucleotide
tacagtccatgacgtttcacctcgcgttcaccctc

SEQ ID NO: 6527 - DNA, 35 bp, Artificial Sequence
  Synthetic oligonucleotide
tacgtgctaactcacaaccatctaccaacagagcc

SEQ ID NO: 6528 - DNA, 37 bp, Artificial Sequence
  Synthetic oligonucleotide
agtacacagggggggggtaggaaaggagctaggacga

SEQ ID NO: 6529 - DNA, 37 bp, Artificial Sequence
  Synthetic oligonucleotide
atcgtctccgtcactgccatccctgttagcctctcga

SEQ ID NO: 6530 - DNA, 35 bp, Artificial Sequence
  Synthetic oligonucleotide
tatccactcgcagtccttgtttacttcatcgctcg

SEQ ID NO: 6531 - DNA, 36 bp, Artificial Sequence
  Synthetic oligonucleotide
acccacagccctggcccgtcatgaaacttctgcgaa

SEQ ID NO: 6532 - DNA, 35 bp, Artificial Sequence
  Synthetic oligonucleotide
gacccccaccggcttaggcgtacacacccatacga

SEQ ID NO: 6533 - DNA, 37 bp, Artificial Sequence
  Synthetic oligonucleotide
ttagggccacgccgcctgactttgtcccttcctttga

SEQ ID NO: 6534 - DNA, 35 bp, Artificial Sequence
  Synthetic oligonucleotide
gcctcccgaacgcggccagttccaccgcgccacct

SEQ ID NO: 6535 - DNA, 35 bp, Artificial Sequence
  Synthetic oligonucleotide
tcgaccagatcgccctacctgtttagtctgtccct

SEQ ID NO: 6536 - DNA, 35 bp, Artificial Sequence
  Synthetic oligonucleotide
atggtacgctaccttgatctgtcctcgctcccctt

SEQ ID NO: 6537 - DNA, 35 bp, Artificial Sequence
  Synthetic oligonucleotide
acgccacaccaatcaagcatccggtctcactgcac

SEQ ID NO: 6538 - DNA, 35 bp, Artificial Sequence
  Synthetic oligonucleotide
gcaccatatcgccaacgaccagcctcacccatttg

SEQ ID NO: 6539 - DNA, 38 bp, Artificial Sequence
  Synthetic oligonucleotide
gacccatgccttccacacgtcagccttcgccctcctga

SEQ ID NO: 6540 - DNA, 36 bp, Artificial Sequence
  Synthetic oligonucleotide
tgcgaacatccgatttctattgtgctatgctcctca

SEQ ID NO: 6541 - DNA, 35 bp, Artificial Sequence
  Synthetic oligonucleotide
acccaccctcgtgtccgcgaaaactctactctcca

SEQ ID NO: 6542 - DNA, 37 bp, Artificial Sequence
  Synthetic oligonucleotide
tagccgtcccgccgctgccaaggctctctgaacccga

SEQ ID NO: 6543 - DNA, 38 bp, Artificial Sequence
  Synthetic oligonucleotide
tcctcccctcgactgtttcaagcatcactcacacatga

SEQ ID NO: 6544 - DNA, 35 bp, Artificial Sequence
  Synthetic oligonucleotide
tgcgctccacaagtcgttccttccttccacgttcg

SEQ ID NO: 6545 - DNA, 34 bp, Artificial Sequence
  Synthetic oligonucleotide
tgcatcccatattcggtccctcatccatgttgaa

SEQ ID NO: 6546 - DNA, 37 bp, Artificial Sequence
  Synthetic oligonucleotide
ggactgcatcacagtaccatttcaagccacccttcga

SEQ ID NO: 6547 - DNA, 35 bp, Artificial Sequence
  Synthetic oligonucleotide
acgtagtacggcccctctagcaacccacccacctg

SEQ ID NO: 6548 - DNA, 36 bp, Artificial Sequence
  Synthetic oligonucleotide
ttgcccactccccccagagccttcatagtcgttcga

SEQ ID NO: 6549 - DNA, 38 bp, Artificial Sequence
  Synthetic oligonucleotide
tcgcgtcgaaccacctgtcctgtgcctgccttgcttga

SEQ ID NO: 6550 - DNA, 35 bp, Artificial Sequence
  Synthetic oligonucleotide
tcctccctcataatcctttgcacattgagacggtt

SEQ ID NO: 6551 - DNA, 35 bp, Artificial Sequence
  Synthetic oligonucleotide
tccgccatgtccgcccccgcgcaactgcttcttta

SEQ ID NO: 6552 - DNA, 37 bp, Artificial Sequence
  Synthetic oligonucleotide
tcaagcgggggggagtaggggtggagcggaaacgcga

SEQ ID NO: 6553 - DNA, 37 bp, Artificial Sequence
  Synthetic oligonucleotide
gtcgtcccccctccagtgccatccgggaacaccttga

SEQ ID NO: 6554 - DNA, 38 bp, Artificial Sequence
  Synthetic oligonucleotide
acccgccccaacatgcatcttcaactaagcccccgtga

SEQ ID NO: 6555 - DNA, 36 bp, Artificial Sequence
  Synthetic oligonucleotide
tgccgccccgccacgacaagttggcaccatccccta

SEQ ID NO: 6556 - DNA, 34 bp, Artificial Sequence
  Synthetic oligonucleotide
taaaaacagtgtgcccatcgcatctggctctgcc

SEQ ID NO: 6557 - DNA, 35 bp, Artificial Sequence
  Synthetic oligonucleotide
tgtaggtgccgttcttccgtcctcccttggcctac

SEQ ID NO: 6558 - DNA, 35 bp, Artificial Sequence
  Synthetic oligonucleotide
gtcccattcaccgtacgtgaattattacacctgcc

SEQ ID NO: 6559 - DNA, 35 bp, Artificial Sequence
  Synthetic oligonucleotide
gctccgaccaccccctcgcactctagccttaatag

SEQ ID NO: 6560 - DNA, 35 bp, Artificial Sequence
  Synthetic oligonucleotide
ggagacgttagggagggagggaaagggtgggggtg

SEQ ID NO: 6561 - DNA, 37 bp, Artificial Sequence
  Synthetic oligonucleotide
gcccccaacacccctgcatttgaaaggacgccatgga

SEQ ID NO: 6562 - DNA, 38 bp, Artificial Sequence
  Synthetic oligonucleotide
gacggaacctcagccatacccgacctgctaccatttga

SEQ ID NO: 6563 - DNA, 35 bp, Artificial Sequence
  Synthetic oligonucleotide
taacaccccctttgcctattgtacgcgcttcccca

SEQ ID NO: 6564 - DNA, 35 bp, Artificial Sequence
  Synthetic oligonucleotide
tcacccccccaagtgtgtccattgttctgctggta

SEQ ID NO: 6565 - DNA, 36 bp, Artificial Sequence
  Synthetic oligonucleotide
gtgagtgcctaggagggtaggggatgggggtgaggt

SEQ ID NO: 6566 - DNA, 35 bp, Artificial Sequence
  Synthetic oligonucleotide
tgatccgacgccgagcatatataccctgctccctt

SEQ ID NO: 6567 - DNA, 35 bp, Artificial Sequence
  Synthetic oligonucleotide
gcccgcatccacctgcatcagcctttcccataaat

SEQ ID NO: 6568 - DNA, 38 bp, Artificial Sequence
  Synthetic oligonucleotide
gaaccggggggaggggcaaggaatgacggtgctattga

SEQ ID NO: 6569 - DNA, 35 bp, Artificial Sequence
  Synthetic oligonucleotide
gcgccctaccgctgccctctcaccagtgaacttac

SEQ ID NO: 6570 - DNA, 38 bp, Artificial Sequence
  Synthetic oligonucleotide
acatgccgcctgcaaccctgtccacgccttctccttga

SEQ ID NO: 6571 - DNA, 35 bp, Artificial Sequence
  Synthetic oligonucleotide
gccgcccactggctctgtactcctggcatcctttc

SEQ ID NO: 6572 - DNA, 35 bp, Artificial Sequence
  Synthetic oligonucleotide
tgccatagccgttcggtaataacttccgccctttt

SEQ ID NO: 6573 - DNA, 35 bp, Artificial Sequence
  Synthetic oligonucleotide
tagcattgcatcgctggtccgcccctcttgccacg

SEQ ID NO: 6574 - DNA, 36 bp, Artificial Sequence
  Synthetic oligonucleotide
gccgagtcaacgcctgctcatcacgccgtctccata

SEQ ID NO: 6575 - DNA, 35 bp, Artificial Sequence
  Synthetic oligonucleotide
gcgaccttaggagcgcggacccacctgccactgtc

SEQ ID NO: 6576 - DNA, 36 bp, Artificial Sequence
  Synthetic oligonucleotide
gacccacacactgcccctttcggtttacgaccggca

SEQ ID NO: 6577 - DNA, 35 bp, Artificial Sequence
  Synthetic oligonucleotide
gaaccgatgaagaggtgggtgggaagtaacgacag

SEQ ID NO: 6578 - DNA, 35 bp, Artificial Sequence
  Synthetic oligonucleotide
gctacacacatcacctgcccgcttagaaagcgatc

SEQ ID NO: 6579 - DNA, 35 bp, Artificial Sequence
  Synthetic oligonucleotide
gttacccgcccaccaagaaacatgtccgctacttg

SEQ ID NO: 6580 - DNA, 30 bp, Artificial Sequence
  Synthetic oligonucleotide
aaccttaagaccccactgctgcctatgccc

SEQ ID NO: 6581 - DNA, 35 bp, Artificial Sequence
  Synthetic oligonucleotide
tacaccaccaatcacggacagacagcagggcttcg

SEQ ID NO: 6582 - DNA, 37 bp, Artificial Sequence
  Synthetic oligonucleotide
taacaccgcctccatgacctcaaaagcttcccttgga

SEQ ID NO: 6583 - DNA, 35 bp, Artificial Sequence
  Synthetic oligonucleotide
tccgcggagaggggggagcaaagtggaagtatgag

SEQ ID NO: 6584 - DNA, 35 bp, Artificial Sequence
  Synthetic oligonucleotide
tcgtaccgtttcccctgtgcgcttgtactgtccct

SEQ ID NO: 6585 - DNA, 37 bp, Artificial Sequence
  Synthetic oligonucleotide
gccaggggacaataatcagggaagggatggggttgga

SEQ ID NO: 6586 - DNA, 35 bp, Artificial Sequence
  Synthetic oligonucleotide
ctacagccacgcctgttcgctaccctgataccggg

SEQ ID NO: 6587 - DNA, 36 bp, Artificial Sequence
  Synthetic oligonucleotide
acccgcccactcctgagaaggccacactttcctgaa

SEQ ID NO: 6588 - DNA, 35 bp, Artificial Sequence
  Synthetic oligonucleotide
gaaccgcgccctactttattagcaccaccattgca

SEQ ID NO: 6589 - DNA, 35 bp, Artificial Sequence
  Synthetic oligonucleotide
atgcaccaccttggcgatttccttgccacaccggc

SEQ ID NO: 6590 - DNA, 35 bp, Artificial Sequence
  Synthetic oligonucleotide
gcaacgcattgccttcctgtctactggcctcaatc

SEQ ID NO: 6591 - DNA, 36 bp, Artificial Sequence
  Synthetic oligonucleotide
gacatatgcccccgctctcgtacctgccgcaacaca

SEQ ID NO: 6592 - DNA, 35 bp, Artificial Sequence
  Synthetic oligonucleotide
tcacttggccctcgcgccaagtccctcgcacatct

SEQ ID NO: 6593 - DNA, 36 bp, Artificial Sequence
  Synthetic oligonucleotide
gtacgtccccgcccccccttacacacacggaagcca

SEQ ID NO: 6594 - DNA, 36 bp, Artificial Sequence
  Synthetic oligonucleotide
atcggagccgttcgcgtttcccctctgtctgtgcca

SEQ ID NO: 6595 - DNA, 35 bp, Artificial Sequence
  Synthetic oligonucleotide
acaccaccgagctctatccaatacagtcgccgtac

SEQ ID NO: 6596 - DNA, 36 bp, Artificial Sequence
  Synthetic oligonucleotide
atcacatcgtccactcctgtcacggtccgcttttaa

SEQ ID NO: 6597 - DNA, 38 bp, Artificial Sequence
  Synthetic oligonucleotide
gcggacacatcgctgcgttttcctgccgtactccatga

SEQ ID NO: 6598 - DNA, 35 bp, Artificial Sequence
  Synthetic oligonucleotide
tacctcatcagtgttccaccagcaacgaactccac

SEQ ID NO: 6599 - DNA, 35 bp, Artificial Sequence
  Synthetic oligonucleotide
gatgtaccgcctgacctatcacacattgccctggg

SEQ ID NO: 6600 - DNA, 36 bp, Artificial Sequence
  Synthetic oligonucleotide
agtaaaggggagtacgagggtagggcggggtgtgga

SEQ ID NO: 6601 - DNA, 35 bp, Artificial Sequence
  Synthetic oligonucleotide
gaggggtgaaggaggtatgggccgcgatgaaggga

SEQ ID NO: 6602 - DNA, 35 bp, Artificial Sequence
  Synthetic oligonucleotide
gtccaacagtccgcccctggctagctccatccgac

SEQ ID NO: 6603 - DNA, 37 bp, Artificial Sequence
  Synthetic oligonucleotide
atgcaccaccactgcacctcatcttcgatggactcga

SEQ ID NO: 6604 - DNA, 36 bp, Artificial Sequence
  Synthetic oligonucleotide
acatagtcgatctgcacccgccgcgccttccgccca

SEQ ID NO: 6605 - DNA, 35 bp, Artificial Sequence
  Synthetic oligonucleotide
gtgccacactcgcggttcacgctatcccgaccgac

SEQ ID NO: 6606 - DNA, 35 bp, Artificial Sequence
  Synthetic oligonucleotide
ggacacatccacgctgttttttcttgcttggttac

SEQ ID NO: 6607 - DNA, 35 bp, Artificial Sequence
  Synthetic oligonucleotide
gccaacgctagaacatgcactcccacactacacca

SEQ ID NO: 6608 - DNA, 38 bp, Artificial Sequence
  Synthetic oligonucleotide
acacgggggaacaggattggggcatgaggagagtgtga

SEQ ID NO: 6609 - DNA, 36 bp, Artificial Sequence
  Synthetic oligonucleotide
taccccaaccgcctatcaccactgtcacggtgccaa

SEQ ID NO: 6610 - DNA, 35 bp, Artificial Sequence
  Synthetic oligonucleotide
tatgctcctgcatgcacctccgttgaccagccact

SEQ ID NO: 6611 - DNA, 37 bp, Artificial Sequence
  Synthetic oligonucleotide
tgaaccgccttgctcctaagccctccgttgactacga

SEQ ID NO: 6612 - DNA, 36 bp, Artificial Sequence
  Synthetic oligonucleotide
agatacctcggccaaagtgcacccacctcgctttta

SEQ ID NO: 6613 - DNA, 35 bp, Artificial Sequence
  Synthetic oligonucleotide
gacccaccccatttctactatacgggcgcatcgcc

SEQ ID NO: 6614 - DNA, 35 bp, Artificial Sequence
  Synthetic oligonucleotide
tagacgccccagacccgtaattcgctctggttctt

SEQ ID NO: 6615 - DNA, 35 bp, Artificial Sequence
  Synthetic oligonucleotide
tgctcacctcaacgcattctgtcccatcttcacgc

SEQ ID NO: 6616 - DNA, 38 bp, Artificial Sequence
  Synthetic oligonucleotide
aacgcaccatcgctccctgtccgccctgcctgccgtga

SEQ ID NO: 6617 - DNA, 36 bp, Artificial Sequence
  Synthetic oligonucleotide
ggggaggggggaggaaaagttgtcgacagagaatga

SEQ ID NO: 6618 - DNA, 35 bp, Artificial Sequence
  Synthetic oligonucleotide
gcactccacgaggcgtctctacgcacaaccacgac

SEQ ID NO: 6619 - DNA, 37 bp, Artificial Sequence
  Synthetic oligonucleotide
aagcgcaccccactgtttttctcatgtcaccagacga

SEQ ID NO: 6620 - DNA, 35 bp, Artificial Sequence
  Synthetic oligonucleotide
tgccaccaatcgactcggagtctgccttctcatcc

SEQ ID NO: 6621 - DNA, 35 bp, Artificial Sequence
  Synthetic oligonucleotide
tcccggtcccccaagtgcaaagcccttactgctct

SEQ ID NO: 6622 - DNA, 35 bp, Artificial Sequence
  Synthetic oligonucleotide
gatagcgaaccttgaaccccagcctacgtctcgct

SEQ ID NO: 6623 - DNA, 35 bp, Artificial Sequence
  Synthetic oligonucleotide
tgcaaagttccgtccccggtcagccacacacactt

SEQ ID NO: 6624 - DNA, 35 bp, Artificial Sequence
  Synthetic oligonucleotide
tacggcacccccatccacggattcgcattgccctt

SEQ ID NO: 6625 - DNA, 37 bp, Artificial Sequence
  Synthetic oligonucleotide
gtcagtggtggaggggtgttgtaggctgagggaggga

SEQ ID NO: 6626 - DNA, 34 bp, Artificial Sequence
  Synthetic oligonucleotide
tctgacgacgccacacgtattaccctcccggtcc

SEQ ID NO: 6627 - DNA, 35 bp, Artificial Sequence
  Synthetic oligonucleotide
acttccgccgcctcgtagctttttattaactctcg

SEQ ID NO: 6628 - DNA, 34 bp, Artificial Sequence
  Synthetic oligonucleotide
attcccgctggacattcacagtggctccacctac

SEQ ID NO: 6629 - DNA, 37 bp, Artificial Sequence
  Synthetic oligonucleotide
gccgagccacccgacggcctccgacgcacttccccga

SEQ ID NO: 6630 - DNA, 35 bp, Artificial Sequence
  Synthetic oligonucleotide
ttacggtcccgaatacctgcgccacatttccctgt

SEQ ID NO: 6631 - DNA, 36 bp, Artificial Sequence
  Synthetic oligonucleotide
acactgcagctacacacctccgcactagtaccgcta

SEQ ID NO: 6632 - DNA, 35 bp, Artificial Sequence
  Synthetic oligonucleotide
tccaaaccctgggggtaatgtcctggtcccacaca

SEQ ID NO: 6633 - DNA, 38 bp, Artificial Sequence
  Synthetic oligonucleotide
atggtagggagggggtggtttaagggagaggggattga

SEQ ID NO: 6634 - DNA, 35 bp, Artificial Sequence
  Synthetic oligonucleotide
atcgacccatccgccttaatacgcccagtaactta

SEQ ID NO: 6635 - DNA, 35 bp, Artificial Sequence
  Synthetic oligonucleotide
gcaggcctcaacagcaggcctggaatgaccactct

SEQ ID NO: 6636 - DNA, 38 bp, Artificial Sequence
  Synthetic oligonucleotide
agatcgtgcgcctgacgcccccattgtacccctgccga

SEQ ID NO: 6637 - DNA, 35 bp, Artificial Sequence
  Synthetic oligonucleotide
gccaacgagtgcgtcacactcatcgcttcttccct

SEQ ID NO: 6638 - DNA, 35 bp, Artificial Sequence
  Synthetic oligonucleotide
tccccacctcgcgctccagaccaccgaaaacacca

SEQ ID NO: 6639 - DNA, 36 bp, Artificial Sequence
  Synthetic oligonucleotide
acacaccaccccccagacccgcaatccagttcgcga

SEQ ID NO: 6640 - DNA, 36 bp, Artificial Sequence
  Synthetic oligonucleotide
acccaccggcgaccacatttgacgatcccacctgta

SEQ ID NO: 6641 - DNA, 34 bp, Artificial Sequence
  Synthetic oligonucleotide
atgtgcaatgcgcctttcttgttaccccgcttat

SEQ ID NO: 6642 - DNA, 35 bp, Artificial Sequence
  Synthetic oligonucleotide
acgaatctgcccccgagcgtgtccctgttcttcgt

SEQ ID NO: 6643 - DNA, 36 bp, Artificial Sequence
  Synthetic oligonucleotide
gtacgcaaccaccgcaccatgcccgagaaattatca

SEQ ID NO: 6644 - DNA, 35 bp, Artificial Sequence
  Synthetic oligonucleotide
tgatgggaaggtgagtgaggaggattggaaggaag

SEQ ID NO: 6645 - DNA, 35 bp, Artificial Sequence
  Synthetic oligonucleotide
tgtagcctgtccgtttcagtcccatgatctacctc

SEQ ID NO: 6646 - DNA, 34 bp, Artificial Sequence
  Synthetic oligonucleotide
tcatacgcacagtcaatcacgtaactttcccgtc

SEQ ID NO: 6647 - DNA, 35 bp, Artificial Sequence
  Synthetic oligonucleotide
acatcacgggcccgaatcgagttagttcatcacac

SEQ ID NO: 6648 - DNA, 35 bp, Artificial Sequence
  Synthetic oligonucleotide
gccatctcgctagctcgtagcctgtcccctccttg

SEQ ID NO: 6649 - DNA, 36 bp, Artificial Sequence
  Synthetic oligonucleotide
tcctgcctccacggtattttgggttaccgttctaca

SEQ ID NO: 6650 - DNA, 36 bp, Artificial Sequence
  Synthetic oligonucleotide
tacacctccgaccccgtaacccccaatacaattgga

SEQ ID NO: 6651 - DNA, 37 bp, Artificial Sequence
  Synthetic oligonucleotide
gcccccatccattgaatcttggccatcactctttcga

SEQ ID NO: 6652 - DNA, 36 bp, Artificial Sequence
  Synthetic oligonucleotide
gtacctgcctcttccggtctatctgtaccgacttta

SEQ ID NO: 6653 - DNA, 36 bp, Artificial Sequence
  Synthetic oligonucleotide
aacccaccccagacttccaaggaacgcctatcctta

SEQ ID NO: 6654 - DNA, 35 bp, Artificial Sequence
  Synthetic oligonucleotide
ggattgcaaagcgctaacatacgtaccaccctgtc

SEQ ID NO: 6655 - DNA, 37 bp, Artificial Sequence
  Synthetic oligonucleotide
tccacccacgggggccctccctctcgttcgcctatga

SEQ ID NO: 6656 - DNA, 35 bp, Artificial Sequence
  Synthetic oligonucleotide
ttggggcccctctgaatttttgcctgccttgggaa

SEQ ID NO: 6657 - DNA, 36 bp, Artificial Sequence
  Synthetic oligonucleotide
taagccgctgccatttaccggtacctgcccccctca

SEQ ID NO: 6658 - DNA, 35 bp, Artificial Sequence
  Synthetic oligonucleotide
atccatccgccacttaccttgggtcgttcacatcg

SEQ ID NO: 6659 - DNA, 36 bp, Artificial Sequence
  Synthetic oligonucleotide
ggtcgccctctctgtctccactgtcctttctagaca

SEQ ID NO: 6660 - DNA, 37 bp, Artificial Sequence
  Synthetic oligonucleotide
gcacccacccgtcttgccgccgctacatcctccttga

SEQ ID NO: 6661 - DNA, 38 bp, Artificial Sequence
  Synthetic oligonucleotide
gtgcccatcctgactgcccgccgcccagtcacatctga

SEQ ID NO: 6662 - DNA, 34 bp, Artificial Sequence
  Synthetic oligonucleotide
gttcgactcccgctctttgttacgttgatcttcc

SEQ ID NO: 6663 - DNA, 35 bp, Artificial Sequence
  Synthetic oligonucleotide
acacgactacgtttgcctttcccctgcctgcccaa

SEQ ID NO: 6664 - DNA, 37 bp, Artificial Sequence
  Synthetic oligonucleotide
gcactccgcccttgctggttctatcactcaatgttga

SEQ ID NO: 6665 - DNA, 35 bp, Artificial Sequence
  Synthetic oligonucleotide
acccggacggccttacatttaccttcaccttggtt

SEQ ID NO: 6666 - DNA, 38 bp, Artificial Sequence
  Synthetic oligonucleotide
gcaacgcgcgttctcgttcctgtgattctttcccctga

SEQ ID NO: 6667 - DNA, 37 bp, Artificial Sequence
  Synthetic oligonucleotide
gctgaggttaggtaggaccaagggggggtggtggcga

SEQ ID NO: 6668 - DNA, 37 bp, Artificial Sequence
  Synthetic oligonucleotide
ttgtcacgccggacgcctaaactatctctgccttgga

SEQ ID NO: 6669 - DNA, 34 bp, Artificial Sequence
  Synthetic oligonucleotide
gtcatactggcacatgttacgtaccgccaccact

SEQ ID NO: 6670 - DNA, 35 bp, Artificial Sequence
  Synthetic oligonucleotide
tctacgtccttgctatagccaattgttgcctctca

SEQ ID NO: 6671 - DNA, 37 bp, Artificial Sequence
  Synthetic oligonucleotide
gctcggagaaggaggaaggtggtttggggcggaagga

SEQ ID NO: 6672 - DNA, 35 bp, Artificial Sequence
  Synthetic oligonucleotide
aaccttagacgcccccacatggtactaccagcccg

SEQ ID NO: 6673 - DNA, 37 bp, Artificial Sequence
  Synthetic oligonucleotide
aacgcgcaatcgctccttcgtcccgcctctgaaccga

SEQ ID NO: 6674 - DNA, 35 bp, Artificial Sequence
  Synthetic oligonucleotide
tcaggccccctcccccagcttcctagtgacggtct

SEQ ID NO: 6675 - DNA, 36 bp, Artificial Sequence
  Synthetic oligonucleotide
gcacccactcctagtctatcgagtcctgctcgtcta

SEQ ID NO: 6676 - DNA, 35 bp, Artificial Sequence
  Synthetic oligonucleotide
gatatgggtggtgagggagtaaggtgaaacgtaag

SEQ ID NO: 6677 - DNA, 37 bp, Artificial Sequence
  Synthetic oligonucleotide
gtgtccagccccggtgacctcttgtgccctcgaccga

SEQ ID NO: 6678 - DNA, 35 bp, Artificial Sequence
  Synthetic oligonucleotide
agacccgacgcattaccgtagacgccccatcaccc

SEQ ID NO: 6679 - DNA, 36 bp, Artificial Sequence
  Synthetic oligonucleotide
actgacaaccaccgaatttttgatcactgattctta

SEQ ID NO: 6680 - DNA, 35 bp, Artificial Sequence
  Synthetic oligonucleotide
gcccgctgtccattcccagccacccttccgtttcg

SEQ ID NO: 6681 - DNA, 38 bp, Artificial Sequence
  Synthetic oligonucleotide
gccgtggtcacgccttttgtcttaccgccttcctttga

SEQ ID NO: 6682 - DNA, 38 bp, Artificial Sequence
  Synthetic oligonucleotide
atcctgcaccgcacactctggtcttacacatccgctga

SEQ ID NO: 6683 - DNA, 35 bp, Artificial Sequence
  Synthetic oligonucleotide
taagcgtacgccgctcccgcacccccctctccgat

SEQ ID NO: 6684 - DNA, 35 bp, Artificial Sequence
  Synthetic oligonucleotide
gtccacgatcgaatcgttccccacatcacagtcca

SEQ ID NO: 6685 - DNA, 35 bp, Artificial Sequence
  Synthetic oligonucleotide
actatcaccccacgcgaatgcgttgctacacctca

SEQ ID NO: 6686 - DNA, 34 bp, Artificial Sequence
  Synthetic oligonucleotide
acgtcctgcactcgactagttttccgtccatttc

SEQ ID NO: 6687 - DNA, 35 bp, Artificial Sequence
  Synthetic oligonucleotide
tgctcgccggccgccaccacacgcattcataccga

SEQ ID NO: 6688 - DNA, 38 bp, Artificial Sequence
  Synthetic oligonucleotide
gcacattcgccgtgtctttttgccctcgccttcaatga

SEQ ID NO: 6689 - DNA, 35 bp, Artificial Sequence
  Synthetic oligonucleotide
tcagcaaactgctcccgttgttgctctccctagta

SEQ ID NO: 6690 - DNA, 36 bp, Artificial Sequence
  Synthetic oligonucleotide
taggtgccgccaacggtcttgcctttttcctgccca

SEQ ID NO: 6691 - DNA, 36 bp, Artificial Sequence
  Synthetic oligonucleotide
gccgacgcaccttccccgtttatctcctcagtgtta

SEQ ID NO: 6692 - DNA, 38 bp, Artificial Sequence
  Synthetic oligonucleotide
gcaccaccccatagccacgcttacgcagtaggtcctga

SEQ ID NO: 6693 - DNA, 35 bp, Artificial Sequence
  Synthetic oligonucleotide
tgtgccaccatctgctgattgtctattctccatgg

SEQ ID NO: 6694 - DNA, 36 bp, Artificial Sequence
  Synthetic oligonucleotide
aatgtccccgatcccgcacccggtttgcccgtttca

SEQ ID NO: 6695 - DNA, 35 bp, Artificial Sequence
  Synthetic oligonucleotide
tagccaaccacgatcctcctctaacgcatgtagtc

SEQ ID NO: 6696 - DNA, 36 bp, Artificial Sequence
  Synthetic oligonucleotide
gtacgcggcacactgctgtccctaactaactctcca

SEQ ID NO: 6697 - DNA, 37 bp, Artificial Sequence
  Synthetic oligonucleotide
gttgggggaaagcgattagtgtgggaggggatgggga

SEQ ID NO: 6698 - DNA, 35 bp, Artificial Sequence
  Synthetic oligonucleotide
ttcggggtggctcgggggcgggtggaagtagaagg

SEQ ID NO: 6699 - DNA, 35 bp, Artificial Sequence
  Synthetic oligonucleotide
gataaccactcatcgcatgtgcaattacacttctc

SEQ ID NO: 6700 - DNA, 35 bp, Artificial Sequence
  Synthetic oligonucleotide
actatgcactgatcgttgcgcgtttttttttcttc

SEQ ID NO: 6701 - DNA, 35 bp, Artificial Sequence
  Synthetic oligonucleotide
tgaccaccgtgccggctagctcttggtacctttcc

SEQ ID NO: 6702 - DNA, 37 bp, Artificial Sequence
  Synthetic oligonucleotide
tgtgacccgcccatctcttacctgtgtttcactgtga

SEQ ID NO: 6703 - DNA, 37 bp, Artificial Sequence
  Synthetic oligonucleotide
ttgacgtggaccatgggaattacgggaggggttggga

SEQ ID NO: 6704 - DNA, 36 bp, Artificial Sequence
  Synthetic oligonucleotide
atccgaccactcgatccaggagtcttccatacctta

SEQ ID NO: 6705 - DNA, 36 bp, Artificial Sequence
  Synthetic oligonucleotide
gtcctccccaatgtgcttgttatagctatcccgcca

SEQ ID NO: 6706 - DNA, 35 bp, Artificial Sequence
  Synthetic oligonucleotide
acccgtcctgcttcacataagcttcttctcatgga

SEQ ID NO: 6707 - DNA, 35 bp, Artificial Sequence
  Synthetic oligonucleotide
gacccagcactccccaaatacgcacggctccccct

SEQ ID NO: 6708 - DNA, 35 bp, Artificial Sequence
  Synthetic oligonucleotide
ttgccttcctcagtcgcttttcttttttctcatta

SEQ ID NO: 6709 - DNA, 36 bp, Artificial Sequence
  Synthetic oligonucleotide
tagcccctcaacttcactgtcctgcgacgttaatca

SEQ ID NO: 6710 - DNA, 35 bp, Artificial Sequence
  Synthetic oligonucleotide
tttgctgtccctcctcacttcgtgtcagtcacact

SEQ ID NO: 6711 - DNA, 35 bp, Artificial Sequence
  Synthetic oligonucleotide
taggagcccggcctctcacctagtaccccttcatg

SEQ ID NO: 6712 - DNA, 35 bp, Artificial Sequence
  Synthetic oligonucleotide
gtggcccccctagatccgactttcactgccacccg

SEQ ID NO: 6713 - DNA, 35 bp, Artificial Sequence
  Synthetic oligonucleotide
tcctgaccgaaccatcgatcctcagtcctaccgga

SEQ ID NO: 6714 - DNA, 38 bp, Artificial Sequence
  Synthetic oligonucleotide
acacgccacatgtcgccccgtggacccatacaccatga

SEQ ID NO: 6715 - DNA, 35 bp, Artificial Sequence
  Synthetic oligonucleotide
tcagctcgccccgcttatacatctgtcacaatagt

SEQ ID NO: 6716 - DNA, 37 bp, Artificial Sequence
  Synthetic oligonucleotide
tagatggtggaggtggaagtacggtgggattcggaga

SEQ ID NO: 6717 - DNA, 37 bp, Artificial Sequence
  Synthetic oligonucleotide
accccgtcgtcccactccatctgaattcttgcttcga

SEQ ID NO: 6718 - DNA, 38 bp, Artificial Sequence
  Synthetic oligonucleotide
tcgcctcccatcccacgtagaatttgcaactgccatga

SEQ ID NO: 6719 - DNA, 35 bp, Artificial Sequence
  Synthetic oligonucleotide
acctgtgaccagcacctttggtaacgaccccacac

SEQ ID NO: 6720 - DNA, 36 bp, Artificial Sequence
  Synthetic oligonucleotide
ggacgcatacgtccagtcactatcaactcgtccccc

SEQ ID NO: 6721 - DNA, 37 bp, Artificial Sequence
  Synthetic oligonucleotide
gacccaggcgcacttccctcgtttccctgtcacacga

SEQ ID NO: 6722 - DNA, 35 bp, Artificial Sequence
  Synthetic oligonucleotide
tttgatgcccagaatacctgcctccgcactttggc

SEQ ID NO: 6723 - DNA, 35 bp, Artificial Sequence
  Synthetic oligonucleotide
gcacggagccacaagcgttttctcctccgcacatt

SEQ ID NO: 6724 - DNA, 35 bp, Artificial Sequence
  Synthetic oligonucleotide
gaccgctgccgcattacccgccaacgtatccttgt

SEQ ID NO: 6725 - DNA, 35 bp, Artificial Sequence
  Synthetic oligonucleotide
gatcaacccgcatgtctattgctccccatctgcgc

SEQ ID NO: 6726 - DNA, 35 bp, Artificial Sequence
  Synthetic oligonucleotide
ttctacgcctgttaccacaaatgcccctgtttcat

SEQ ID NO: 6727 - DNA, 35 bp, Artificial Sequence
  Synthetic oligonucleotide
acctatccgcccagtcaaggcaacaacactaccct

SEQ ID NO: 6728 - DNA, 37 bp, Artificial Sequence
  Synthetic oligonucleotide
atcacccacatctgttattcgatatttgtgccctcga

SEQ ID NO: 6729 - DNA, 36 bp, Artificial Sequence
  Synthetic oligonucleotide
tccctccgccccatcctgggtccgcctgtttttgga

SEQ ID NO: 6730 - DNA, 35 bp, Artificial Sequence
  Synthetic oligonucleotide
tgcgcgctcagaccttactgtcacccgttcgcctt

SEQ ID NO: 6731 - DNA, 35 bp, Artificial Sequence
  Synthetic oligonucleotide
tccaagggaaggaggagtattgtagggggggaatg

SEQ ID NO: 6732 - DNA, 35 bp, Artificial Sequence
  Synthetic oligonucleotide
gttatcccccatttgttttgccgctcccaatggct

SEQ ID NO: 6733 - DNA, 35 bp, Artificial Sequence
  Synthetic oligonucleotide
tgcatgtgtagataatcccgttccacctcgtactg

SEQ ID NO: 6734 - DNA, 36 bp, Artificial Sequence
  Synthetic oligonucleotide
tacccatggacgcagtctattttgccttacacttca

SEQ ID NO: 6735 - DNA, 35 bp, Artificial Sequence
  Synthetic oligonucleotide
tttgccccgacccggcgttattcttcagttcccat

SEQ ID NO: 6736 - DNA, 35 bp, Artificial Sequence
  Synthetic oligonucleotide
tgattaaccatcatcgccgccttcccctggtacgc

SEQ ID NO: 6737 - DNA, 36 bp, Artificial Sequence
  Synthetic oligonucleotide
agctgcaccaatgccctgtcacacactttgcctcga

SEQ ID NO: 6738 - DNA, 35 bp, Artificial Sequence
  Synthetic oligonucleotide
tgaccaccacgcccccttgttaaatacacgtccta

SEQ ID NO: 6739 - DNA, 34 bp, Artificial Sequence
  Synthetic oligonucleotide
gactggcctgggacgggacgggtagggagggttg

SEQ ID NO: 6740 - DNA, 35 bp, Artificial Sequence
  Synthetic oligonucleotide
tcacatgccaccgaggactctcctgcgccgccctt

SEQ ID NO: 6741 - DNA, 36 bp, Artificial Sequence
  Synthetic oligonucleotide
gatctgcgcagaatcacccccgccccttaacgccaa

SEQ ID NO: 6742 - DNA, 35 bp, Artificial Sequence
  Synthetic oligonucleotide
tccgtcacctctgcagtcgtcccatccagcctatt

SEQ ID NO: 6743 - DNA, 35 bp, Artificial Sequence
  Synthetic oligonucleotide
aacgatatccacgcagacttgcaccatgccattca

SEQ ID NO: 6744 - DNA, 35 bp, Artificial Sequence
  Synthetic oligonucleotide
gggtgagggtgtgggcattgggtgggcggggcggt

SEQ ID NO: 6745 - DNA, 35 bp, Artificial Sequence
  Synthetic oligonucleotide
gaacacgcgagcgcagcctgggccgcatcctcccc

SEQ ID NO: 6746 - DNA, 36 bp, Artificial Sequence
  Synthetic oligonucleotide
gagtaggacacaagggttaggggggttaagggagaa

SEQ ID NO: 6747 - DNA, 35 bp, Artificial Sequence
  Synthetic oligonucleotide
tgcacgccatatctcgctcaaacactcgggccttc

SEQ ID NO: 6748 - DNA, 35 bp, Artificial Sequence
  Synthetic oligonucleotide
aaccacgcctttccagtccgccaaccacattccgc

SEQ ID NO: 6749 - DNA, 35 bp, Artificial Sequence
  Synthetic oligonucleotide
aagggagggaggtatggtggctctaggtttggggt

SEQ ID NO: 6750 - DNA, 35 bp, Artificial Sequence
  Synthetic oligonucleotide
tgcaaagcctgcctccttcataagacccgcacttc

SEQ ID NO: 6751 - DNA, 35 bp, Artificial Sequence
  Synthetic oligonucleotide
tcctccctacgccgaatcccaattgggtgactctc

SEQ ID NO: 6752 - DNA, 35 bp, Artificial Sequence
  Synthetic oligonucleotide
gtcccaaccccaccattctgagcatcctgatgcca

SEQ ID NO: 6753 - DNA, 35 bp, Artificial Sequence
  Synthetic oligonucleotide
gctccacagcccgccacatgcatcttacggaacac

SEQ ID NO: 6754 - DNA, 35 bp, Artificial Sequence
  Synthetic oligonucleotide
atgcaaagcctcaccctttcctatgcgcttgacgc

SEQ ID NO: 6755 - DNA, 35 bp, Artificial Sequence
  Synthetic oligonucleotide
acccactcccgctcgtgctctggcatgattgccca

SEQ ID NO: 6756 - DNA, 36 bp, Artificial Sequence
  Synthetic oligonucleotide
gacaggccaaaggaagggtggaattagggtaagtga

SEQ ID NO: 6757 - DNA, 35 bp, Artificial Sequence
  Synthetic oligonucleotide
gtccaccgccccccaccctccgtttcgagcgatct

SEQ ID NO: 6758 - DNA, 35 bp, Artificial Sequence
  Synthetic oligonucleotide
gatcgaccgacaggacggcccacactttcctccga

SEQ ID NO: 6759 - DNA, 35 bp, Artificial Sequence
  Synthetic oligonucleotide
ttttgctgccctgacacctggtcgctctcacatcc

SEQ ID NO: 6760 - DNA, 35 bp, Artificial Sequence
  Synthetic oligonucleotide
ttggcggagccctcctgtcgttgcacatttttcgc

SEQ ID NO: 6761 - DNA, 35 bp, Artificial Sequence
  Synthetic oligonucleotide
gaccatagccctccgttcacttccgacccctccgt

SEQ ID NO: 6762 - DNA, 36 bp, Artificial Sequence
  Synthetic oligonucleotide
gacaccttgcgcacgactgccctgccccaaattaca

SEQ ID NO: 6763 - DNA, 35 bp, Artificial Sequence
  Synthetic oligonucleotide
ggacaccgatacctcccgcgccgctaacacatgct

SEQ ID NO: 6764 - DNA, 35 bp, Artificial Sequence
  Synthetic oligonucleotide
gataaggggcggggatgcgctggggtatttggggt

SEQ ID NO: 6765 - DNA, 35 bp, Artificial Sequence
  Synthetic oligonucleotide
tgtgtgtgatcctggtctgctcgaatgccactttc

SEQ ID NO: 6766 - DNA, 35 bp, Artificial Sequence
  Synthetic oligonucleotide
atcgctgcccaggtacgcgacttccactacctcta

SEQ ID NO: 6767 - DNA, 35 bp, Artificial Sequence
  Synthetic oligonucleotide
tgtcgacctcaaccgtgcctcgctctctcccgcct

SEQ ID NO: 6768 - DNA, 36 bp, Artificial Sequence
  Synthetic oligonucleotide
gaggtcgccgccaacactcacgccatgctcgttaca

SEQ ID NO: 6769 - DNA, 36 bp, Artificial Sequence
  Synthetic oligonucleotide
tgagcgaagctcgacccaccccttgcgcttgcccca

SEQ ID NO: 6770 - DNA, 35 bp, Artificial Sequence
  Synthetic oligonucleotide
tgtggcggacctggccagccttttccttcatgcct

SEQ ID NO: 6771 - DNA, 35 bp, Artificial Sequence
  Synthetic oligonucleotide
tccacgggcgtaggggcccccgtgatcctgaacac

SEQ ID NO: 6772 - DNA, 34 bp, Artificial Sequence
  Synthetic oligonucleotide
ggagaggaggagggaacacagtgcatggtaaggg

SEQ ID NO: 6773 - DNA, 36 bp, Artificial Sequence
  Synthetic oligonucleotide
tgctccaccttcccttgccgacttgcgattctcaca

SEQ ID NO: 6774 - DNA, 35 bp, Artificial Sequence
  Synthetic oligonucleotide
accccttccacctgccatgcgctcacgcgtaaatc

SEQ ID NO: 6775 - DNA, 36 bp, Artificial Sequence
  Synthetic oligonucleotide
ttgacttccgccccgtacacgccttgcctgctacga

SEQ ID NO: 6776 - DNA, 35 bp, Artificial Sequence
  Synthetic oligonucleotide
acattgtgtactgttgcgccttccccctgcaccgc

SEQ ID NO: 6777 - DNA, 35 bp, Artificial Sequence
  Synthetic oligonucleotide
gatccagactcccaaagctgctcctcgccgcatat

SEQ ID NO: 6778 - DNA, 37 bp, Artificial Sequence
  Synthetic oligonucleotide
ttgaacactactgcactatcccacagtctgtcgtaga

SEQ ID NO: 6779 - DNA, 38 bp, Artificial Sequence
  Synthetic oligonucleotide
gtcgccgcgcattctttgtccgtcctgcccatccgtga

SEQ ID NO: 6780 - DNA, 35 bp, Artificial Sequence
  Synthetic oligonucleotide
ttcacacaccgccgcccttaatagtgcatctgtta

SEQ ID NO: 6781 - DNA, 35 bp, Artificial Sequence
  Synthetic oligonucleotide
tgcaataaaccacctcgtagcgacccgccttcatt

SEQ ID NO: 6782 - DNA, 35 bp, Artificial Sequence
  Synthetic oligonucleotide
gactccccctgaggtctttcgtgccccccgtatta

SEQ ID NO: 6783 - DNA, 35 bp, Artificial Sequence
  Synthetic oligonucleotide
tcctgcacccccgccttgttgagcccctcctctag

SEQ ID NO: 6784 - DNA, 38 bp, Artificial Sequence
  Synthetic oligonucleotide
gcaccccgtagcacgctatacacacatgtccaccttga

SEQ ID NO: 6785 - DNA, 35 bp, Artificial Sequence
  Synthetic oligonucleotide
gcaaccgcgtagcaaggcctcccatcccaacgtac

SEQ ID NO: 6786 - DNA, 38 bp, Artificial Sequence
  Synthetic oligonucleotide
tcgcaccacttctgcctcacatggttgttctgccttga

SEQ ID NO: 6787 - DNA, 37 bp, Artificial Sequence
  Synthetic oligonucleotide
gtgtgggaaggggccgggctgaggcatttggggagga

SEQ ID NO: 6788 - DNA, 36 bp, Artificial Sequence
  Synthetic oligonucleotide
gcctgcctccgagcttgtcgcaggttctccatcata

SEQ ID NO: 6789 - DNA, 36 bp, Artificial Sequence
  Synthetic oligonucleotide
tccacaaccatcgcacccacaggatgctttctttga

SEQ ID NO: 6790 - DNA, 38 bp, Artificial Sequence
  Synthetic oligonucleotide
gaagagacagcggggcaaaggggcaaaagggtgtagga

SEQ ID NO: 6791 - DNA, 35 bp, Artificial Sequence
  Synthetic oligonucleotide
gccatgtcactcgcctccgactcttcttattcgtc

SEQ ID NO: 6792 - DNA, 35 bp, Artificial Sequence
  Synthetic oligonucleotide
accccacgaagtcttcgtcagtcagcacatccctc

SEQ ID NO: 6793 - DNA, 36 bp, Artificial Sequence
  Synthetic oligonucleotide
tgcatgggaagggggctgggggggtgttagaaggca

SEQ ID NO: 6794 - DNA, 35 bp, Artificial Sequence
  Synthetic oligonucleotide
taacccctggcgtcccatctcccccgtctttaggt

SEQ ID NO: 6795 - DNA, 35 bp, Artificial Sequence
  Synthetic oligonucleotide
atgtactgttgccacccactgccccccgatatggc

SEQ ID NO: 6796 - DNA, 35 bp, Artificial Sequence
  Synthetic oligonucleotide
gcactctatccgcgtattccgtcaagccatcatcg

SEQ ID NO: 6797 - DNA, 37 bp, Artificial Sequence
  Synthetic oligonucleotide
tgctcaacactcattcctccacgacgctgtccgccga

SEQ ID NO: 6798 - DNA, 35 bp, Artificial Sequence
  Synthetic oligonucleotide
gtgcaactcctacccgcgtttcgacctcccgagta

SEQ ID NO: 6799 - DNA, 35 bp, Artificial Sequence
  Synthetic oligonucleotide
aatgactccgcctcagccactgttcccgtttaatc

SEQ ID NO: 6800 - DNA, 37 bp, Artificial Sequence
  Synthetic oligonucleotide
tgtagcctcacaatgaccttggcgccacacatccgga

SEQ ID NO: 6801 - DNA, 38 bp, Artificial Sequence
  Synthetic oligonucleotide
gtgggggggtgggaatgggtccagggaggtgtgcgtga

SEQ ID NO: 6802 - DNA, 37 bp, Artificial Sequence
  Synthetic oligonucleotide
gacacacgtgaagtgggagggtgatgttgggtgagga

SEQ ID NO: 6803 - DNA, 35 bp, Artificial Sequence
  Synthetic oligonucleotide
acacaccatttttgcgtaccaatccgactcctggg

SEQ ID NO: 6804 - DNA, 35 bp, Artificial Sequence
  Synthetic oligonucleotide
gtttagccgttgccttttcgtaccgttccttgcac

SEQ ID NO: 6805 - DNA, 35 bp, Artificial Sequence
  Synthetic oligonucleotide
gtgcatggacctgagtcactatttcgatctccctc

SEQ ID NO: 6806 - DNA, 36 bp, Artificial Sequence
  Synthetic oligonucleotide
atgtggggaggggacgggcggaagaagggggcggta

SEQ ID NO: 6807 - DNA, 35 bp, Artificial Sequence
  Synthetic oligonucleotide
acgacttgcctgcgtcatcctgttcctgtccgctc

SEQ ID NO: 6808 - DNA, 35 bp, Artificial Sequence
  Synthetic oligonucleotide
tactcatgtgagtgggtagtagtggggtgggagaa

SEQ ID NO: 6809 - DNA, 35 bp, Artificial Sequence
  Synthetic oligonucleotide
tgagtaaggtggaagggagattagagttagagcag

SEQ ID NO: 6810 - DNA, 35 bp, Artificial Sequence
  Synthetic oligonucleotide
gccaaagaaaggtgacggggaaggttcaaggcagt

SEQ ID NO: 6811 - DNA, 36 bp, Artificial Sequence
  Synthetic oligonucleotide
gtcaccctccacagcctgtccgtagcaccgctttca

SEQ ID NO: 6812 - DNA, 35 bp, Artificial Sequence
  Synthetic oligonucleotide
tccacacgggctagtgtccacggtctgccatctca

SEQ ID NO: 6813 - DNA, 36 bp, Artificial Sequence
  Synthetic oligonucleotide
ttcagtcggtccgactgacccccttacacactctca

SEQ ID NO: 6814 - DNA, 38 bp, Artificial Sequence
  Synthetic oligonucleotide
tacgagggagggacgggtacgaaggtgagggtaattga

SEQ ID NO: 6815 - DNA, 35 bp, Artificial Sequence
  Synthetic oligonucleotide
tgccattcgcatctcatgccctcccgaagcccact

SEQ ID NO: 6816 - DNA, 35 bp, Artificial Sequence
  Synthetic oligonucleotide
ttgccccgcctgacacctggaaaatctcacgatct

SEQ ID NO: 6817 - DNA, 37 bp, Artificial Sequence
  Synthetic oligonucleotide
attgtcgagggaggaggggtattggggtttggtaaga

SEQ ID NO: 6818 - DNA, 34 bp, Artificial Sequence
  Synthetic oligonucleotide
tgccatctcttaccttccgtaccacgccggcttt

SEQ ID NO: 6819 - DNA, 36 bp, Artificial Sequence
  Synthetic oligonucleotide
acctccactccgccaaacgcgcccttggtcgcataa

SEQ ID NO: 6820 - DNA, 36 bp, Artificial Sequence
  Synthetic oligonucleotide
ttcgcagatgcctacaacggcctccctccaccctta

SEQ ID NO: 6821 - DNA, 35 bp, Artificial Sequence
  Synthetic oligonucleotide
gtcctagcaggcgtttcttcagcctccacttccac

SEQ ID NO: 6822 - DNA, 34 bp, Artificial Sequence
  Synthetic oligonucleotide
tcatatgcagggtcacctctcgtcgcgtccctac

SEQ ID NO: 6823 - DNA, 36 bp, Artificial Sequence
  Synthetic oligonucleotide
tcacaacactctactggctaagccaccaggcacacc

SEQ ID NO: 6824 - DNA, 35 bp, Artificial Sequence
  Synthetic oligonucleotide
tccgccacccctaatacaaccgtaaccgcgaggtt

SEQ ID NO: 6825 - DNA, 36 bp, Artificial Sequence
  Synthetic oligonucleotide
tgcccaggccggtcgctcgagcccaccttctccgta

SEQ ID NO: 6826 - DNA, 35 bp, Artificial Sequence
  Synthetic oligonucleotide
gaacccatctttctgttgcaccgcctgctttcccc

SEQ ID NO: 6827 - DNA, 34 bp, Artificial Sequence
  Synthetic oligonucleotide
tcaaccttccgacgttccatcattgctcggggac

SEQ ID NO: 6828 - DNA, 35 bp, Artificial Sequence
  Synthetic oligonucleotide
gtcccgcacctacacattactcacgccatcgaatg

SEQ ID NO: 6829 - DNA, 35 bp, Artificial Sequence
  Synthetic oligonucleotide
tcgcaccgtgtacatcagtgcccgcctacatccct

SEQ ID NO: 6830 - DNA, 38 bp, Artificial Sequence
  Synthetic oligonucleotide
actccgcacccaacgtcgacccctatcctgcattatga

SEQ ID NO: 6831 - DNA, 37 bp, Artificial Sequence
  Synthetic oligonucleotide
ggccaccaccgatcaagttactccagccctcacctga

SEQ ID NO: 6832 - DNA, 35 bp, Artificial Sequence
  Synthetic oligonucleotide
gcgctacgttcaaatttaccacccccactacggtt

SEQ ID NO: 6833 - DNA, 36 bp, Artificial Sequence
  Synthetic oligonucleotide
acaccccaacctttcaactcagtacgagggaacgta

SEQ ID NO: 6834 - DNA, 38 bp, Artificial Sequence
  Synthetic oligonucleotide
gcatgtactgtcgcgctttctcagcaccatccccgtga

SEQ ID NO: 6835 - DNA, 37 bp, Artificial Sequence
  Synthetic oligonucleotide
atgcaccgccacctgccatcaagtttcttctttcgga

SEQ ID NO: 6836 - DNA, 36 bp, Artificial Sequence
  Synthetic oligonucleotide
tcttgcccaccccaactcctgtcaccttcggtcgta

SEQ ID NO: 6837 - DNA, 35 bp, Artificial Sequence
  Synthetic oligonucleotide
acatccgcattctgtagaatctacccttaccttcc

SEQ ID NO: 6838 - DNA, 37 bp, Artificial Sequence
  Synthetic oligonucleotide
acgacctacgcctgtatctcccttcccgtattggtga

SEQ ID NO: 6839 - DNA, 35 bp, Artificial Sequence
  Synthetic oligonucleotide
gacgatgccacagctcgctgctgtctcctcctcac

SEQ ID NO: 6840 - DNA, 35 bp, Artificial Sequence
  Synthetic oligonucleotide
tcgctccaacggccgcccctttccgttacctcagc

SEQ ID NO: 6841 - DNA, 35 bp, Artificial Sequence
  Synthetic oligonucleotide
tgcacccctgcgttcgggatacttatttttccttc

SEQ ID NO: 6842 - DNA, 35 bp, Artificial Sequence
  Synthetic oligonucleotide
gacggagcgccggtcggtcactgctcaaccctcct

SEQ ID NO: 6843 - DNA, 35 bp, Artificial Sequence
  Synthetic oligonucleotide
aacacatcacccctgctacgtgagtccatcctcaa

SEQ ID NO: 6844 - DNA, 36 bp, Artificial Sequence
  Synthetic oligonucleotide
attcgaacgcaatgcttatctcaaggccttcctcca

SEQ ID NO: 6845 - DNA, 36 bp, Artificial Sequence
  Synthetic oligonucleotide
ttcgccaccgagccctgacaacctcaccgccaccaa

SEQ ID NO: 6846 - DNA, 33 bp, Artificial Sequence
  Synthetic oligonucleotide
tcccaatccacgcccaccacgatccaggctaca

SEQ ID NO: 6847 - DNA, 35 bp, Artificial Sequence
  Synthetic oligonucleotide
actccccaccgcccgtgaaagacttcgtatcccca

SEQ ID NO: 6848 - DNA, 38 bp, Artificial Sequence
  Synthetic oligonucleotide
acacatggcactgacgtatcatctcctccttctgttga

SEQ ID NO: 6849 - DNA, 36 bp, Artificial Sequence
  Synthetic oligonucleotide
tccacagcccgctacccattttctctcgacgatcga

SEQ ID NO: 6850 - DNA, 35 bp, Artificial Sequence
  Synthetic oligonucleotide
attgacgtactgcctcccgtggactttctctggcc

SEQ ID NO: 6851 - DNA, 35 bp, Artificial Sequence
  Synthetic oligonucleotide
tccctcccagactcagttctggcttctggactatc

SEQ ID NO: 6852 - DNA, 35 bp, Artificial Sequence
  Synthetic oligonucleotide
ttagccacagtgtctcgccctcagtctacaaccac

SEQ ID NO: 6853 - DNA, 35 bp, Artificial Sequence
  Synthetic oligonucleotide
gactgccagtgaggatcattccacgcctccaatcc

SEQ ID NO: 6854 - DNA, 35 bp, Artificial Sequence
  Synthetic oligonucleotide
tcccggtccgagtcaatccgcgccctgacctcact

SEQ ID NO: 6855 - DNA, 35 bp, Artificial Sequence
  Synthetic oligonucleotide
tgtagccacaatcaaacctgccgccttatgcccct

SEQ ID NO: 6856 - DNA, 36 bp, Artificial Sequence
  Synthetic oligonucleotide
tcaagtggacagagggaggggtgggtcgccggggga

SEQ ID NO: 6857 - DNA, 36 bp, Artificial Sequence
  Synthetic oligonucleotide
taggcccctcgaattgcttcatacaacactctccaa

SEQ ID NO: 6858 - DNA, 37 bp, Artificial Sequence
  Synthetic oligonucleotide
ttcgcccatcacctggtcactcaagccctgaccctga

SEQ ID NO: 6859 - DNA, 37 bp, Artificial Sequence
  Synthetic oligonucleotide
actgcctcacctggcccgtatcactactctatgccga

SEQ ID NO: 6860 - DNA, 35 bp, Artificial Sequence
  Synthetic oligonucleotide
tccgatctcgcaactggacactcacgattcacctc

SEQ ID NO: 6861 - DNA, 38 bp, Artificial Sequence
  Synthetic oligonucleotide
gtactcacaccctgcgaatacaagaccctcctttttga

SEQ ID NO: 6862 - DNA, 37 bp, Artificial Sequence
  Synthetic oligonucleotide
acccccactcgcagcccgctacactacaccgcactga

SEQ ID NO: 6863 - DNA, 35 bp, Artificial Sequence
  Synthetic oligonucleotide
tgtacatccgtcccaccgcacgtattcccagttcc

SEQ ID NO: 6864 - DNA, 38 bp, Artificial Sequence
  Synthetic oligonucleotide
attgcaccccgcagcctgaacttggtactattttttga

SEQ ID NO: 6865 - DNA, 36 bp, Artificial Sequence
  Synthetic oligonucleotide
aactccacccgccgtacatccgccctcactcgtgaa

SEQ ID NO: 6866 - DNA, 35 bp, Artificial Sequence
  Synthetic oligonucleotide
tccccacctcacgtctcggctacctagatataccg

SEQ ID NO: 6867 - DNA, 36 bp, Artificial Sequence
  Synthetic oligonucleotide
tcataccgccaaattttcaccgggtgccattcctta

SEQ ID NO: 6868 - DNA, 35 bp, Artificial Sequence
  Synthetic oligonucleotide
gacatcactggacctttatttgccaatcttgccat

SEQ ID NO: 6869 - DNA, 35 bp, Artificial Sequence
  Synthetic oligonucleotide
agccgccccgctgacatatcccgctgttgttgccg

SEQ ID NO: 6870 - DNA, 36 bp, Artificial Sequence
  Synthetic oligonucleotide
accgccgtacgaaccggctgtgcgcccctcgttcca

SEQ ID NO: 6871 - DNA, 36 bp, Artificial Sequence
  Synthetic oligonucleotide
ttgcacactcacctctgtcctccatatgttcacagc

SEQ ID NO: 6872 - DNA, 36 bp, Artificial Sequence
  Synthetic oligonucleotide
tcacatccctgaccacgcctcctcacgtcgctggaa

SEQ ID NO: 6873 - DNA, 35 bp, Artificial Sequence
  Synthetic oligonucleotide
acatcaccggtcaggtggttcccttcaccccattg

SEQ ID NO: 6874 - DNA, 35 bp, Artificial Sequence
  Synthetic oligonucleotide
agtccccctccccaagtaccgggcatccacgtatc

SEQ ID NO: 6875 - DNA, 37 bp, Artificial Sequence
  Synthetic oligonucleotide
gcgtcacttcacttgggcctcctgttccttctttcga

SEQ ID NO: 6876 - DNA, 36 bp, Artificial Sequence
  Synthetic oligonucleotide
aacgtgcccgcagtcgcctattcactcgcacaccta

SEQ ID NO: 6877 - DNA, 35 bp, Artificial Sequence
  Synthetic oligonucleotide
ttcgcaaccccgccccctagccttcgtggaacatg

SEQ ID NO: 6878 - DNA, 35 bp, Artificial Sequence
  Synthetic oligonucleotide
acctcgccccctgtaagcttctcgccctacgcttg

SEQ ID NO: 6879 - DNA, 36 bp, Artificial Sequence
  Synthetic oligonucleotide
gaatgccaagtggacgggagggaatagggtgaggga

SEQ ID NO: 6880 - DNA, 35 bp, Artificial Sequence
  Synthetic oligonucleotide
tagaccgtccactgcgctccactttcacacgacgt

SEQ ID NO: 6881 - DNA, 36 bp, Artificial Sequence
  Synthetic oligonucleotide
tacgcatccaccctggtaccgaatctctctcccaga

SEQ ID NO: 6882 - DNA, 38 bp, Artificial Sequence
  Synthetic oligonucleotide
actgtcccccccttcctgcgcaagatagccacacttga

SEQ ID NO: 6883 - DNA, 35 bp, Artificial Sequence
  Synthetic oligonucleotide
tttgccgcagaggccagctatactctccgccccac

SEQ ID NO: 6884 - DNA, 35 bp, Artificial Sequence
  Synthetic oligonucleotide
gactctgacaacccatggcacaaccactgcccacg

SEQ ID NO: 6885 - DNA, 38 bp, Artificial Sequence
  Synthetic oligonucleotide
tcccccccccgtggcatcgcatttcgcctcacctttga

SEQ ID NO: 6886 - DNA, 34 bp, Artificial Sequence
  Synthetic oligonucleotide
aattgccacggtaccatctccgctccttgtagct

SEQ ID NO: 6887 - DNA, 37 bp, Artificial Sequence
  Synthetic oligonucleotide
aagtgagggcgagcggaggagggggtatgggggatga

SEQ ID NO: 6888 - DNA, 36 bp, Artificial Sequence
  Synthetic oligonucleotide
acccaagcttccgccgaccctcacatcacgcacgca

SEQ ID NO: 6889 - DNA, 36 bp, Artificial Sequence
  Synthetic oligonucleotide
gacgcaggggtggggctgggatggggcctcggatca

SEQ ID NO: 6890 - DNA, 35 bp, Artificial Sequence
  Synthetic oligonucleotide
tgtcgcaccgcgcaccttcgcccaggcattttccg

SEQ ID NO: 6891 - DNA, 35 bp, Artificial Sequence
  Synthetic oligonucleotide
tccaccacccactcgatgcgattcctttgctcact

SEQ ID NO: 6892 - DNA, 35 bp, Artificial Sequence
  Synthetic oligonucleotide
acgacccgtggcctcgttcctcctcgctcaatgtc

SEQ ID NO: 6893 - DNA, 33 bp, Artificial Sequence
  Synthetic oligonucleotide
actccccctcgtcgtccgtctacgtaatcgcgc

SEQ ID NO: 6894 - DNA, 34 bp, Artificial Sequence
  Synthetic oligonucleotide
atgccctgcccctgccctccttgtttaccctgtt

SEQ ID NO: 6895 - DNA, 36 bp, Artificial Sequence
  Synthetic oligonucleotide
agccaagcaggcacaccgccaagttttcccaccaca

SEQ ID NO: 6896 - DNA, 35 bp, Artificial Sequence
  Synthetic oligonucleotide
tgatgcttgccctggtcgcctgcctcctctgttcc

SEQ ID NO: 6897 - DNA, 35 bp, Artificial Sequence
  Synthetic oligonucleotide
tgtggccaaaaggtcgcttcatcctccctcttacg

SEQ ID NO: 6898 - DNA, 36 bp, Artificial Sequence
  Synthetic oligonucleotide
gacacttgccccatcttcatacgatttagtatgtca

SEQ ID NO: 6899 - DNA, 37 bp, Artificial Sequence
  Synthetic oligonucleotide
gaagggtgggcatgcgaaggggctcataacgtagaga

SEQ ID NO: 6900 - DNA, 36 bp, Artificial Sequence
  Synthetic oligonucleotide
tctccatccatcctgagtcctggaactagtaatcaa

SEQ ID NO: 6901 - DNA, 35 bp, Artificial Sequence
  Synthetic oligonucleotide
atccgcccaccacatcatagggtttcttattcgcc

SEQ ID NO: 6902 - DNA, 35 bp, Artificial Sequence
  Synthetic oligonucleotide
tgatccaccgggttatacatacgcctccctattgt

SEQ ID NO: 6903 - DNA, 35 bp, Artificial Sequence
  Synthetic oligonucleotide
gttcgctgttgccaacctgtattgttccttcccca

SEQ ID NO: 6904 - DNA, 35 bp, Artificial Sequence
  Synthetic oligonucleotide
tccacatcactgagcacgtgtgcttgcattcctgc

SEQ ID NO: 6905 - DNA, 36 bp, Artificial Sequence
  Synthetic oligonucleotide
gccacgcagtgggccgtgccatctttagtactatca

SEQ ID NO: 6906 - DNA, 33 bp, Artificial Sequence
  Synthetic oligonucleotide
gacctaccctgtgactcgccccgaaatacacgc

SEQ ID NO: 6907 - DNA, 35 bp, Artificial Sequence
  Synthetic oligonucleotide
tgattctgtcccaccagcctgggtttactcgccct

SEQ ID NO: 6908 - DNA, 37 bp, Artificial Sequence
  Synthetic oligonucleotide
gagcggggtggagggggaaggggcttctatgacgtga

SEQ ID NO: 6909 - DNA, 35 bp, Artificial Sequence
  Synthetic oligonucleotide
gcaccccgatcgctctatctggctcgttcttctta

SEQ ID NO: 6910 - DNA, 35 bp, Artificial Sequence
  Synthetic oligonucleotide
ggtgctccaccctgttatctctgcacgttctttca

SEQ ID NO: 6911 - DNA, 35 bp, Artificial Sequence
  Synthetic oligonucleotide
gattagctacgttgacgccccttatgtaccacctg

SEQ ID NO: 6912 - DNA, 36 bp, Artificial Sequence
  Synthetic oligonucleotide
accatctcgcgccacttattggttctcttggcccta

SEQ ID NO: 6913 - DNA, 37 bp, Artificial Sequence
  Synthetic oligonucleotide
gacatctcccacttctgccttacgttcgcttacgcga

SEQ ID NO: 6914 - DNA, 35 bp, Artificial Sequence
  Synthetic oligonucleotide
tcgccccacacccctcccactaccgtccattggat

SEQ ID NO: 6915 - DNA, 34 bp, Artificial Sequence
  Synthetic oligonucleotide
accgtgccacgccaacgcatttgcaaacatctct

SEQ ID NO: 6916 - DNA, 35 bp, Artificial Sequence
  Synthetic oligonucleotide
gccaccaacccaacgccgtacatgactgaagttaa

SEQ ID NO: 6917 - DNA, 36 bp, Artificial Sequence
  Synthetic oligonucleotide
tcgcgaagccgcctcgaaacctcccgtgaatcccta

SEQ ID NO: 6918 - DNA, 35 bp, Artificial Sequence
  Synthetic oligonucleotide
agaatacaacaactgcataggtaacgccctcgctc

SEQ ID NO: 6919 - DNA, 35 bp, Artificial Sequence
  Synthetic oligonucleotide
gtccaccaccccgccacagatcgtctccacggagt

SEQ ID NO: 6920 - DNA, 38 bp, Artificial Sequence
  Synthetic oligonucleotide
gcacgcccccttcatcatgggtattcccccccacttga

SEQ ID NO: 6921 - DNA, 38 bp, Artificial Sequence
  Synthetic oligonucleotide
tagcattgcccccgcccctaccacgatctgactggtga

SEQ ID NO: 6922 - DNA, 36 bp, Artificial Sequence
  Synthetic oligonucleotide
gcacacccactgcccaagtcttcccacagtctggta

SEQ ID NO: 6923 - DNA, 35 bp, Artificial Sequence
  Synthetic oligonucleotide
tgcactcactgagttgaccttgcattaaacccttt

SEQ ID NO: 6924 - DNA, 35 bp, Artificial Sequence
  Synthetic oligonucleotide
gtgaatccccttccgttttgctttccatgtgacgc

SEQ ID NO: 6925 - DNA, 37 bp, Artificial Sequence
  Synthetic oligonucleotide
actaggtgggaggggttgggcgggcacgctatcgcga

SEQ ID NO: 6926 - DNA, 37 bp, Artificial Sequence
  Synthetic oligonucleotide
acgctccctctccacactgtcaccgacccctgattga

SEQ ID NO: 6927 - DNA, 36 bp, Artificial Sequence
  Synthetic oligonucleotide
tagctcccctgtccgtgcaacgttgcccactactca

SEQ ID NO: 6928 - DNA, 36 bp, Artificial Sequence
  Synthetic oligonucleotide
gccttcccacccgttatcctgtagcttgggctaaca

SEQ ID NO: 6929 - DNA, 37 bp, Artificial Sequence
  Synthetic oligonucleotide
gacacactcgactgctctctagtagccattctctcga

SEQ ID NO: 6930 - DNA, 36 bp, Artificial Sequence
  Synthetic oligonucleotide
tacagtcccacatagccgtgccttatttaacttaca

SEQ ID NO: 6931 - DNA, 35 bp, Artificial Sequence
  Synthetic oligonucleotide
tgtgacaccctttcccggttatcttggactgactc

SEQ ID NO: 6932 - DNA, 35 bp, Artificial Sequence
  Synthetic oligonucleotide
tgtggtcgcttttcccttgggctacaacgcctttc

SEQ ID NO: 6933 - DNA, 35 bp, Artificial Sequence
  Synthetic oligonucleotide
tgtagccgccgcccgccgtttctcataccacacta

SEQ ID NO: 6934 - DNA, 35 bp, Artificial Sequence
  Synthetic oligonucleotide
gatgccgcgcacccagccacttggctcactacact

SEQ ID NO: 6935 - DNA, 35 bp, Artificial Sequence
  Synthetic oligonucleotide
agacaccctgcccgattgcctgctcccagccgctg

SEQ ID NO: 6936 - DNA, 35 bp, Artificial Sequence
  Synthetic oligonucleotide
atgagtccacccccctgttatccagcggacctccc

SEQ ID NO: 6937 - DNA, 35 bp, Artificial Sequence
  Synthetic oligonucleotide
gattgcccaatagtgctaatactcccttcgctgtc

SEQ ID NO: 6938 - DNA, 37 bp, Artificial Sequence
  Synthetic oligonucleotide
taggtgggtgggtgggggtttgacgtttcctggggga

SEQ ID NO: 6939 - DNA, 36 bp, Artificial Sequence
  Synthetic oligonucleotide
tgccgctgcccaacgcttcccgtcatattccatcga

SEQ ID NO: 6940 - DNA, 36 bp, Artificial Sequence
  Synthetic oligonucleotide
aacccgtaccgccctggtttttacattgtttctgga

SEQ ID NO: 6941 - DNA, 35 bp, Artificial Sequence
  Synthetic oligonucleotide
tccgccgttctaacctgtcgttcgcccggtccctc

SEQ ID NO: 6942 - DNA, 35 bp, Artificial Sequence
  Synthetic oligonucleotide
gttaccccgccttacgtactcctcgcactggaccc

SEQ ID NO: 6943 - DNA, 38 bp, Artificial Sequence
  Synthetic oligonucleotide
tgctcgtccacatctgccccctgcgacgcccgacctga

SEQ ID NO: 6944 - DNA, 35 bp, Artificial Sequence
  Synthetic oligonucleotide
tccctccggcctgcccttctttgcgtggcccactc

SEQ ID NO: 6945 - DNA, 37 bp, Artificial Sequence
  Synthetic oligonucleotide
tcacgccgtcgagctacacccttccccagcccctaga

SEQ ID NO: 6946 - DNA, 37 bp, Artificial Sequence
  Synthetic oligonucleotide
ttcgacccctgtgacctaattgctgctccccttccga

SEQ ID NO: 6947 - DNA, 35 bp, Artificial Sequence
  Synthetic oligonucleotide
taaggagcggcacatcaacccatgttcctgtccac

SEQ ID NO: 6948 - DNA, 36 bp, Artificial Sequence
  Synthetic oligonucleotide
tagaaagggtagaattggaaggggcaaagtaaagga

SEQ ID NO: 6949 - DNA, 36 bp, Artificial Sequence
  Synthetic oligonucleotide
aacgcgccaagttggtcccagccctttccgtcttca

SEQ ID NO: 6950 - DNA, 35 bp, Artificial Sequence
  Synthetic oligonucleotide
acgagcaccctacaccctcccgcacactactcttg

SEQ ID NO: 6951 - DNA, 36 bp, Artificial Sequence
  Synthetic oligonucleotide
atgcgccctcgtaaacggcttgttccttcttccaca

SEQ ID NO: 6952 - DNA, 38 bp, Artificial Sequence
  Synthetic oligonucleotide
ggacaccggtcactcccgcaccacaagacctccgctga

SEQ ID NO: 6953 - DNA, 36 bp, Artificial Sequence
  Synthetic oligonucleotide
accagactcaatgcatctccagccttctcacatgta

SEQ ID NO: 6954 - DNA, 35 bp, Artificial Sequence
  Synthetic oligonucleotide
tacgaaccacccagtgcgaacccgaccctaatttg

SEQ ID NO: 6955 - DNA, 38 bp, Artificial Sequence
  Synthetic oligonucleotide
aacaacacgagtgatacccgccgaacgctccaccttga

SEQ ID NO: 6956 - DNA, 37 bp, Artificial Sequence
  Synthetic oligonucleotide
ttacgcacgcctgactacccaccgactccctgtacga

SEQ ID NO: 6957 - DNA, 36 bp, Artificial Sequence
  Synthetic oligonucleotide
tcgaaacgtgccgatcagcgtctcaatctccgccga

SEQ ID NO: 6958 - DNA, 35 bp, Artificial Sequence
  Synthetic oligonucleotide
actcaccgcccgtcctacaccgcctgcctagctta

SEQ ID NO: 6959 - DNA, 35 bp, Artificial Sequence
  Synthetic oligonucleotide
gagaccccttccatgctttaggactgtccgtttgc

SEQ ID NO: 6960 - DNA, 35 bp, Artificial Sequence
  Synthetic oligonucleotide
tccgaccattgccggttccgtgttcgcaccatcac

SEQ ID NO: 6961 - DNA, 35 bp, Artificial Sequence
  Synthetic oligonucleotide
gttgcccacacttgcaatgtttaacgttctcattc

SEQ ID NO: 6962 - DNA, 37 bp, Artificial Sequence
  Synthetic oligonucleotide
tatcgaggcgggaagggcgggaaaggttctggggtga

SEQ ID NO: 6963 - DNA, 35 bp, Artificial Sequence
  Synthetic oligonucleotide
tccctcgcataccgttgttaccgcaaccacgcttt

SEQ ID NO: 6964 - DNA, 36 bp, Artificial Sequence
  Synthetic oligonucleotide
agtaaagtgaaggggtgggggacgagggcgagggta

SEQ ID NO: 6965 - DNA, 36 bp, Artificial Sequence
  Synthetic oligonucleotide
acatccgcacccctgcctaatccaagaatagagcta

SEQ ID NO: 6966 - DNA, 35 bp, Artificial Sequence
  Synthetic oligonucleotide
aagctgactccgcatgatacttcccgccccacact

SEQ ID NO: 6967 - DNA, 35 bp, Artificial Sequence
  Synthetic oligonucleotide
tagacaccctgtctagaactgtccttcaaccctcg

SEQ ID NO: 6968 - DNA, 35 bp, Artificial Sequence
  Synthetic oligonucleotide
ttgatgctctgccgtagcccctgaccgtttttccc

SEQ ID NO: 6969 - DNA, 35 bp, Artificial Sequence
  Synthetic oligonucleotide
gaccaggtacctgaaagccacggacactcttcatc

SEQ ID NO: 6970 - DNA, 34 bp, Artificial Sequence
  Synthetic oligonucleotide
agacctagtcagcacatccaaccgtccccgctgt

SEQ ID NO: 6971 - DNA, 35 bp, Artificial Sequence
  Synthetic oligonucleotide
gccctggttgggctcacactctgtttcgttacccc

SEQ ID NO: 6972 - DNA, 34 bp, Artificial Sequence
  Synthetic oligonucleotide
tacaccccccccactctcggagtgccgcgcatac

SEQ ID NO: 6973 - DNA, 35 bp, Artificial Sequence
  Synthetic oligonucleotide
gcgtgtagccttacatcgccccttgcaaccactgc

SEQ ID NO: 6974 - DNA, 35 bp, Artificial Sequence
  Synthetic oligonucleotide
agggccaccttgccgtttgtccttatagtcttgcc

SEQ ID NO: 6975 - DNA, 35 bp, Artificial Sequence
  Synthetic oligonucleotide
atgacgtgccagcacactttacgttgcccgttttc

SEQ ID NO: 6976 - DNA, 35 bp, Artificial Sequence
  Synthetic oligonucleotide
gtccaccacagcggtaaaacccttccttaactgcc

SEQ ID NO: 6977 - DNA, 35 bp, Artificial Sequence
  Synthetic oligonucleotide
gccatactgcgctaattgttcctcccgcccgcttc

SEQ ID NO: 6978 - DNA, 36 bp, Artificial Sequence
  Synthetic oligonucleotide
tccagatgcagcactaggttcgaccctcccatcacc

SEQ ID NO: 6979 - DNA, 37 bp, Artificial Sequence
  Synthetic oligonucleotide
tcctccccccgtcaccaggtctttgttctgatccaga

SEQ ID NO: 6980 - DNA, 35 bp, Artificial Sequence
  Synthetic oligonucleotide
gctaaacggtggaatggggggggcggggattggag

SEQ ID NO: 6981 - DNA, 35 bp, Artificial Sequence
  Synthetic oligonucleotide
atcccaccgccggttgaggtccccgtattacccgt

SEQ ID NO: 6982 - DNA, 35 bp, Artificial Sequence
  Synthetic oligonucleotide
tgttggcgcagtctcggttccacgctctccggtcc

SEQ ID NO: 6983 - DNA, 35 bp, Artificial Sequence
  Synthetic oligonucleotide
ttgcgtcgcccattggtatttctcccccgtcatct

SEQ ID NO: 6984 - DNA, 35 bp, Artificial Sequence
  Synthetic oligonucleotide
gtgctaactcagtccacccttcatagtaacccccg

SEQ ID NO: 6985 - DNA, 35 bp, Artificial Sequence
  Synthetic oligonucleotide
tctcccaatccgttgcgtaatccgactcgctctct

SEQ ID NO: 6986 - DNA, 35 bp, Artificial Sequence
  Synthetic oligonucleotide
gcctgattcccttctctatgtcgagctggtcacct

SEQ ID NO: 6987 - DNA, 37 bp, Artificial Sequence
  Synthetic oligonucleotide
tgcaaggcctgggtaggggggggtgaaaaacgggtga

SEQ ID NO: 6988 - DNA, 35 bp, Artificial Sequence
  Synthetic oligonucleotide
tgtcgaacgacaaatcagttaacttgccgctctct

SEQ ID NO: 6989 - DNA, 35 bp, Artificial Sequence
  Synthetic oligonucleotide
ttcaccccatccaatgataatgtcgttttctgcca

SEQ ID NO: 6990 - DNA, 35 bp, Artificial Sequence
  Synthetic oligonucleotide
tgcggtaggtcgtgggggaggtcggaacgggaagg

SEQ ID NO: 6991 - DNA, 36 bp, Artificial Sequence
  Synthetic oligonucleotide
tgcacgcaggacaccatctcacacaccctcggtaga

SEQ ID NO: 6992 - DNA, 35 bp, Artificial Sequence
  Synthetic oligonucleotide
tcactcgcctatttcttgctaccaccagctggaac

SEQ ID NO: 6993 - DNA, 35 bp, Artificial Sequence
  Synthetic oligonucleotide
gcatgcccgtgcgacgtttcttccttgtatcctgg

SEQ ID NO: 6994 - DNA, 35 bp, Artificial Sequence
  Synthetic oligonucleotide
tccacctgccacacgcgcgcaaacggacttgctga

SEQ ID NO: 6995 - DNA, 35 bp, Artificial Sequence
  Synthetic oligonucleotide
aatcctccgtccagcatacgacgctatttcctcgc

SEQ ID NO: 6996 - DNA, 35 bp, Artificial Sequence
  Synthetic oligonucleotide
tcagccgcccgcctcgtcactttttccttaggtcc

SEQ ID NO: 6997 - DNA, 35 bp, Artificial Sequence
  Synthetic oligonucleotide
catccgagccccatcctgatcgctgtcgagtttca

SEQ ID NO: 6998 - DNA, 36 bp, Artificial Sequence
  Synthetic oligonucleotide
accatctccacacgtggctttgttgcacctatcata

SEQ ID NO: 6999 - DNA, 36 bp, Artificial Sequence
  Synthetic oligonucleotide
tcatccccgtgcgagtttcattcgagcatttacata

SEQ ID NO: 7000 - DNA, 36 bp, Artificial Sequence
  Synthetic oligonucleotide
aagcatccccgttctatgcgccgccaccttgccata

SEQ ID NO: 7001 - DNA, 38 bp, Artificial Sequence
  Synthetic oligonucleotide
ttcgccacccccttcacccatgcgtctctgtacagtga

SEQ ID NO: 7002 - DNA, 35 bp, Artificial Sequence
  Synthetic oligonucleotide
ttccgcgcgcacagcaccgctaggacccccattgc

SEQ ID NO: 7003 - DNA, 35 bp, Artificial Sequence
  Synthetic oligonucleotide
ttgactcaccggctcgatctttcattctgttgatt

SEQ ID NO: 7004 - DNA, 35 bp, Artificial Sequence
  Synthetic oligonucleotide
gtaacccctccctttgggccctcacctcttccgag

SEQ ID NO: 7005 - DNA, 35 bp, Artificial Sequence
  Synthetic oligonucleotide
gatcaccgcctaaccgtccctccccgagtttttgt

SEQ ID NO: 7006 - DNA, 38 bp, Artificial Sequence
  Synthetic oligonucleotide
gtcccaatcagccacttccgcccaccagtcaatattga

SEQ ID NO: 7007 - DNA, 35 bp, Artificial Sequence
  Synthetic oligonucleotide
tatggtcagcccctgcatctttccggcccaggcct

SEQ ID NO: 7008 - DNA, 37 bp, Artificial Sequence
  Synthetic oligonucleotide
atgtgcgccaccggttactacatgctttcctttccga

SEQ ID NO: 7009 - DNA, 37 bp, Artificial Sequence
  Synthetic oligonucleotide
gatcctgtcgcacacccctctttatgctctggcctga

SEQ ID NO: 7010 - DNA, 36 bp, Artificial Sequence
  Synthetic oligonucleotide
ggggtggacgggtaaaagcacctccggtggagggga

SEQ ID NO: 7011 - DNA, 35 bp, Artificial Sequence
  Synthetic oligonucleotide
gacgcccgtgcttagcaattttggtcctgctgttc

SEQ ID NO: 7012 - DNA, 35 bp, Artificial Sequence
  Synthetic oligonucleotide
tagctcccccctattgattatgtcatggctcacct

SEQ ID NO: 7013 - DNA, 35 bp, Artificial Sequence
  Synthetic oligonucleotide
ttacccctcgcccgcgatcccgacggtcccgctcc

SEQ ID NO: 7014 - DNA, 35 bp, Artificial Sequence
  Synthetic oligonucleotide
gacgcaccctgtgactcattcgttaatatctaatc

SEQ ID NO: 7015 - DNA, 35 bp, Artificial Sequence
  Synthetic oligonucleotide
agtacgccccggtattacttcctctcatctaagtg

SEQ ID NO: 7016 - DNA, 36 bp, Artificial Sequence
  Synthetic oligonucleotide
tgcccccgccgctcccgacatcaccgtagcctacta

SEQ ID NO: 7017 - DNA, 35 bp, Artificial Sequence
  Synthetic oligonucleotide
atgggtggttagaaggggtagggcgggaggtgggg

SEQ ID NO: 7018 - DNA, 35 bp, Artificial Sequence
  Synthetic oligonucleotide
accagtggaggaggggtagaggcgggggttggaat

SEQ ID NO: 7019 - DNA, 37 bp, Artificial Sequence
  Synthetic oligonucleotide
tagccccaccgcctatccccgttctgaacagacttga

SEQ ID NO: 7020 - DNA, 35 bp, Artificial Sequence
  Synthetic oligonucleotide
ggttgccgcgagatctagtccacaccacaccacat

SEQ ID NO: 7021 - DNA, 35 bp, Artificial Sequence
  Synthetic oligonucleotide
agagccgcctggtctcacatacgggcaccccctcc

SEQ ID NO: 7022 - DNA, 35 bp, Artificial Sequence
  Synthetic oligonucleotide
gaagggaggtgtgtgggctggggggagacgttccg

SEQ ID NO: 7023 - DNA, 37 bp, Artificial Sequence
  Synthetic oligonucleotide
aacgcacccaccactaggcagccgcaaactccatcga

SEQ ID NO: 7024 - DNA, 35 bp, Artificial Sequence
  Synthetic oligonucleotide
gaatcgcacaacttcgctgtccgccctcctgaatt

SEQ ID NO: 7025 - DNA, 37 bp, Artificial Sequence
  Synthetic oligonucleotide
gtggagggaacaggcgtgggtgggatagggcaagcga

SEQ ID NO: 7026 - DNA, 36 bp, Artificial Sequence
  Synthetic oligonucleotide
atgcccacacagtcgttgccttaactttccctccta

SEQ ID NO: 7027 - DNA, 35 bp, Artificial Sequence
  Synthetic oligonucleotide
tcccaccccctgatcgtagacaatattcgaccgca

SEQ ID NO: 7028 - DNA, 35 bp, Artificial Sequence
  Synthetic oligonucleotide
atgctggaactatctgcactgactccctacctacg

SEQ ID NO: 7029 - DNA, 37 bp, Artificial Sequence
  Synthetic oligonucleotide
accgccccccacggactcgactttatgaaactgccga

SEQ ID NO: 7030 - DNA, 36 bp, Artificial Sequence
  Synthetic oligonucleotide
ttcacgctgcaatcacaacactccccctcgcggcga

SEQ ID NO: 7031 - DNA, 35 bp, Artificial Sequence
  Synthetic oligonucleotide
gggggacctggggaatgaaggggagggacgtgagg

SEQ ID NO: 7032 - DNA, 36 bp, Artificial Sequence
  Synthetic oligonucleotide
tacaatgcccacatctccatcttgcccgtacttgca

SEQ ID NO: 7033 - DNA, 37 bp, Artificial Sequence
  Synthetic oligonucleotide
tccagactcgcctggtatggctgcccttccatcctga

SEQ ID NO: 7034 - DNA, 35 bp, Artificial Sequence
  Synthetic oligonucleotide
acctcgcgacccaagccccggccggtaccttaacc

SEQ ID NO: 7035 - DNA, 35 bp, Artificial Sequence
  Synthetic oligonucleotide
ttatgcctcccgacgcacttgagcctttatacctc

SEQ ID NO: 7036 - DNA, 36 bp, Artificial Sequence
  Synthetic oligonucleotide
acaacgtagtacgtcgggtagggtgggtggcgggaa

SEQ ID NO: 7037 - DNA, 37 bp, Artificial Sequence
  Synthetic oligonucleotide
atcactgtccttgctcctgtccctttgtcctcgtgga

SEQ ID NO: 7038 - DNA, 35 bp, Artificial Sequence
  Synthetic oligonucleotide
taccagcaacactactatctctccgcatgccacgt

SEQ ID NO: 7039 - DNA, 35 bp, Artificial Sequence
  Synthetic oligonucleotide
tcgatgcacgctgtgtcgcacctgaccattccgct

SEQ ID NO: 7040 - DNA, 35 bp, Artificial Sequence
  Synthetic oligonucleotide
tccatcgcccgagctccagcggccctaactacgtc

SEQ ID NO: 7041 - DNA, 38 bp, Artificial Sequence
  Synthetic oligonucleotide
aacactcgcacattcctctatcacttgcccaggcttga

SEQ ID NO: 7042 - DNA, 34 bp, Artificial Sequence
  Synthetic oligonucleotide
gtggcccctccgcttacaccattttgacacacta

SEQ ID NO: 7043 - DNA, 35 bp, Artificial Sequence
  Synthetic oligonucleotide
gcatcacccagaccgtttcgcgtgggcacatacat

SEQ ID NO: 7044 - DNA, 35 bp, Artificial Sequence
  Synthetic oligonucleotide
tatccatccaccgtgaggcttatctaacttctgct

SEQ ID NO: 7045 - DNA, 36 bp, Artificial Sequence
  Synthetic oligonucleotide
gacgtgtctacgtccacgatccaacacatctcttga

SEQ ID NO: 7046 - DNA, 35 bp, Artificial Sequence
  Synthetic oligonucleotide
gggagtaacgcccgcctccaatgcccccctcagca

SEQ ID NO: 7047 - DNA, 35 bp, Artificial Sequence
  Synthetic oligonucleotide
ttaggagcccacccccgcatgtattcttggctact

SEQ ID NO: 7048 - DNA, 35 bp, Artificial Sequence
  Synthetic oligonucleotide
tcacgctgtaggtcacatatgcgccccaaccctgc

SEQ ID NO: 7049 - DNA, 35 bp, Artificial Sequence
  Synthetic oligonucleotide
acctgagccgcaccccccttgatattgaatcgcca

SEQ ID NO: 7050 - DNA, 35 bp, Artificial Sequence
  Synthetic oligonucleotide
tgcctgtgcctgggctccacaaacccgttaccatt

SEQ ID NO: 7051 - DNA, 35 bp, Artificial Sequence
  Synthetic oligonucleotide
tatcctccaccgctcgcatcccttaggacgtgcca

SEQ ID NO: 7052 - DNA, 36 bp, Artificial Sequence
  Synthetic oligonucleotide
gtgtgcatctgtccgcgcgcgtgcctcctgcctcca

SEQ ID NO: 7053 - DNA, 37 bp, Artificial Sequence
  Synthetic oligonucleotide
tcactccgctgtctcaggctccctgcccggtttttga

SEQ ID NO: 7054 - DNA, 35 bp, Artificial Sequence
  Synthetic oligonucleotide
tccacccgtaaccataatgttgcactcaggcccct

SEQ ID NO: 7055 - DNA, 35 bp, Artificial Sequence
  Synthetic oligonucleotide
tttgcgaccctgagcgcaccatactcttcccatct

SEQ ID NO: 7056 - DNA, 35 bp, Artificial Sequence
  Synthetic oligonucleotide
atctgcctccctcgttcgcgcgattgccaaaggct

SEQ ID NO: 7057 - DNA, 35 bp, Artificial Sequence
  Synthetic oligonucleotide
gcaaccatcgcggtcgactcgcattatctcttgga

SEQ ID NO: 7058 - DNA, 35 bp, Artificial Sequence
  Synthetic oligonucleotide
tcaccgactcggttgtcgtcgctcacaccccggtt

SEQ ID NO: 7059 - DNA, 35 bp, Artificial Sequence
  Synthetic oligonucleotide
gaccgaaccccatcccgcactgtcctgaccctatt

SEQ ID NO: 7060 - DNA, 38 bp, Artificial Sequence
  Synthetic oligonucleotide
atctccgccaccattgtctttctttagagtttcgctga

SEQ ID NO: 7061 - DNA, 36 bp, Artificial Sequence
  Synthetic oligonucleotide
gttgcccaactgttaactttcctcaccttacgtgga

SEQ ID NO: 7062 - DNA, 35 bp, Artificial Sequence
  Synthetic oligonucleotide
atttccgcccatcctccgctgactgctgtatcttg

SEQ ID NO: 7063 - DNA, 35 bp, Artificial Sequence
  Synthetic oligonucleotide
attcgcctgcgtagttcatcccccgagcctgcctt

SEQ ID NO: 7064 - DNA, 35 bp, Artificial Sequence
  Synthetic oligonucleotide
tagcgccgataccctttcctcacgccctgtacgtt

SEQ ID NO: 7065 - DNA, 38 bp, Artificial Sequence
  Synthetic oligonucleotide
gagtacccctcaatactgaataccctgcctgaacctga

SEQ ID NO: 7066 - DNA, 35 bp, Artificial Sequence
  Synthetic oligonucleotide
gtccacgaccctgcaccaggccactcctccacact

SEQ ID NO: 7067 - DNA, 36 bp, Artificial Sequence
  Synthetic oligonucleotide
gcctcgcccagtacttagctacacaccactcacgca

SEQ ID NO: 7068 - DNA, 35 bp, Artificial Sequence
  Synthetic oligonucleotide
gactacctacgcacctggtcatatacagctgctcc

SEQ ID NO: 7069 - DNA, 37 bp, Artificial Sequence
  Synthetic oligonucleotide
ttggccacctctcgttcttcccacctcccccagggga

SEQ ID NO: 7070 - DNA, 35 bp, Artificial Sequence
  Synthetic oligonucleotide
taggaatgggtggtggggggggagggaagacctac

SEQ ID NO: 7071 - DNA, 35 bp, Artificial Sequence
  Synthetic oligonucleotide
gtctgttccggcacttggtagtagccaaccaccct

SEQ ID NO: 7072 - DNA, 36 bp, Artificial Sequence
  Synthetic oligonucleotide
acctagcaggtacgcagacaccccccgaactgccca

SEQ ID NO: 7073 - DNA, 37 bp, Artificial Sequence
  Synthetic oligonucleotide
gaacagggtgaaggagaggaaggtcgggcgttgggga

SEQ ID NO: 7074 - DNA, 36 bp, Artificial Sequence
  Synthetic oligonucleotide
gacgcgcccacctgactctccactgctgctttgaaa

SEQ ID NO: 7075 - DNA, 35 bp, Artificial Sequence
  Synthetic oligonucleotide
gaacaccaacctcggagggcataacaccttccttg

SEQ ID NO: 7076 - DNA, 36 bp, Artificial Sequence
  Synthetic oligonucleotide
gcatgtcgccgccggtctgctagctattgtcctaca

SEQ ID NO: 7077 - DNA, 35 bp, Artificial Sequence
  Synthetic oligonucleotide
tccctgcacgacacggcatctgctcacaccgctcc

SEQ ID NO: 7078 - DNA, 35 bp, Artificial Sequence
  Synthetic oligonucleotide
acatgccggccgccttttcattgggctccttacct

SEQ ID NO: 7079 - DNA, 36 bp, Artificial Sequence
  Synthetic oligonucleotide
tagcatgccccttatgtcctcgcactacgcctttga

SEQ ID NO: 7080 - DNA, 35 bp, Artificial Sequence
  Synthetic oligonucleotide
acaccatacgcaatgaactggcccttcaatatctc

SEQ ID NO: 7081 - DNA, 35 bp, Artificial Sequence
  Synthetic oligonucleotide
tcacgccgcattcctgctgtccgctatccacttac

SEQ ID NO: 7082 - DNA, 35 bp, Artificial Sequence
  Synthetic oligonucleotide
tcatccatgccgtgttcctctagtaccaccctatg

SEQ ID NO: 7083 - DNA, 35 bp, Artificial Sequence
  Synthetic oligonucleotide
gtgatgcctgaagtggcggaaaaagggggggatga

SEQ ID NO: 7084 - DNA, 36 bp, Artificial Sequence
  Synthetic oligonucleotide
ctgcgccgcccaccatcaatcaacatcccggcgtga

SEQ ID NO: 7085 - DNA, 35 bp, Artificial Sequence
  Synthetic oligonucleotide
tggggccccgctcgctggtttggtgctcccctcta

SEQ ID NO: 7086 - DNA, 35 bp, Artificial Sequence
  Synthetic oligonucleotide
tatgcacccccgtttggctatctcgtttccgtgac

SEQ ID NO: 7087 - DNA, 35 bp, Artificial Sequence
  Synthetic oligonucleotide
ggaccacctaaccagtattgcccttttgaaatcct

SEQ ID NO: 7088 - DNA, 38 bp, Artificial Sequence
  Synthetic oligonucleotide
gagaacacctcccttgcgcacttttgagccaccattga

SEQ ID NO: 7089 - DNA, 35 bp, Artificial Sequence
  Synthetic oligonucleotide
tccgagccgccgggaagcggatcatcataatatgc

SEQ ID NO: 7090 - DNA, 35 bp, Artificial Sequence
  Synthetic oligonucleotide
aagcctcatcccatgctcatcttgaccgtatccct

SEQ ID NO: 7091 - DNA, 35 bp, Artificial Sequence
  Synthetic oligonucleotide
gatgactccccttgcaccgccccgtgtactctcga

SEQ ID NO: 7092 - DNA, 35 bp, Artificial Sequence
  Synthetic oligonucleotide
gaagagggggacgggggggattagagtgtgatata

SEQ ID NO: 7093 - DNA, 38 bp, Artificial Sequence
  Synthetic oligonucleotide
accacacccccccacgtgaagcaagtggtgacacttga

SEQ ID NO: 7094 - DNA, 35 bp, Artificial Sequence
  Synthetic oligonucleotide
tccgacaccctatacatcattagccacccgtattg

SEQ ID NO: 7095 - DNA, 38 bp, Artificial Sequence
  Synthetic oligonucleotide
taccctcaacctctgatctgcctcatattgccgcctga

SEQ ID NO: 7096 - DNA, 37 bp, Artificial Sequence
  Synthetic oligonucleotide
gcgaaaggggggggaaagaggtttaagtggcgattga

SEQ ID NO: 7097 - DNA, 35 bp, Artificial Sequence
  Synthetic oligonucleotide
cgcacacctcgatagttctcatgtcagggtaactt

SEQ ID NO: 7098 - DNA, 35 bp, Artificial Sequence
  Synthetic oligonucleotide
tgctaatgcttgactcctgtgctacctgttccgta

SEQ ID NO: 7099 - DNA, 35 bp, Artificial Sequence
  Synthetic oligonucleotide
gatgcccccctcagttagacgactgccctctttta

SEQ ID NO: 7100 - DNA, 35 bp, Artificial Sequence
  Synthetic oligonucleotide
acgcacctttcacgcccccccatatttgtgtccac

SEQ ID NO: 7101 - DNA, 35 bp, Artificial Sequence
  Synthetic oligonucleotide
tgccagcctccctgtcttctaaatgcccttcccgt

SEQ ID NO: 7102 - DNA, 37 bp, Artificial Sequence
  Synthetic oligonucleotide
tcaccgctacgtaattagttccccctgttgctccgga

SEQ ID NO: 7103 - DNA, 35 bp, Artificial Sequence
  Synthetic oligonucleotide
tgcctgcccttttggaaagccttctatgccccatc

SEQ ID NO: 7104 - DNA, 35 bp, Artificial Sequence
  Synthetic oligonucleotide
gtaacgcgagagcgagtcgtgggtggggtgggtgg

SEQ ID NO: 7105 - DNA, 36 bp, Artificial Sequence
  Synthetic oligonucleotide
gtaagccatcgcagcacttggccatttacccttgca

SEQ ID NO: 7106 - DNA, 36 bp, Artificial Sequence
  Synthetic oligonucleotide
gaggggggttgcatgaggaaagggatattgattgga

SEQ ID NO: 7107 - DNA, 35 bp, Artificial Sequence
  Synthetic oligonucleotide
acaatcctccaatggtcccttcgtgctgtctacct

SEQ ID NO: 7108 - DNA, 36 bp, Artificial Sequence
  Synthetic oligonucleotide
aagggaggtgggtggagtgaggaagcgcagggatca

SEQ ID NO: 7109 - DNA, 37 bp, Artificial Sequence
  Synthetic oligonucleotide
agatcaaccctgctttttaactgccatgactactgga

SEQ ID NO: 7110 - DNA, 38 bp, Artificial Sequence
  Synthetic oligonucleotide
aagcacggtcccaattgatttcgttgttccccctgtga

SEQ ID NO: 7111 - DNA, 37 bp, Artificial Sequence
  Synthetic oligonucleotide
tattgcccccgcatccgttgccccgacttctgttgga

SEQ ID NO: 7112 - DNA, 37 bp, Artificial Sequence
  Synthetic oligonucleotide
ttgccccccattgaactgtttgaataccacccgatga

SEQ ID NO: 7113 - DNA, 35 bp, Artificial Sequence
  Synthetic oligonucleotide
ggatcacgcgctcgacgctttacacctttatcacc

SEQ ID NO: 7114 - DNA, 35 bp, Artificial Sequence
  Synthetic oligonucleotide
gttgcctgcccacggtaattcgttgccacctgtac

SEQ ID NO: 7115 - DNA, 36 bp, Artificial Sequence
  Synthetic oligonucleotide
tgcattgccagctagtattccccgggccctatgtta

SEQ ID NO: 7116 - DNA, 38 bp, Artificial Sequence
  Synthetic oligonucleotide
tgacaccctcgccgctcgtttccagttttctttcatga

SEQ ID NO: 7117 - DNA, 34 bp, Artificial Sequence
  Synthetic oligonucleotide
tcagtcatcctctcgcacaccacgccacctgcgt

SEQ ID NO: 7118 - DNA, 35 bp, Artificial Sequence
  Synthetic oligonucleotide
aactcgtcctggccccaccccgcgcttgatcatga

SEQ ID NO: 7119 - DNA, 37 bp, Artificial Sequence
  Synthetic oligonucleotide
actcgcacacttgctcagtccgtaccgcccaccttga

SEQ ID NO: 7120 - DNA, 35 bp, Artificial Sequence
  Synthetic oligonucleotide
accatcacccaggtccgtcattttgccttatctca

SEQ ID NO: 7121 - DNA, 35 bp, Artificial Sequence
  Synthetic oligonucleotide
gtccaccgcctcccagtaacgatttttaggttctg

SEQ ID NO: 7122 - DNA, 37 bp, Artificial Sequence
  Synthetic oligonucleotide
tatgtcaccccggcattggtttcgctcgttctcagga

SEQ ID NO: 7123 - DNA, 35 bp, Artificial Sequence
  Synthetic oligonucleotide
tcaccacccgtactaccaacgccgcgctaaacgac

SEQ ID NO: 7124 - DNA, 35 bp, Artificial Sequence
  Synthetic oligonucleotide
tctcacccctcctttaaggcaaccggccatcgctc

SEQ ID NO: 7125 - DNA, 36 bp, Artificial Sequence
  Synthetic oligonucleotide
atctcaccgccggaccacgcactaagcccacggtta

SEQ ID NO: 7126 - DNA, 36 bp, Artificial Sequence
  Synthetic oligonucleotide
acctccctgcctccctccttattcgggacagagtga

SEQ ID NO: 7127 - DNA, 36 bp, Artificial Sequence
  Synthetic oligonucleotide
gacgccctcacacactgccttaggtttccgattgca

SEQ ID NO: 7128 - DNA, 35 bp, Artificial Sequence
  Synthetic oligonucleotide
tagaccccctcaagtctaccccatcgcaatcccag

SEQ ID NO: 7129 - DNA, 35 bp, Artificial Sequence
  Synthetic oligonucleotide
tagtccacatcgccgtgtggccccttttgtcattc

SEQ ID NO: 7130 - DNA, 35 bp, Artificial Sequence
  Synthetic oligonucleotide
ttcacggtcgcccccttatgcccgtccgatctatc

SEQ ID NO: 7131 - DNA, 35 bp, Artificial Sequence
  Synthetic oligonucleotide
atcaccccgcacattacgagtttcatgcccggttt

SEQ ID NO: 7132 - DNA, 35 bp, Artificial Sequence
  Synthetic oligonucleotide
gcacccatcaccagcactacccggcccctatgcta

SEQ ID NO: 7133 - DNA, 35 bp, Artificial Sequence
  Synthetic oligonucleotide
gcatacacccggccctaccacgaatcacggcccat

SEQ ID NO: 7134 - DNA, 35 bp, Artificial Sequence
  Synthetic oligonucleotide
gaagccgtcgaccctcacctcacatgcccgtactg

SEQ ID NO: 7135 - DNA, 38 bp, Artificial Sequence
  Synthetic oligonucleotide
acgaccacacgccgcaagtttctccgtccgttacatga

SEQ ID NO: 7136 - DNA, 35 bp, Artificial Sequence
  Synthetic oligonucleotide
gccataaagcacgggggggattgtgagggtggtgg

SEQ ID NO: 7137 - DNA, 37 bp, Artificial Sequence
  Synthetic oligonucleotide
gtctcccccaggtattgctatatgcctttcctactga

SEQ ID NO: 7138 - DNA, 37 bp, Artificial Sequence
  Synthetic oligonucleotide
aagtaccgcccaatgacctcccctcgtcctggtttga

SEQ ID NO: 7139 - DNA, 37 bp, Artificial Sequence
  Synthetic oligonucleotide
gtagccgctcaagtacacccacgattcaccatcctga

SEQ ID NO: 7140 - DNA, 35 bp, Artificial Sequence
  Synthetic oligonucleotide
acccacatccatccatgtcggtacgcaacactatc

SEQ ID NO: 7141 - DNA, 36 bp, Artificial Sequence
  Synthetic oligonucleotide
tccacccctcggggttacatactgcctttgctttga

SEQ ID NO: 7142 - DNA, 37 bp, Artificial Sequence
  Synthetic oligonucleotide
actcacccgcctggccctacgaattctggcctttcga

SEQ ID NO: 7143 - DNA, 35 bp, Artificial Sequence
  Synthetic oligonucleotide
tcacagtcctgaaactgcaatctcgtagcccattc

SEQ ID NO: 7144 - DNA, 35 bp, Artificial Sequence
  Synthetic oligonucleotide
gcccacgatcccccctgtttctattggtgtaactt

SEQ ID NO: 7145 - DNA, 38 bp, Artificial Sequence
  Synthetic oligonucleotide
tgcccactgcaggggtcgactttttttctgctccatga

SEQ ID NO: 7146 - DNA, 36 bp, Artificial Sequence
  Synthetic oligonucleotide
gtgagatcgcagggggggggcattggcggttgagga

SEQ ID NO: 7147 - DNA, 35 bp, Artificial Sequence
  Synthetic oligonucleotide
tagtggacatgggcggattgggcggggagaaggct

SEQ ID NO: 7148 - DNA, 35 bp, Artificial Sequence
  Synthetic oligonucleotide
ttttcaccccggacggtaagacctactactttctt

SEQ ID NO: 7149 - DNA, 35 bp, Artificial Sequence
  Synthetic oligonucleotide
tcgaacacccctcttttgcacgtcgccctttcccg

SEQ ID NO: 7150 - DNA, 36 bp, Artificial Sequence
  Synthetic oligonucleotide
gagccagaataaaggggggtaaaggtggtaagggga

SEQ ID NO: 7151 - DNA, 35 bp, Artificial Sequence
  Synthetic oligonucleotide
ttccgaacggtgcccagccattcccatacatgtct

SEQ ID NO: 7152 - DNA, 35 bp, Artificial Sequence
  Synthetic oligonucleotide
gtccactttcacccgccgatgggcaccatcccccc

SEQ ID NO: 7153 - DNA, 35 bp, Artificial Sequence
  Synthetic oligonucleotide
tgtggcacgacattgccatctcttccatcctatgt

SEQ ID NO: 7154 - DNA, 35 bp, Artificial Sequence
  Synthetic oligonucleotide
acgtcccgccttcacccatctcattcgccgcacga

SEQ ID NO: 7155 - DNA, 37 bp, Artificial Sequence
  Synthetic oligonucleotide
gggatgcaaaggggcatgggagggagggtccgatgga

SEQ ID NO: 7156 - DNA, 35 bp, Artificial Sequence
  Synthetic oligonucleotide
gtggatccaccgccccccaaaaatactgtccttgg

SEQ ID NO: 7157 - DNA, 35 bp, Artificial Sequence
  Synthetic oligonucleotide
gcgagacgaccgctgcctatcttttttattttgtt

SEQ ID NO: 7158 - DNA, 37 bp, Artificial Sequence
  Synthetic oligonucleotide
tagtcgtactggggaagggagggacaagcaggaggga

SEQ ID NO: 7159 - DNA, 35 bp, Artificial Sequence
  Synthetic oligonucleotide
tacgcctcaattgtcatgttacctactgcccgtcc

SEQ ID NO: 7160 - DNA, 35 bp, Artificial Sequence
  Synthetic oligonucleotide
tgtccactccatctcgctttgaacccgggaccgcc

SEQ ID NO: 7161 - DNA, 35 bp, Artificial Sequence
  Synthetic oligonucleotide
actctcgccgctccctaccgccacatcgcccgaag

SEQ ID NO: 7162 - DNA, 35 bp, Artificial Sequence
  Synthetic oligonucleotide
attcgcccccgacttctcagcatagccgacttcta

SEQ ID NO: 7163 - DNA, 35 bp, Artificial Sequence
  Synthetic oligonucleotide
tgctggtatggagggaaaaaacgcaaggggggaca

SEQ ID NO: 7164 - DNA, 38 bp, Artificial Sequence
  Synthetic oligonucleotide
tacgcatcagcagggtcattcctttccgccgcccctga

SEQ ID NO: 7165 - DNA, 37 bp, Artificial Sequence
  Synthetic oligonucleotide
taagccactccccacgcaacgtgctgtcattcaacga

SEQ ID NO: 7166 - DNA, 35 bp, Artificial Sequence
  Synthetic oligonucleotide
accacttgcgcgacatcgcctcccgaaccactctg

SEQ ID NO: 7167 - DNA, 36 bp, Artificial Sequence
  Synthetic oligonucleotide
gacagacacagccccctccaataggaagctctacca

SEQ ID NO: 7168 - DNA, 38 bp, Artificial Sequence
  Synthetic oligonucleotide
tccaccatcatacatcgcgcatgatacctggcccttga

SEQ ID NO: 7169 - DNA, 35 bp, Artificial Sequence
  Synthetic oligonucleotide
tatgacccccctatgacaagcgacctgaacacctc

SEQ ID NO: 7170 - DNA, 33 bp, Artificial Sequence
  Synthetic oligonucleotide
agttgcgcagtgtccgctacccatttgcccttc

SEQ ID NO: 7171 - DNA, 35 bp, Artificial Sequence
  Synthetic oligonucleotide
gcacacgccgacatccttttgcttctccgtggact

SEQ ID NO: 7172 - DNA, 35 bp, Artificial Sequence
  Synthetic oligonucleotide
tcccagcacaaataggtgccccgtcccccctaccg

SEQ ID NO: 7173 - DNA, 38 bp, Artificial Sequence
  Synthetic oligonucleotide
tgcacgacccgtcgtgctttaactcccatcatgtttga

SEQ ID NO: 7174 - DNA, 35 bp, Artificial Sequence
  Synthetic oligonucleotide
gtttgcatccctcgggcctttcctagtttgatctc

SEQ ID NO: 7175 - DNA, 35 bp, Artificial Sequence
  Synthetic oligonucleotide
tctcatccgcattttgtttcaccttacccgatctc

SEQ ID NO: 7176 - DNA, 36 bp, Artificial Sequence
  Synthetic oligonucleotide
aagccaccgcggggctggccttcccgaacatccata

SEQ ID NO: 7177 - DNA, 35 bp, Artificial Sequence
  Synthetic oligonucleotide
gctccctggatccgatcgttctactgcctttgcca

SEQ ID NO: 7178 - DNA, 36 bp, Artificial Sequence
  Synthetic oligonucleotide
acctatccgcccgccacgctcgatactatctaatga

SEQ ID NO: 7179 - DNA, 35 bp, Artificial Sequence
  Synthetic oligonucleotide
gaccacactaaccccccccttccgagacgcccagg

SEQ ID NO: 7180 - DNA, 35 bp, Artificial Sequence
  Synthetic oligonucleotide
gcaccttcccaccacgacttaagctcgccgttact

SEQ ID NO: 7181 - DNA, 35 bp, Artificial Sequence
  Synthetic oligonucleotide
actcggtggttcgtggcgacaacctcctgtacctt

SEQ ID NO: 7182 - DNA, 35 bp, Artificial Sequence
  Synthetic oligonucleotide
tacagcccaacatgcattattgcactacttgcctt

SEQ ID NO: 7183 - DNA, 37 bp, Artificial Sequence
  Synthetic oligonucleotide
acgtgcatccccgccagcgatctagtaccaccccaga

SEQ ID NO: 7184 - DNA, 35 bp, Artificial Sequence
  Synthetic oligonucleotide
accagcctcgcgttttcacccatcttggccctccg

SEQ ID NO: 7185 - DNA, 35 bp, Artificial Sequence
  Synthetic oligonucleotide
tgcatcccgagcgcttgttgcctgcccttttcgaa

SEQ ID NO: 7186 - DNA, 35 bp, Artificial Sequence
  Synthetic oligonucleotide
gactcttccgcccgaacacagtcttgttttcctgc

SEQ ID NO: 7187 - DNA, 35 bp, Artificial Sequence
  Synthetic oligonucleotide
gtgggacgggtggtgagagctcagggaggagcagg

SEQ ID NO: 7188 - DNA, 34 bp, Artificial Sequence
  Synthetic oligonucleotide
ttccatccagctgatctgcccgggtaaactccca

SEQ ID NO: 7189 - DNA, 35 bp, Artificial Sequence
  Synthetic oligonucleotide
gcgaaacttccccgcagcacttctgcatacccgcc

SEQ ID NO: 7190 - DNA, 36 bp, Artificial Sequence
  Synthetic oligonucleotide
tgatacgccactatacgcacgcccgaagacccgcca

SEQ ID NO: 7191 - DNA, 36 bp, Artificial Sequence
  Synthetic oligonucleotide
acaccaccacgtcgctatcactgagttccgtttgca

SEQ ID NO: 7192 - DNA, 33 bp, Artificial Sequence
  Synthetic oligonucleotide
agcccccccccgatctccgggttgccacttgcc

SEQ ID NO: 7193 - DNA, 38 bp, Artificial Sequence
  Synthetic oligonucleotide
gaccaagcgctagtctacctccgctcacgtccccttga

SEQ ID NO: 7194 - DNA, 35 bp, Artificial Sequence
  Synthetic oligonucleotide
actcctcgcgcaacactctataacgcaaacgcttc

SEQ ID NO: 7195 - DNA, 36 bp, Artificial Sequence
  Synthetic oligonucleotide
tgcctcctcgcacaccaccagccctacctacgtcgt

SEQ ID NO: 7196 - DNA, 38 bp, Artificial Sequence
  Synthetic oligonucleotide
attgggcccgcctatcgttccgacccctgttcccctga

SEQ ID NO: 7197 - DNA, 36 bp, Artificial Sequence
  Synthetic oligonucleotide
actggccccgccgagccgcccacttgcttaatccca

SEQ ID NO: 7198 - DNA, 35 bp, Artificial Sequence
  Synthetic oligonucleotide
gtacatccccagagatgtatatcgttcttttccac

SEQ ID NO: 7199 - DNA, 35 bp, Artificial Sequence
  Synthetic oligonucleotide
taccctcgcccggttaatccgcgatgtcctttgtc

SEQ ID NO: 7200 - DNA, 32 bp, Artificial Sequence
  Synthetic oligonucleotide
actcagtacggggtagggaaaagtgagggaag

SEQ ID NO: 7201 - DNA, 35 bp, Artificial Sequence
  Synthetic oligonucleotide
gccgatgcgcgtctggtcccatccctttgctccca

SEQ ID NO: 7202 - DNA, 37 bp, Artificial Sequence
  Synthetic oligonucleotide
tccgtaccgcacgactcgccccacccctcaagctgga

SEQ ID NO: 7203 - DNA, 35 bp, Artificial Sequence
  Synthetic oligonucleotide
aactcgcccgcaccctccctgcgcaggaactttta

SEQ ID NO: 7204 - DNA, 35 bp, Artificial Sequence
  Synthetic oligonucleotide
tgctgttccgtcccccagttgccttacgctcttgt

SEQ ID NO: 7205 - DNA, 35 bp, Artificial Sequence
  Synthetic oligonucleotide
taaacagcatagaagccctccgcctgcccgcaaca

SEQ ID NO: 7206 - DNA, 36 bp, Artificial Sequence
  Synthetic oligonucleotide
ttgtccaccgccattattagcaaacccccgtgtgca

SEQ ID NO: 7207 - DNA, 37 bp, Artificial Sequence
  Synthetic oligonucleotide
tcaaccagggggtaatgggaacatagggcgggtttga

SEQ ID NO: 7208 - DNA, 35 bp, Artificial Sequence
  Synthetic oligonucleotide
tgtccactcacctggcttagaatcatcacgcggtt

SEQ ID NO: 7209 - DNA, 36 bp, Artificial Sequence
  Synthetic oligonucleotide
gttcacagtcgcatgagttactgcttaccgccccca

SEQ ID NO: 7210 - DNA, 35 bp, Artificial Sequence
  Synthetic oligonucleotide
tacgccctttcacttgaagccgtttgaactcccaa

SEQ ID NO: 7211 - DNA, 38 bp, Artificial Sequence
  Synthetic oligonucleotide
gtctcgcccgacgcgccactttcccaatgcactcctga

SEQ ID NO: 7212 - DNA, 37 bp, Artificial Sequence
  Synthetic oligonucleotide
gccatgcaaacaggttatgacctttctccctccctga

SEQ ID NO: 7213 - DNA, 38 bp, Artificial Sequence
  Synthetic oligonucleotide
tgcggggggaagggtgagagggcgaaaaagggtagtga

SEQ ID NO: 7214 - DNA, 35 bp, Artificial Sequence
  Synthetic oligonucleotide
gaccatccatatgcgcttttcctaaccgtcctgcc

SEQ ID NO: 7215 - DNA, 35 bp, Artificial Sequence
  Synthetic oligonucleotide
gtgccgcatcgcaccggctacacagtacctacccc

SEQ ID NO: 7216 - DNA, 36 bp, Artificial Sequence
  Synthetic oligonucleotide
tgcactcaaacctgcaattgccgtcccctccattga

SEQ ID NO: 7217 - DNA, 37 bp, Artificial Sequence
  Synthetic oligonucleotide
gaacgcacgcttgtaacaccctgtcgccccctaagga

SEQ ID NO: 7218 - DNA, 35 bp, Artificial Sequence
  Synthetic oligonucleotide
aactgcccggacctgacacactcctttagctgacc

SEQ ID NO: 7219 - DNA, 36 bp, Artificial Sequence
  Synthetic oligonucleotide
accgccgaactacctttgggtatcatctcaccatca

SEQ ID NO: 7220 - DNA, 36 bp, Artificial Sequence
  Synthetic oligonucleotide
tacgccatccccacccagcatcgtgcctaggattta

SEQ ID NO: 7221 - DNA, 35 bp, Artificial Sequence
  Synthetic oligonucleotide
tcactggtccctatgtctatcgtttccccatcgcc

SEQ ID NO: 7222 - DNA, 35 bp, Artificial Sequence
  Synthetic oligonucleotide
ttcagcgcaccttctaccactatcggctatttgcg

SEQ ID NO: 7223 - DNA, 35 bp, Artificial Sequence
  Synthetic oligonucleotide
gacaccacgctttgattgcctacctgttcacatgt

SEQ ID NO: 7224 - DNA, 35 bp, Artificial Sequence
  Synthetic oligonucleotide
ggaacacatccgtaaatgaaactgaacaacccacg

SEQ ID NO: 7225 - DNA, 35 bp, Artificial Sequence
  Synthetic oligonucleotide
tgggatccgccttcccgttgctctaactaacttgc

SEQ ID NO: 7226 - DNA, 35 bp, Artificial Sequence
  Synthetic oligonucleotide
tccgtacccctccttggttttgcccgacttaaggt

SEQ ID NO: 7227 - DNA, 38 bp, Artificial Sequence
  Synthetic oligonucleotide
gccctcaccgccactgccttctcgatttcggacattga

SEQ ID NO: 7228 - DNA, 36 bp, Artificial Sequence
  Synthetic oligonucleotide
gctgccacggtgcaatccagtaccgttgttccacca

SEQ ID NO: 7229 - DNA, 38 bp, Artificial Sequence
  Synthetic oligonucleotide
tagcctgccgggagggtgggggaaaggggtaagtctga

SEQ ID NO: 7230 - DNA, 35 bp, Artificial Sequence
  Synthetic oligonucleotide
ccgctcccgctttattcgagttcatgaaactgtcc

SEQ ID NO: 7231 - DNA, 35 bp, Artificial Sequence
  Synthetic oligonucleotide
tacgcccatcatgactatcaccttcgcctcagacc

SEQ ID NO: 7232 - DNA, 35 bp, Artificial Sequence
  Synthetic oligonucleotide
tctaatccccatttggttcgagcctcgccttgctc

SEQ ID NO: 7233 - DNA, 35 bp, Artificial Sequence
  Synthetic oligonucleotide
gacactccctccgcaatggcgtttgtaccagccct

SEQ ID NO: 7234 - DNA, 36 bp, Artificial Sequence
  Synthetic oligonucleotide
gccccactccgcccggtcatttcttggtgcctgaaa

SEQ ID NO: 7235 - DNA, 35 bp, Artificial Sequence
  Synthetic oligonucleotide
atcacccccgggagtgcgccttccgaggattcctc

SEQ ID NO: 7236 - DNA, 35 bp, Artificial Sequence
  Synthetic oligonucleotide
acaccacccgccatacaaccgttagacgtttcgtt

SEQ ID NO: 7237 - DNA, 36 bp, Artificial Sequence
  Synthetic oligonucleotide
gtgtgagccactggccgatctatccttgtccattct

SEQ ID NO: 7238 - DNA, 35 bp, Artificial Sequence
  Synthetic oligonucleotide
gcgatccgccccaagctcttgttcacgaattccat

SEQ ID NO: 7239 - DNA, 35 bp, Artificial Sequence
  Synthetic oligonucleotide
gataatgagggagggaatggaccggtgataggacg

SEQ ID NO: 7240 - DNA, 36 bp, Artificial Sequence
  Synthetic oligonucleotide
tgccgagactcatcatgcacgtattccgtctcccca

SEQ ID NO: 7241 - DNA, 35 bp, Artificial Sequence
  Synthetic oligonucleotide
tgtccgcctcccctgtgccctgcgcctggcctcgc

SEQ ID NO: 7242 - DNA, 35 bp, Artificial Sequence
  Synthetic oligonucleotide
atttccacacgctcccgagccagtcacactccaac

SEQ ID NO: 7243 - DNA, 35 bp, Artificial Sequence
  Synthetic oligonucleotide
gactggcacaagtgtttgtcgcgtcactacacccc

SEQ ID NO: 7244 - DNA, 35 bp, Artificial Sequence
  Synthetic oligonucleotide
atgccccctacccatttgtaactcgcacccggtac

SEQ ID NO: 7245 - DNA, 35 bp, Artificial Sequence
  Synthetic oligonucleotide
tgcgtccccagacatcaccctgttccccggccctc

SEQ ID NO: 7246 - DNA, 35 bp, Artificial Sequence
  Synthetic oligonucleotide
gcaacctcctgccctgtaaccagtagccctacacg

SEQ ID NO: 7247 - DNA, 38 bp, Artificial Sequence
  Synthetic oligonucleotide
gacacgtgcctgaagccatcttataaccacctgcctga

SEQ ID NO: 7248 - DNA, 35 bp, Artificial Sequence
  Synthetic oligonucleotide
acccatcttcccaggttcacctcagcccccgtagg

SEQ ID NO: 7249 - DNA, 35 bp, Artificial Sequence
  Synthetic oligonucleotide
tcccatgcgcaggaacatcggctggctttcctcct

SEQ ID NO: 7250 - DNA, 35 bp, Artificial Sequence
  Synthetic oligonucleotide
gctccatgaagaacccccctgcccaatgttcagcc

SEQ ID NO: 7251 - DNA, 38 bp, Artificial Sequence
  Synthetic oligonucleotide
atccccccgtcagcccgccccccggtttcatgtactga

SEQ ID NO: 7252 - DNA, 36 bp, Artificial Sequence
  Synthetic oligonucleotide
gatcccacgcatgcccccgtagcactagcactacta

SEQ ID NO: 7253 - DNA, 37 bp, Artificial Sequence
  Synthetic oligonucleotide
gagcctccacactccctgccataacagtcctggttga

SEQ ID NO: 7254 - DNA, 35 bp, Artificial Sequence
  Synthetic oligonucleotide
ttgcgctccgcctcacttcatgattgaccattttt

SEQ ID NO: 7255 - DNA, 35 bp, Artificial Sequence
  Synthetic oligonucleotide
tcacatccgcggtttcacccacgccctcgcaacac

SEQ ID NO: 7256 - DNA, 35 bp, Artificial Sequence
  Synthetic oligonucleotide
ttccaccaccggtgtgagtgccgtaaccttacctt

SEQ ID NO: 7257 - DNA, 37 bp, Artificial Sequence
  Synthetic oligonucleotide
tcccgccactatactgccctgttttggaccttctgga

SEQ ID NO: 7258 - DNA, 37 bp, Artificial Sequence
  Synthetic oligonucleotide
ttacgggggttgtggacggcattttggggatggtgga

SEQ ID NO: 7259 - DNA, 35 bp, Artificial Sequence
  Synthetic oligonucleotide
gtccccattccaggcctttttacctacagctcttg

SEQ ID NO: 7260 - DNA, 35 bp, Artificial Sequence
  Synthetic oligonucleotide
tgagctgccacaacgcacttgactaccactcttcg

SEQ ID NO: 7261 - DNA, 35 bp, Artificial Sequence
  Synthetic oligonucleotide
atccctgcccgtgtttctccgtatgactgtcgtcc

SEQ ID NO: 7262 - DNA, 35 bp, Artificial Sequence
  Synthetic oligonucleotide
tcccactcccgatttcgagaacatcatcctgggtc

SEQ ID NO: 7263 - DNA, 35 bp, Artificial Sequence
  Synthetic oligonucleotide
tcagacacgccggtcgtcgtctcttacccgctact

SEQ ID NO: 7264 - DNA, 32 bp, Artificial Sequence
  Synthetic oligonucleotide
acgcgggtccgccgtcgttcccctgcccaatt

SEQ ID NO: 7265 - DNA, 35 bp, Artificial Sequence
  Synthetic oligonucleotide
attgccgtctgacctctgccctgctcgctcaattg

SEQ ID NO: 7266 - DNA, 36 bp, Artificial Sequence
  Synthetic oligonucleotide
acccgtgggggggagggaacgggaaattcatgcaca

SEQ ID NO: 7267 - DNA, 35 bp, Artificial Sequence
  Synthetic oligonucleotide
gattgcctcgtccaaagtcatcatcatccatgctc

SEQ ID NO: 7268 - DNA, 35 bp, Artificial Sequence
  Synthetic oligonucleotide
gtgacacggtccactgggtctggtcacttaacctt

SEQ ID NO: 7269 - DNA, 35 bp, Artificial Sequence
  Synthetic oligonucleotide
attctgctcagcactcccatcctcccgtttgccgc

SEQ ID NO: 7270 - DNA, 35 bp, Artificial Sequence
  Synthetic oligonucleotide
acctcagcatgacctgcctgtcaacatccttcatc

SEQ ID NO: 7271 - DNA, 35 bp, Artificial Sequence
  Synthetic oligonucleotide
gttgtcgcctaatatgtcctgctcacgttaacact

SEQ ID NO: 7272 - DNA, 35 bp, Artificial Sequence
  Synthetic oligonucleotide
gggcgatgagcccccatcgtaaccaccctggattc

SEQ ID NO: 7273 - DNA, 35 bp, Artificial Sequence
  Synthetic oligonucleotide
ttcgaccccgagggtaaaactagcacacctgccat

SEQ ID NO: 7274 - DNA, 38 bp, Artificial Sequence
  Synthetic oligonucleotide
ggggccgtacgggtgggcgaaaagggtggggcttatga

SEQ ID NO: 7275 - DNA, 36 bp, Artificial Sequence
  Synthetic oligonucleotide
gaggaaagggaaggaggagggaggcgatgacactta

SEQ ID NO: 7276 - DNA, 36 bp, Artificial Sequence
  Synthetic oligonucleotide
tccgaactagcgcactctaggacacatcacttccca

SEQ ID NO: 7277 - DNA, 36 bp, Artificial Sequence
  Synthetic oligonucleotide
gattggggaagggacctggtgaggggactggggaga

SEQ ID NO: 7278 - DNA, 35 bp, Artificial Sequence
  Synthetic oligonucleotide
tatcactacctgacgtctctcgagccccttgtacg

SEQ ID NO: 7279 - DNA, 35 bp, Artificial Sequence
  Synthetic oligonucleotide
tcacgtaccttgcgtcgtaatttctgtttctgttg

SEQ ID NO: 7280 - DNA, 35 bp, Artificial Sequence
  Synthetic oligonucleotide
aacgcgctactgctactgtctcaagctcttgcaac

SEQ ID NO: 7281 - DNA, 35 bp, Artificial Sequence
  Synthetic oligonucleotide
acgtgattcgacctgctgccccgttctgtccttcg

SEQ ID NO: 7282 - DNA, 35 bp, Artificial Sequence
  Synthetic oligonucleotide
tagtcaactcacatcgactgttcccaaaagccctc

SEQ ID NO: 7283 - DNA, 35 bp, Artificial Sequence
  Synthetic oligonucleotide
atccaccccggtcccaaagtttatcacacactctt

SEQ ID NO: 7284 - DNA, 35 bp, Artificial Sequence
  Synthetic oligonucleotide
gccgatcatctctacacatgtacgtggccattcct

SEQ ID NO: 7285 - DNA, 37 bp, Artificial Sequence
  Synthetic oligonucleotide
agacgcatcgagtcgtatccgcccttctgccacctga

SEQ ID NO: 7286 - DNA, 35 bp, Artificial Sequence
  Synthetic oligonucleotide
gtaccgtgcgtacaagtaatctagccacacacccc

SEQ ID NO: 7287 - DNA, 35 bp, Artificial Sequence
  Synthetic oligonucleotide
gcacaacggtagagagggaaggtaggataaaggtg

SEQ ID NO: 7288 - DNA, 36 bp, Artificial Sequence
  Synthetic oligonucleotide
tggacccctccaatcccttttaactggccgtagcta

SEQ ID NO: 7289 - DNA, 35 bp, Artificial Sequence
  Synthetic oligonucleotide
tcacgctctccacctggttcggttctatctcaact

SEQ ID NO: 7290 - DNA, 36 bp, Artificial Sequence
  Synthetic oligonucleotide
accactccctgttcctgtctatttagcgttccgcta

SEQ ID NO: 7291 - DNA, 35 bp, Artificial Sequence
  Synthetic oligonucleotide
gctgaaccacgacgtgaacccacctttgcacttcc

SEQ ID NO: 7292 - DNA, 36 bp, Artificial Sequence
  Synthetic oligonucleotide
atccaccccgctgttacgttcgcattcttattagta

SEQ ID NO: 7293 - DNA, 35 bp, Artificial Sequence
  Synthetic oligonucleotide
atgcccacacctgcgtccttgatttgcctttccgc

SEQ ID NO: 7294 - DNA, 35 bp, Artificial Sequence
  Synthetic oligonucleotide
tagttcggaccccccgccccatgctttcattactg

SEQ ID NO: 7295 - DNA, 35 bp, Artificial Sequence
  Synthetic oligonucleotide
tactccctgccgatcggtaatattatccctcttcc

SEQ ID NO: 7296 - DNA, 35 bp, Artificial Sequence
  Synthetic oligonucleotide
ttggttcccgcacttctacttttaatgcctgtcct

SEQ ID NO: 7297 - DNA, 35 bp, Artificial Sequence
  Synthetic oligonucleotide
gtcgatgcctccggtccccccttccagacacacaa

SEQ ID NO: 7298 - DNA, 36 bp, Artificial Sequence
  Synthetic oligonucleotide
acacgacacacgcgcttgacaaccctctcacttgta

SEQ ID NO: 7299 - DNA, 35 bp, Artificial Sequence
  Synthetic oligonucleotide
aaccttcacccgtgacttttgacgccgaactccat

SEQ ID NO: 7300 - DNA, 36 bp, Artificial Sequence
  Synthetic oligonucleotide
gcacacgcctcatcattttcttttcgtaccgggcta

SEQ ID NO: 7301 - DNA, 36 bp, Artificial Sequence
  Synthetic oligonucleotide
acaggggagggcagggagggacacttaacgacggta

SEQ ID NO: 7302 - DNA, 36 bp, Artificial Sequence
  Synthetic oligonucleotide
gccaaccgtcctgctcaagtcccgccatgctcacaa

SEQ ID NO: 7303 - DNA, 37 bp, Artificial Sequence
  Synthetic oligonucleotide
gtgtgcatccgaatgcacaacacgtactagttgggga

SEQ ID NO: 7304 - DNA, 37 bp, Artificial Sequence
  Synthetic oligonucleotide
gccgcctgccacaaaatcgtctacacacacagagtga

SEQ ID NO: 7305 - DNA, 37 bp, Artificial Sequence
  Synthetic oligonucleotide
acatccccgtggtctgaatccgatatctcctcgttga

SEQ ID NO: 7306 - DNA, 36 bp, Artificial Sequence
  Synthetic oligonucleotide
gtcgggggggagggaggaaagggggagaaggacaaa

SEQ ID NO: 7307 - DNA, 38 bp, Artificial Sequence
  Synthetic oligonucleotide
gtcaccgccctgcatacgtaccatggcccaccagctga

SEQ ID NO: 7308 - DNA, 35 bp, Artificial Sequence
  Synthetic oligonucleotide
aatggagtaagggaaggaaagtggccggcgtgtgg

SEQ ID NO: 7309 - DNA, 36 bp, Artificial Sequence
  Synthetic oligonucleotide
tagcacaccacatgataggggctcacgcattccaca

SEQ ID NO: 7310 - DNA, 36 bp, Artificial Sequence
  Synthetic oligonucleotide
acgcccacgtattctccggtcccagacccgccacca

SEQ ID NO: 7311 - DNA, 35 bp, Artificial Sequence
  Synthetic oligonucleotide
ttcgtcaccacaatgcttttgtcttccggccacca

SEQ ID NO: 7312 - DNA, 36 bp, Artificial Sequence
  Synthetic oligonucleotide
tagtgcgcgcacaccgtctcagcaatccgttccgca

SEQ ID NO: 7313 - DNA, 36 bp, Artificial Sequence
  Synthetic oligonucleotide
tccaccctgccccaccgttcctagatgaccctgtaa

SEQ ID NO: 7314 - DNA, 38 bp, Artificial Sequence
  Synthetic oligonucleotide
gaccacgcccattctaaccaatgtccagtaccccgtga

SEQ ID NO: 7315 - DNA, 35 bp, Artificial Sequence
  Synthetic oligonucleotide
gtcccacacccgccgtctatccccccctcggagga

SEQ ID NO: 7316 - DNA, 37 bp, Artificial Sequence
  Synthetic oligonucleotide
agactccatccggtgccgattacttcacgatcttcga

SEQ ID NO: 7317 - DNA, 35 bp, Artificial Sequence
  Synthetic oligonucleotide
ttgtgcccctaccctgcccctgggcccgtgccatc

SEQ ID NO: 7318 - DNA, 35 bp, Artificial Sequence
  Synthetic oligonucleotide
atccaacacaccttggtactagagtactatcactc

SEQ ID NO: 7319 - DNA, 36 bp, Artificial Sequence
  Synthetic oligonucleotide
tgcatgttcccatgtccaccatcttgatccccacga

SEQ ID NO: 7320 - DNA, 37 bp, Artificial Sequence
  Synthetic oligonucleotide
acgccaccctgctcttaccatccgtgacactgaacga

SEQ ID NO: 7321 - DNA, 35 bp, Artificial Sequence
  Synthetic oligonucleotide
acagccccctctgttctttaccactgcctcccacc

SEQ ID NO: 7322 - DNA, 36 bp, Artificial Sequence
  Synthetic oligonucleotide
aaggtaggtggagggggagggtggcaggcttcagca

SEQ ID NO: 7323 - DNA, 35 bp, Artificial Sequence
  Synthetic oligonucleotide
gccgaggtaggtggaggggggcttggaaggtggag

SEQ ID NO: 7324 - DNA, 38 bp, Artificial Sequence
  Synthetic oligonucleotide
gtacgctcccggcataactccatgtctcttcacactga

SEQ ID NO: 7325 - DNA, 37 bp, Artificial Sequence
  Synthetic oligonucleotide
atgcccccgacacatccgcctctatcatacgccttga

SEQ ID NO: 7326 - DNA, 35 bp, Artificial Sequence
  Synthetic oligonucleotide
tgagtgtcggtcagccttcacacatccctgcacca

SEQ ID NO: 7327 - DNA, 38 bp, Artificial Sequence
  Synthetic oligonucleotide
tgacacctccgacccttgcccagctcttcaataagtga

SEQ ID NO: 7328 - DNA, 35 bp, Artificial Sequence
  Synthetic oligonucleotide
tcactgttcccgacccacccaacagaccgtaatac

SEQ ID NO: 7329 - DNA, 35 bp, Artificial Sequence
  Synthetic oligonucleotide
acatgtctacctccctacctcgctcctgcctacgt

SEQ ID NO: 7330 - DNA, 38 bp, Artificial Sequence
  Synthetic oligonucleotide
aacatcctccatcgctaatgacggtactccttccctga

SEQ ID NO: 7331 - DNA, 36 bp, Artificial Sequence
  Synthetic oligonucleotide
acatgccgccctcctaggcacttacgagacctaaca

SEQ ID NO: 7332 - DNA, 37 bp, Artificial Sequence
  Synthetic oligonucleotide
tcacgcccagccttaggtcccggcatccaattctcga

SEQ ID NO: 7333 - DNA, 36 bp, Artificial Sequence
  Synthetic oligonucleotide
gtcacagaagggcaggaaggggaggaaaaagtagga

SEQ ID NO: 7334 - DNA, 35 bp, Artificial Sequence
  Synthetic oligonucleotide
tgtgcaaccaatttcgtcctgcccccgtctttaca

SEQ ID NO: 7335 - DNA, 35 bp, Artificial Sequence
  Synthetic oligonucleotide
ggacatccggtcccacctaatttgcctactgttcg

SEQ ID NO: 7336 - DNA, 35 bp, Artificial Sequence
  Synthetic oligonucleotide
tacgcctcgctctcatagtcgttcctacctgattc

SEQ ID NO: 7337 - DNA, 37 bp, Artificial Sequence
  Synthetic oligonucleotide
agggcgggtgagggtgggttgaataggcctcatcgga

SEQ ID NO: 7338 - DNA, 37 bp, Artificial Sequence
  Synthetic oligonucleotide
gccactccccgtaactaaatcgtcataagtctgtcga

SEQ ID NO: 7339 - DNA, 37 bp, Artificial Sequence
  Synthetic oligonucleotide
atcgacaccaccagcccccatacctgcaccatcacga

SEQ ID NO: 7340 - DNA, 35 bp, Artificial Sequence
  Synthetic oligonucleotide
atgcacacgaaatgcgctactccatccggtctatc

SEQ ID NO: 7341 - DNA, 35 bp, Artificial Sequence
  Synthetic oligonucleotide
ggtacggggtaaggggggggaggatcgtatggagg

SEQ ID NO: 7342 - DNA, 37 bp, Artificial Sequence
  Synthetic oligonucleotide
tgcaccgccatcatttatcctcccgtccttcccgaga

SEQ ID NO: 7343 - DNA, 36 bp, Artificial Sequence
  Synthetic oligonucleotide
tcccatccctgacctaacacgacgccatgcccataa

SEQ ID NO: 7344 - DNA, 35 bp, Artificial Sequence
  Synthetic oligonucleotide
tatacggcacaacgccctcctttcacgtaatcgtt

SEQ ID NO: 7345 - DNA, 35 bp, Artificial Sequence
  Synthetic oligonucleotide
tcgaaccgcactcgataatgcccctatgccctggt

SEQ ID NO: 7346 - DNA, 37 bp, Artificial Sequence
  Synthetic oligonucleotide
gaccacctcattatcttttagggctcctgttgcacga

SEQ ID NO: 7347 - DNA, 35 bp, Artificial Sequence
  Synthetic oligonucleotide
gcgacctaccgcccatctgatttttcacacgcccg

SEQ ID NO: 7348 - DNA, 35 bp, Artificial Sequence
  Synthetic oligonucleotide
acactgacccctcttacgtacaacatgctgaaaca

SEQ ID NO: 7349 - DNA, 35 bp, Artificial Sequence
  Synthetic oligonucleotide
tcagtattgccaccggtgttcgaatgcccatatcc

SEQ ID NO: 7350 - DNA, 35 bp, Artificial Sequence
  Synthetic oligonucleotide
agcccccgctgctgtatgcctcctcgtcccgcagt

SEQ ID NO: 7351 - DNA, 36 bp, Artificial Sequence
  Synthetic oligonucleotide
acacaagcccctccgcgcctgcccacacgctttaca

SEQ ID NO: 7352 - DNA, 38 bp, Artificial Sequence
  Synthetic oligonucleotide
tcgatcgccttgcctctgccgtttcctaccctccgtga

SEQ ID NO: 7353 - DNA, 36 bp, Artificial Sequence
  Synthetic oligonucleotide
tccgccactgcacatccttgtcctcgaaattctgca

SEQ ID NO: 7354 - DNA, 35 bp, Artificial Sequence
  Synthetic oligonucleotide
ttacatggacggtggagcagggagtcgggggctag

SEQ ID NO: 7355 - DNA, 35 bp, Artificial Sequence
  Synthetic oligonucleotide
ttccctcccgcgctctcattgtaccgatccccact

SEQ ID NO: 7356 - DNA, 36 bp, Artificial Sequence
  Synthetic oligonucleotide
ttactcggatcctgccctgtccatgttctccctcca

SEQ ID NO: 7357 - DNA, 36 bp, Artificial Sequence
  Synthetic oligonucleotide
atgtccgccccgattttgaaccccacctcgtgctca

SEQ ID NO: 7358 - DNA, 37 bp, Artificial Sequence
  Synthetic oligonucleotide
tcgcaccccaaacaaagccccagccgaccttgcccga

SEQ ID NO: 7359 - DNA, 38 bp, Artificial Sequence
  Synthetic oligonucleotide
gcacgactccgctttgtgcacacgccacacacccttga

SEQ ID NO: 7360 - DNA, 35 bp, Artificial Sequence
  Synthetic oligonucleotide
gacgtgcgttgttgcctcagcctccccgcatactt

SEQ ID NO: 7361 - DNA, 35 bp, Artificial Sequence
  Synthetic oligonucleotide
ccacggacgcttagagttcgttttttcggtctttc

SEQ ID NO: 7362 - DNA, 35 bp, Artificial Sequence
  Synthetic oligonucleotide
gcgtacgcaccggattccgaattgccactcgcccc

SEQ ID NO: 7363 - DNA, 35 bp, Artificial Sequence
  Synthetic oligonucleotide
aacacaggtcgttcctaattcatacttgcgctccc

SEQ ID NO: 7364 - DNA, 38 bp, Artificial Sequence
  Synthetic oligonucleotide
tccgaccactctgcattctattccgcgactgcccgtga

SEQ ID NO: 7365 - DNA, 36 bp, Artificial Sequence
  Synthetic oligonucleotide
agtgtacgccctgccaatgtcaccgtttccgcccta

SEQ ID NO: 7366 - DNA, 35 bp, Artificial Sequence
  Synthetic oligonucleotide
gtccaccaccccggccctttcacgttgttctccgg

SEQ ID NO: 7367 - DNA, 35 bp, Artificial Sequence
  Synthetic oligonucleotide
tcccgccccaagcttggaacccacccgtaaccttt

SEQ ID NO: 7368 - DNA, 35 bp, Artificial Sequence
  Synthetic oligonucleotide
gtttccgtctcagtgcacgctgctgcctttcatct

SEQ ID NO: 7369 - DNA, 35 bp, Artificial Sequence
  Synthetic oligonucleotide
ctgcctggatctgttgcttttcatactacctttgg

SEQ ID NO: 7370 - DNA, 35 bp, Artificial Sequence
  Synthetic oligonucleotide
gcaacctgtgatgtgatcgccgctttcctcccttc

SEQ ID NO: 7371 - DNA, 35 bp, Artificial Sequence
  Synthetic oligonucleotide
gcacaccggtacatggttcatcaatccttcacttg

SEQ ID NO: 7372 - DNA, 35 bp, Artificial Sequence
  Synthetic oligonucleotide
tctggcgccctgtctcgtttctactttgcatcctt

SEQ ID NO: 7373 - DNA, 35 bp, Artificial Sequence
  Synthetic oligonucleotide
gatgcggttaacgctggatgtcgcccaaccctttt

SEQ ID NO: 7374 - DNA, 37 bp, Artificial Sequence
  Synthetic oligonucleotide
tttcacctcccatcttattcgtctccgcctggcgaga

SEQ ID NO: 7375 - DNA, 35 bp, Artificial Sequence
  Synthetic oligonucleotide
atgtaccgcgcgtactgtgcctctctacgttcccg

SEQ ID NO: 7376 - DNA, 35 bp, Artificial Sequence
  Synthetic oligonucleotide
gtaccctcacgtattgtctaataccgcccccatga

SEQ ID NO: 7377 - DNA, 38 bp, Artificial Sequence
  Synthetic oligonucleotide
ggactccctccgatctatagcccccacacgacacttga

SEQ ID NO: 7378 - DNA, 35 bp, Artificial Sequence
  Synthetic oligonucleotide
tatgtgcgcgttctccatccgattactgcttttcc

SEQ ID NO: 7379 - DNA, 36 bp, Artificial Sequence
  Synthetic oligonucleotide
tcgcccactgttcggtctcgggcctttgtctcctca

SEQ ID NO: 7380 - DNA, 35 bp, Artificial Sequence
  Synthetic oligonucleotide
ttggccctccatcctgttagttgcttgatctatgt

SEQ ID NO: 7381 - DNA, 36 bp, Artificial Sequence
  Synthetic oligonucleotide
ttacctcgcccctcacactcccaccacagtgaccca

SEQ ID NO: 7382 - DNA, 35 bp, Artificial Sequence
  Synthetic oligonucleotide
ttagccacccgcgctccgcctttccggatcctgtc

SEQ ID NO: 7383 - DNA, 36 bp, Artificial Sequence
  Synthetic oligonucleotide
atcacacctactatcacgccttacagtacttgtgta

SEQ ID NO: 7384 - DNA, 36 bp, Artificial Sequence
  Synthetic oligonucleotide
atatccaccgcactcaacgtctgctggcccaagcca

SEQ ID NO: 7385 - DNA, 37 bp, Artificial Sequence
  Synthetic oligonucleotide
acagcaccccgccgcgccgtctgtttcttcatcctga

SEQ ID NO: 7386 - DNA, 35 bp, Artificial Sequence
  Synthetic oligonucleotide
gagcgccctcctcgcatactgtctttgacctcttt

SEQ ID NO: 7387 - DNA, 36 bp, Artificial Sequence
  Synthetic oligonucleotide
tacgcctgcatcctgaacctctctgcgaaatatcga

SEQ ID NO: 7388 - DNA, 37 bp, Artificial Sequence
  Synthetic oligonucleotide
acgggagggagggggggcgatggagagcgtgagatga

SEQ ID NO: 7389 - DNA, 35 bp, Artificial Sequence
  Synthetic oligonucleotide
gcccacatcggcctctacctaccacatccgctagt

SEQ ID NO: 7390 - DNA, 35 bp, Artificial Sequence
  Synthetic oligonucleotide
ttccgcctcatattgccccgtgcccggtctcttgt

SEQ ID NO: 7391 - DNA, 36 bp, Artificial Sequence
  Synthetic oligonucleotide
ggttggaagcagtatggggccgggaatagggtggaa

SEQ ID NO: 7392 - DNA, 38 bp, Artificial Sequence
  Synthetic oligonucleotide
tcagctccccgccaggcgctccccaccactgacattga

SEQ ID NO: 7393 - DNA, 35 bp, Artificial Sequence
  Synthetic oligonucleotide
gcggacaaaaagtaagggtgggaggggggactgtg

SEQ ID NO: 7394 - DNA, 35 bp, Artificial Sequence
  Synthetic oligonucleotide
tacgctactccacatgttgccaatcatcgttattc

SEQ ID NO: 7395 - DNA, 35 bp, Artificial Sequence
  Synthetic oligonucleotide
gactgcatccatagtaccttccttcgcgctctctg

SEQ ID NO: 7396 - DNA, 35 bp, Artificial Sequence
  Synthetic oligonucleotide
gcccttcatccacagacttgcaaggcccacaactc

SEQ ID NO: 7397 - DNA, 35 bp, Artificial Sequence
  Synthetic oligonucleotide
aacccaccccgggtcgatatttcctgttcgccgac

SEQ ID NO: 7398 - DNA, 35 bp, Artificial Sequence
  Synthetic oligonucleotide
tcatcaccacggatgacttcatacctgctaccggt

SEQ ID NO: 7399 - DNA, 37 bp, Artificial Sequence
  Synthetic oligonucleotide
tcgcaccgcctgcccacgctttgtgtcacctaaccga

SEQ ID NO: 7400 - DNA, 37 bp, Artificial Sequence
  Synthetic oligonucleotide
gaccaccgccaagtcttggcctcgattattcttttga

SEQ ID NO: 7401 - DNA, 35 bp, Artificial Sequence
  Synthetic oligonucleotide
agatcgtgcatcacgtaccgctatcaacttggtcc

SEQ ID NO: 7402 - DNA, 35 bp, Artificial Sequence
  Synthetic oligonucleotide
ggatgcctcgcacaccactcactgcctgggtttct

SEQ ID NO: 7403 - DNA, 35 bp, Artificial Sequence
  Synthetic oligonucleotide
tacttcactccccgcctgcctcctttagccgctgg

SEQ ID NO: 7404 - DNA, 36 bp, Artificial Sequence
  Synthetic oligonucleotide
gttcaactgcgctcttctgacgtactatcacccgaa

SEQ ID NO: 7405 - DNA, 36 bp, Artificial Sequence
  Synthetic oligonucleotide
tcacaccagctcgtacttctcattgcctccgtcgta

SEQ ID NO: 7406 - DNA, 37 bp, Artificial Sequence
  Synthetic oligonucleotide
accgcagtgacttcccgttgccctgattctgctccga

SEQ ID NO: 7407 - DNA, 35 bp, Artificial Sequence
  Synthetic oligonucleotide
taccatgccctgtccagcaaatccgccctctggtc

SEQ ID NO: 7408 - DNA, 35 bp, Artificial Sequence
  Synthetic oligonucleotide
tacatgacgtttgcctttccctcccgcgatagccg

SEQ ID NO: 7409 - DNA, 35 bp, Artificial Sequence
  Synthetic oligonucleotide
gcacaacgccgttgtcttggcaaccatatcacccc

SEQ ID NO: 7410 - DNA, 36 bp, Artificial Sequence
  Synthetic oligonucleotide
aacatgtgtggggtgaagggggaagcaggagtggta

SEQ ID NO: 7411 - DNA, 35 bp, Artificial Sequence
  Synthetic oligonucleotide
acccacctcgacgcgcggttacctcagtcctaact

SEQ ID NO: 7412 - DNA, 35 bp, Artificial Sequence
  Synthetic oligonucleotide
tatcaccatccgaggcactgactgtctacgttctt

SEQ ID NO: 7413 - DNA, 38 bp, Artificial Sequence
  Synthetic oligonucleotide
ggacgctagctctcaccgtgatccatccttccatgtga

SEQ ID NO: 7414 - DNA, 37 bp, Artificial Sequence
  Synthetic oligonucleotide
accacgcgccctccgtttaccgttcctatacccctga

SEQ ID NO: 7415 - DNA, 34 bp, Artificial Sequence
  Synthetic oligonucleotide
tccctcccgcgggtgccagctcctacccgatccc

SEQ ID NO: 7416 - DNA, 35 bp, Artificial Sequence
  Synthetic oligonucleotide
acctccgcaccccccggaccatcttcggcgttttt

SEQ ID NO: 7417 - DNA, 35 bp, Artificial Sequence
  Synthetic oligonucleotide
gtgtgcaggccagttcgctactacttcttcttctg

SEQ ID NO: 7418 - DNA, 37 bp, Artificial Sequence
  Synthetic oligonucleotide
gctaccccgtgctcctcccctgtcacgtttgacgtga

SEQ ID NO: 7419 - DNA, 37 bp, Artificial Sequence
  Synthetic oligonucleotide
tagcgcgagcacatcggccccattcaccccctctcga

SEQ ID NO: 7420 - DNA, 38 bp, Artificial Sequence
  Synthetic oligonucleotide
tcgcgaaccgcacatgtctccgtcgtcgctcatcctga

SEQ ID NO: 7421 - DNA, 35 bp, Artificial Sequence
  Synthetic oligonucleotide
cccccaacccccgatgcgtgttcttgcttcccatc

SEQ ID NO: 7422 - DNA, 37 bp, Artificial Sequence
  Synthetic oligonucleotide
tgtcacactccccatacactcagcgtcccgcgcgcga

SEQ ID NO: 7423 - DNA, 36 bp, Artificial Sequence
  Synthetic oligonucleotide
gcccatgccgggctcttctctgccaaacctcctgga

SEQ ID NO: 7424 - DNA, 31 bp, Artificial Sequence
  Synthetic oligonucleotide
gtggcccacacgccgcccaaatattccgaat

SEQ ID NO: 7425 - DNA, 38 bp, Artificial Sequence
  Synthetic oligonucleotide
tacctgaccgccgccatcgactgttcgtaccatcttga

SEQ ID NO: 7426 - DNA, 35 bp, Artificial Sequence
  Synthetic oligonucleotide
gccgacatttcgctctttctttgggtcatcctggg

SEQ ID NO: 7427 - DNA, 35 bp, Artificial Sequence
  Synthetic oligonucleotide
tcgccttccgccaccaggtcacccgtcaccagtct

SEQ ID NO: 7428 - DNA, 35 bp, Artificial Sequence
  Synthetic oligonucleotide
gcccctacatcacacgttatccacagtgacgaacc

SEQ ID NO: 7429 - DNA, 35 bp, Artificial Sequence
  Synthetic oligonucleotide
atggaccacttctcaatctgtttactcgtacctgt

SEQ ID NO: 7430 - DNA, 35 bp, Artificial Sequence
  Synthetic oligonucleotide
tccaccccgggggtgtcctatccagataacccgtt

SEQ ID NO: 7431 - DNA, 35 bp, Artificial Sequence
  Synthetic oligonucleotide
acgacgatctgccagcacccgaccactctcttgta

SEQ ID NO: 7432 - DNA, 35 bp, Artificial Sequence
  Synthetic oligonucleotide
gtccgtccgctggttaatattgccccttccacgtt

SEQ ID NO: 7433 - DNA, 35 bp, Artificial Sequence
  Synthetic oligonucleotide
gccccgacgcgcaccacctatccagactgccggac

SEQ ID NO: 7434 - DNA, 35 bp, Artificial Sequence
  Synthetic oligonucleotide
cagttgccatgagcggatactgcctcttcactgtc

SEQ ID NO: 7435 - DNA, 35 bp, Artificial Sequence
  Synthetic oligonucleotide
tcctccacccaccttcgcgtaacggatatctattg

SEQ ID NO: 7436 - DNA, 36 bp, Artificial Sequence
  Synthetic oligonucleotide
tccagccccacttggccccgccgactttgcgtgaca

SEQ ID NO: 7437 - DNA, 37 bp, Artificial Sequence
  Synthetic oligonucleotide
gcaccatagcgtcctcgctgcttttctgtttcctaga

SEQ ID NO: 7438 - DNA, 37 bp, Artificial Sequence
  Synthetic oligonucleotide
ttcgcccgccacatcttgccccgattcgctcatttga

SEQ ID NO: 7439 - DNA, 35 bp, Artificial Sequence
  Synthetic oligonucleotide
tacgcgtgcatccgcctgcttgctgtttccttcga

SEQ ID NO: 7440 - DNA, 35 bp, Artificial Sequence
  Synthetic oligonucleotide
ggacgcacctgctcacccctgtcttattacgttca

SEQ ID NO: 7441 - DNA, 35 bp, Artificial Sequence
  Synthetic oligonucleotide
aaccgacccctgacgttgtcataattctccccctg

SEQ ID NO: 7442 - DNA, 36 bp, Artificial Sequence
  Synthetic oligonucleotide
aagctgccatccatccgttgcgccgaagcctcttca

SEQ ID NO: 7443 - DNA, 37 bp, Artificial Sequence
  Synthetic oligonucleotide
gaccacgttcatcacctgtctctcacacgctcaccga

SEQ ID NO: 7444 - DNA, 35 bp, Artificial Sequence
  Synthetic oligonucleotide
gaggagcctctttccgccacccgccgaccacttga

SEQ ID NO: 7445 - DNA, 35 bp, Artificial Sequence
  Synthetic oligonucleotide
tacatgcgcactttcacacatcacaccgtgttcca

SEQ ID NO: 7446 - DNA, 36 bp, Artificial Sequence
  Synthetic oligonucleotide
atcaccgcctacagccctgtgccacttatcgctcga

SEQ ID NO: 7447 - DNA, 35 bp, Artificial Sequence
  Synthetic oligonucleotide
tacccccctgtctggtcgtcctcaactgtcatctc

SEQ ID NO: 7448 - DNA, 35 bp, Artificial Sequence
  Synthetic oligonucleotide
tcctgaccaccctccgttgtttactagcttcgtag

SEQ ID NO: 7449 - DNA, 35 bp, Artificial Sequence
  Synthetic oligonucleotide
tgcatgggagggttatgggggaggactgtgagccg

SEQ ID NO: 7450 - DNA, 35 bp, Artificial Sequence
  Synthetic oligonucleotide
tcaccaccacaatctcgtaatcacggacggagtaa

SEQ ID NO: 7451 - DNA, 35 bp, Artificial Sequence
  Synthetic oligonucleotide
tgcaatccatcccgcttacgtccttactgtcgctt

SEQ ID NO: 7452 - DNA, 38 bp, Artificial Sequence
  Synthetic oligonucleotide
gacacagtccgagagtgcctaccaccctgccttcttga

SEQ ID NO: 7453 - DNA, 35 bp, Artificial Sequence
  Synthetic oligonucleotide
ccattacgacgtcatcagccttacagttccagtct

SEQ ID NO: 7454 - DNA, 35 bp, Artificial Sequence
  Synthetic oligonucleotide
tcccacacccgcacgtagaggtcgcctcaacttcc

SEQ ID NO: 7455 - DNA, 35 bp, Artificial Sequence
  Synthetic oligonucleotide
aacacgtgtcgccttcaccctgataccatctgtgc

SEQ ID NO: 7456 - DNA, 35 bp, Artificial Sequence
  Synthetic oligonucleotide
gtccggccccacccggcctaatatggacctcattc

SEQ ID NO: 7457 - DNA, 35 bp, Artificial Sequence
  Synthetic oligonucleotide
acttccccctgccgtccccctgtctgagtctcact

SEQ ID NO: 7458 - DNA, 36 bp, Artificial Sequence
  Synthetic oligonucleotide
tctccgaccgctttctactgctacagctgacacaca

SEQ ID NO: 7459 - DNA, 35 bp, Artificial Sequence
  Synthetic oligonucleotide
atccgcgggagcatctggtcttaagcactcactgt

SEQ ID NO: 7460 - DNA, 36 bp, Artificial Sequence
  Synthetic oligonucleotide
acaccgcaagcacttgcattaacacagccctcatca

SEQ ID NO: 7461 - DNA, 37 bp, Artificial Sequence
  Synthetic oligonucleotide
gtgtagctgccgcctagaccccttactgccctcttga

SEQ ID NO: 7462 - DNA, 36 bp, Artificial Sequence
  Synthetic oligonucleotide
gttgcactcgccttccgcgcttctttggcctcaaca

SEQ ID NO: 7463 - DNA, 37 bp, Artificial Sequence
  Synthetic oligonucleotide
acgtccgacgcctttccatggtatctttgccctccga

SEQ ID NO: 7464 - DNA, 35 bp, Artificial Sequence
  Synthetic oligonucleotide
tccaagcgctgtagcttggtcccctcgccaccctt

SEQ ID NO: 7465 - DNA, 38 bp, Artificial Sequence
  Synthetic oligonucleotide
gccatcaacacatctcgtatcacacttatatcaactga

SEQ ID NO: 7466 - DNA, 36 bp, Artificial Sequence
  Synthetic oligonucleotide
gacaccctcgcttctttgcatattctcacctggtca

SEQ ID NO: 7467 - DNA, 34 bp, Artificial Sequence
  Synthetic oligonucleotide
tgtgcctagccccttatccccccccgactaatcc

SEQ ID NO: 7468 - DNA, 34 bp, Artificial Sequence
  Synthetic oligonucleotide
gcaatgcgcctgtatgccctgctaaacctgccct

SEQ ID NO: 7469 - DNA, 35 bp, Artificial Sequence
  Synthetic oligonucleotide
agtagcgcctcccctgttgttttatctcgcccaca

SEQ ID NO: 7470 - DNA, 35 bp, Artificial Sequence
  Synthetic oligonucleotide
cccatcgcgtgcctctgtttcgttgctaccaccca

SEQ ID NO: 7471 - DNA, 35 bp, Artificial Sequence
  Synthetic oligonucleotide
tctgcccctttcctcgcgacaatacagctgctccc

SEQ ID NO: 7472 - DNA, 36 bp, Artificial Sequence
  Synthetic oligonucleotide
tccaccctcccgtctacggaccccccgccccccgaa

SEQ ID NO: 7473 - DNA, 36 bp, Artificial Sequence
  Synthetic oligonucleotide
gcatacgcaccgaagcctcgcccttaccgttaaaca

SEQ ID NO: 7474 - DNA, 38 bp, Artificial Sequence
  Synthetic oligonucleotide
gactcgcgcaactttttacacgaccaaccgcctcctga

SEQ ID NO: 7475 - DNA, 36 bp, Artificial Sequence
  Synthetic oligonucleotide
tcccaccgccattgtccatcttcttctggggcctaa

SEQ ID NO: 7476 - DNA, 35 bp, Artificial Sequence
  Synthetic oligonucleotide
ttcagctccagacaaacaaactgcctcctcctcgt

SEQ ID NO: 7477 - DNA, 36 bp, Artificial Sequence
  Synthetic oligonucleotide
tataccgcccgagctgcaccgtcctccgttccgcca

SEQ ID NO: 7478 - DNA, 35 bp, Artificial Sequence
  Synthetic oligonucleotide
ttcgacccaccgagcgatatctctcgaccggaccc

SEQ ID NO: 7479 - DNA, 35 bp, Artificial Sequence
  Synthetic oligonucleotide
gcgagtgagggaagtaaggttggcgattgggaggt

SEQ ID NO: 7480 - DNA, 35 bp, Artificial Sequence
  Synthetic oligonucleotide
aaggaggggcgggaaaggtagattggcgtggggaa

SEQ ID NO: 7481 - DNA, 35 bp, Artificial Sequence
  Synthetic oligonucleotide
atccgcccatgacaaacagaccggcattattaccc

SEQ ID NO: 7482 - DNA, 35 bp, Artificial Sequence
  Synthetic oligonucleotide
acgcgccatctccgtctcgtcacacccctctctgc

SEQ ID NO: 7483 - DNA, 35 bp, Artificial Sequence
  Synthetic oligonucleotide
atgcaaagctccgttagacgctaagtctgttttgg

SEQ ID NO: 7484 - DNA, 35 bp, Artificial Sequence
  Synthetic oligonucleotide
gcaatccccctattgtaagctgttgggcccacccc

SEQ ID NO: 7485 - DNA, 35 bp, Artificial Sequence
  Synthetic oligonucleotide
tcccacactctcaccaccgcagtgcagtccctcgt

SEQ ID NO: 7486 - DNA, 38 bp, Artificial Sequence
  Synthetic oligonucleotide
atgcactctgatccgcttgatcctcctgtttcacttga

SEQ ID NO: 7487 - DNA, 35 bp, Artificial Sequence
  Synthetic oligonucleotide
tcctcgcaggccatttttcgacgctgcgccctgct

SEQ ID NO: 7488 - DNA, 35 bp, Artificial Sequence
  Synthetic oligonucleotide
ttgcaagatgcgcaccccctgtccattactcgccc

SEQ ID NO: 7489 - DNA, 35 bp, Artificial Sequence
  Synthetic oligonucleotide
tagacctctcgtgattcgattttgccacgtatatc

SEQ ID NO: 7490 - DNA, 35 bp, Artificial Sequence
  Synthetic oligonucleotide
tcgcacttcccgccttctcttccgcggtcatcgcc

SEQ ID NO: 7491 - DNA, 36 bp, Artificial Sequence
  Synthetic oligonucleotide
agatcacccagcctttctccacccaccaagtcgaca

SEQ ID NO: 7492 - DNA, 37 bp, Artificial Sequence
  Synthetic oligonucleotide
accactctgcctctgtctgtcaccttcatttcatcga

SEQ ID NO: 7493 - DNA, 35 bp, Artificial Sequence
  Synthetic oligonucleotide
aacgcccatgcaactcgacccacacactgcacgta

SEQ ID NO: 7494 - DNA, 38 bp, Artificial Sequence
  Synthetic oligonucleotide
tgacccaacctccacgcctgctcctgaacgcccgttga

SEQ ID NO: 7495 - DNA, 35 bp, Artificial Sequence
  Synthetic oligonucleotide
tcaccccattgtcacacacgcctggcaaactaagg

SEQ ID NO: 7496 - DNA, 35 bp, Artificial Sequence
  Synthetic oligonucleotide
tgtgaggccttacctctctgttttttgcacaaccc

SEQ ID NO: 7497 - DNA, 35 bp, Artificial Sequence
  Synthetic oligonucleotide
accccgcaaatgtggtctctgtcgccgtacttccg

SEQ ID NO: 7498 - DNA, 35 bp, Artificial Sequence
  Synthetic oligonucleotide
actagcagtgcccccctgccatgcgattgctttct

SEQ ID NO: 7499 - DNA, 35 bp, Artificial Sequence
  Synthetic oligonucleotide
atctctccgacgactcatgacacgtcctaccttgc

SEQ ID NO: 7500 - DNA, 36 bp, Artificial Sequence
  Synthetic oligonucleotide
gatggccacccccctagttgacagggccccccacca

SEQ ID NO: 7501 - DNA, 36 bp, Artificial Sequence
  Synthetic oligonucleotide
taccatcgggtacaaatggtccgggcctttcactta

SEQ ID NO: 7502 - DNA, 38 bp, Artificial Sequence
  Synthetic oligonucleotide
aaatccatctgccacatcggccaagaacacctcactga

SEQ ID NO: 7503 - DNA, 37 bp, Artificial Sequence
  Synthetic oligonucleotide
acactgccggtcgacgctctcatcctcctcgatacga

SEQ ID NO: 7504 - DNA, 35 bp, Artificial Sequence
  Synthetic oligonucleotide
tattgtcccatcaagcagtgcattccgcgtacctc

SEQ ID NO: 7505 - DNA, 35 bp, Artificial Sequence
  Synthetic oligonucleotide
tttgcccaaggcactgcacatttgttccccatgcg

SEQ ID NO: 7506 - DNA, 36 bp, Artificial Sequence
  Synthetic oligonucleotide
acccctagcccgggcgatatacccaggttcctacta

SEQ ID NO: 7507 - DNA, 34 bp, Artificial Sequence
  Synthetic oligonucleotide
gttgcagcccagccgctcgaccccaaacgccaca

SEQ ID NO: 7508 - DNA, 36 bp, Artificial Sequence
  Synthetic oligonucleotide
gggggatagctggggttttaagaattggggagggga

SEQ ID NO: 7509 - DNA, 37 bp, Artificial Sequence
  Synthetic oligonucleotide
gacccgccccactgttccattatggccattatgacga

SEQ ID NO: 7510 - DNA, 35 bp, Artificial Sequence
  Synthetic oligonucleotide
agccaccgcatccctgtcactcccgtaactctcga

SEQ ID NO: 7511 - DNA, 35 bp, Artificial Sequence
  Synthetic oligonucleotide
ttgtccccggcgcctacctacgacacggctttttc

SEQ ID NO: 7512 - DNA, 36 bp, Artificial Sequence
  Synthetic oligonucleotide
taccatccccgtgcgttggtattatccctcctctca

SEQ ID NO: 7513 - DNA, 35 bp, Artificial Sequence
  Synthetic oligonucleotide
gcaaaggagggcatggaggggtgggagggctcgtg

SEQ ID NO: 7514 - DNA, 35 bp, Artificial Sequence
  Synthetic oligonucleotide
ggacgctggcaggggggacggagggatgggtggat

SEQ ID NO: 7515 - DNA, 37 bp, Artificial Sequence
  Synthetic oligonucleotide
acgttgtggcggtgcctatatccactccttctcttga

SEQ ID NO: 7516 - DNA, 37 bp, Artificial Sequence
  Synthetic oligonucleotide
tccacggtcaagcattgcatcaccgcaacactctcga

SEQ ID NO: 7517 - DNA, 35 bp, Artificial Sequence
  Synthetic oligonucleotide
gactcgatcgctgccgccgggggcccgactcctct

SEQ ID NO: 7518 - DNA, 36 bp, Artificial Sequence
  Synthetic oligonucleotide
gacgaagagggggaggggatagtagtgaaggacgaa

SEQ ID NO: 7519 - DNA, 35 bp, Artificial Sequence
  Synthetic oligonucleotide
tgactggccctggcatcgtttcgacccaccatacc

SEQ ID NO: 7520 - DNA, 35 bp, Artificial Sequence
  Synthetic oligonucleotide
attgcccctcccacactacagcacgacgcttgtga

SEQ ID NO: 7521 - DNA, 35 bp, Artificial Sequence
  Synthetic oligonucleotide
tccaccgcgaaatctctagatacacactctccccg

SEQ ID NO: 7522 - DNA, 38 bp, Artificial Sequence
  Synthetic oligonucleotide
gtcgagaggggagggatagtaccgggttagtggtgtga

SEQ ID NO: 7523 - DNA, 36 bp, Artificial Sequence
  Synthetic oligonucleotide
agccaccacatcgatcgctggttcgcctcttccgta

SEQ ID NO: 7524 - DNA, 37 bp, Artificial Sequence
  Synthetic oligonucleotide
ccgcccgacccaacggtaacacgcgacttgcttgcga

SEQ ID NO: 7525 - DNA, 36 bp, Artificial Sequence
  Synthetic oligonucleotide
tcaggccactgacgttgcttgaaccactctctttaa

SEQ ID NO: 7526 - DNA, 35 bp, Artificial Sequence
  Synthetic oligonucleotide
tacacctcacgcaagcacgaccggcgtaaacccca

SEQ ID NO: 7527 - DNA, 35 bp, Artificial Sequence
  Synthetic oligonucleotide
tatggacgcggacgagggaaggttcggaacgggag

SEQ ID NO: 7528 - DNA, 35 bp, Artificial Sequence
  Synthetic oligonucleotide
gttgcaacatgtagctgtcgtcaccccacttcgcc

SEQ ID NO: 7529 - DNA, 37 bp, Artificial Sequence
  Synthetic oligonucleotide
accgaccccactggttgtcttagatcttgccttttga

SEQ ID NO: 7530 - DNA, 36 bp, Artificial Sequence
  Synthetic oligonucleotide
gacccagctgtcggtcgccgccaacgtcctctagca

SEQ ID NO: 7531 - DNA, 35 bp, Artificial Sequence
  Synthetic oligonucleotide
gtcccaccccggtgatctgagaatccttcgccacc

SEQ ID NO: 7532 - DNA, 35 bp, Artificial Sequence
  Synthetic oligonucleotide
atccgcgcccgttccccaggtcgtccctacttctc

SEQ ID NO: 7533 - DNA, 35 bp, Artificial Sequence
  Synthetic oligonucleotide
tacatccaatcatccgtgtctgcgttttcattcgc

SEQ ID NO: 7534 - DNA, 35 bp, Artificial Sequence
  Synthetic oligonucleotide
tctccacgcacccatctcagcctaagttcaactca

SEQ ID NO: 7535 - DNA, 36 bp, Artificial Sequence
  Synthetic oligonucleotide
atcgcaccccgcaacagcgtttgttttatctcgtca

SEQ ID NO: 7536 - DNA, 35 bp, Artificial Sequence
  Synthetic oligonucleotide
tacacaccgccccttaatggcaattaacactcaac

SEQ ID NO: 7537 - DNA, 36 bp, Artificial Sequence
  Synthetic oligonucleotide
acctgcgccgccacgggtgcacccggctctttccca

SEQ ID NO: 7538 - DNA, 35 bp, Artificial Sequence
  Synthetic oligonucleotide
tttgacgcctcccttttctaatgcagtgcctttac

SEQ ID NO: 7539 - DNA, 34 bp, Artificial Sequence
  Synthetic oligonucleotide
ggacgcacgccgcgataaactgcacacacgcata

SEQ ID NO: 7540 - DNA, 35 bp, Artificial Sequence
  Synthetic oligonucleotide
tacgctgtatccgccatgtcagtaggccgcccttc

SEQ ID NO: 7541 - DNA, 35 bp, Artificial Sequence
  Synthetic oligonucleotide
tctcaatgcccgaattgtcgccttacggtaccact

SEQ ID NO: 7542 - DNA, 35 bp, Artificial Sequence
  Synthetic oligonucleotide
tctgccaagtcccgacccgcaccatgttctctgct

SEQ ID NO: 7543 - DNA, 35 bp, Artificial Sequence
  Synthetic oligonucleotide
tctatgcccccgcctgcctatactcctgcacccgc

SEQ ID NO: 7544 - DNA, 35 bp, Artificial Sequence
  Synthetic oligonucleotide
atcaatgcccccgcccagaagccctaccacggtac

SEQ ID NO: 7545 - DNA, 35 bp, Artificial Sequence
  Synthetic oligonucleotide
tcccgcccgcgcatctccgttccagctgcaattga

SEQ ID NO: 7546 - DNA, 36 bp, Artificial Sequence
  Synthetic oligonucleotide
tactgtcgtacggaaagttatggggaggggaagtca

SEQ ID NO: 7547 - DNA, 35 bp, Artificial Sequence
  Synthetic oligonucleotide
tctctcgagccccccgcgcgcactcgctccccttt

SEQ ID NO: 7548 - DNA, 36 bp, Artificial Sequence
  Synthetic oligonucleotide
gtgccaccaccaaggtctctgaccgcttcccaccga

SEQ ID NO: 7549 - DNA, 38 bp, Artificial Sequence
  Synthetic oligonucleotide
accgagggtggggtaacagcgggggtaaatggggttga

SEQ ID NO: 7550 - DNA, 35 bp, Artificial Sequence
  Synthetic oligonucleotide
gagcatcccccgctgtttgcatcgcccttatacac

SEQ ID NO: 7551 - DNA, 38 bp, Artificial Sequence
  Synthetic oligonucleotide
tccatcggccactggctatgcacctacccttgaactga

SEQ ID NO: 7552 - DNA, 34 bp, Artificial Sequence
  Synthetic oligonucleotide
tcccccccggcatgaaccccttgattacgttgta

SEQ ID NO: 7553 - DNA, 35 bp, Artificial Sequence
  Synthetic oligonucleotide
aacacgcccccgtgggttgccaccaatgagcactc

SEQ ID NO: 7554 - DNA, 35 bp, Artificial Sequence
  Synthetic oligonucleotide
gcctacccgcccaaatcctggtattcttaatcctg

SEQ ID NO: 7555 - DNA, 36 bp, Artificial Sequence
  Synthetic oligonucleotide
tcatgtcaactggttgccatgcaccaccctttccca

SEQ ID NO: 7556 - DNA, 35 bp, Artificial Sequence
  Synthetic oligonucleotide
ccgcagttccatttctactatcgcctgtgagcctc

SEQ ID NO: 7557 - DNA, 36 bp, Artificial Sequence
  Synthetic oligonucleotide
tcacacgctcgttacatacatgtttcaccgtcccca

SEQ ID NO: 7558 - DNA, 35 bp, Artificial Sequence
  Synthetic oligonucleotide
actacgtctcccctgcccatctgaatttatagcct

SEQ ID NO: 7559 - DNA, 36 bp, Artificial Sequence
  Synthetic oligonucleotide
atgtccgcatctgacttcccccaccctcgcgcgaca

SEQ ID NO: 7560 - DNA, 37 bp, Artificial Sequence
  Synthetic oligonucleotide
gatgcgggtccacattctcctctccgacccctcctga

SEQ ID NO: 7561 - DNA, 35 bp, Artificial Sequence
  Synthetic oligonucleotide
gcaaccccattcgtccttacgcgcagtccatattc

SEQ ID NO: 7562 - DNA, 38 bp, Artificial Sequence
  Synthetic oligonucleotide
tccacaaccccgtcgcacgtccccccccaccgggttga

SEQ ID NO: 7563 - DNA, 35 bp, Artificial Sequence
  Synthetic oligonucleotide
gactgactgcccttaccttttgtacgcggacccat

SEQ ID NO: 7564 - DNA, 36 bp, Artificial Sequence
  Synthetic oligonucleotide
accccgctggacaccatggtttactaatacctagca

SEQ ID NO: 7565 - DNA, 38 bp, Artificial Sequence
  Synthetic oligonucleotide
actccccgccatactaccaccaggcttctcccacatga

SEQ ID NO: 7566 - DNA, 37 bp, Artificial Sequence
  Synthetic oligonucleotide
atgccaacctatcccttcataagcacacacaccccga

SEQ ID NO: 7567 - DNA, 32 bp, Artificial Sequence
  Synthetic oligonucleotide
acagacctacaccacgcatccacggcacccca

SEQ ID NO: 7568 - DNA, 37 bp, Artificial Sequence
  Synthetic oligonucleotide
tacagggcgtagggagggagagtaggggaacggcgga

SEQ ID NO: 7569 - DNA, 32 bp, Artificial Sequence
  Synthetic oligonucleotide
acacgaatgacctagctccccctcgaatatgt

SEQ ID NO: 7570 - DNA, 36 bp, Artificial Sequence
  Synthetic oligonucleotide
acctcaaccgcactcccaccagacgtaatgtctcaa

SEQ ID NO: 7571 - DNA, 36 bp, Artificial Sequence
  Synthetic oligonucleotide
gtgggggaatttgaagggcgggtaagaagggcagta

SEQ ID NO: 7572 - DNA, 35 bp, Artificial Sequence
  Synthetic oligonucleotide
gtgtaggctgaggaaggggagggggagcgtggaga

SEQ ID NO: 7573 - DNA, 37 bp, Artificial Sequence
  Synthetic oligonucleotide
tcccccacccgttccgcgcccccagggctgtgctgga

SEQ ID NO: 7574 - DNA, 35 bp, Artificial Sequence
  Synthetic oligonucleotide
acgtactgcgcacctgagccctctatttctcccgg

SEQ ID NO: 7575 - DNA, 36 bp, Artificial Sequence
  Synthetic oligonucleotide
accgcaaccacaccgctaatgtcgaccctgctccga

SEQ ID NO: 7576 - DNA, 35 bp, Artificial Sequence
  Synthetic oligonucleotide
gcgacgcccctgttcgctttcacgccgctacttgc

SEQ ID NO: 7577 - DNA, 35 bp, Artificial Sequence
  Synthetic oligonucleotide
ttcgcaggaggagagagggcacaatatggtcgagg

SEQ ID NO: 7578 - DNA, 35 bp, Artificial Sequence
  Synthetic oligonucleotide
gtgctccaactcccgttgccggacctcccccttgt

SEQ ID NO: 7579 - DNA, 37 bp, Artificial Sequence
  Synthetic oligonucleotide
gagccgggggtcgtggaaggaggcttcggctcgcgga

SEQ ID NO: 7580 - DNA, 35 bp, Artificial Sequence
  Synthetic oligonucleotide
atgtcgggcaaaggtcctccatccgtctttcactc

SEQ ID NO: 7581 - DNA, 35 bp, Artificial Sequence
  Synthetic oligonucleotide
aaccaatacgtcgatgtgcgcctcccaccctgttc

SEQ ID NO: 7582 - DNA, 35 bp, Artificial Sequence
  Synthetic oligonucleotide
tcccatcgttagagtcttctcatctgtcggcccca

SEQ ID NO: 7583 - DNA, 36 bp, Artificial Sequence
  Synthetic oligonucleotide
tcatcccgccccataaagagctttgacgacctacaa

SEQ ID NO: 7584 - DNA, 38 bp, Artificial Sequence
  Synthetic oligonucleotide
gaaccaccgtctattagctatccctgtctcgcacttga

SEQ ID NO: 7585 - DNA, 36 bp, Artificial Sequence
  Synthetic oligonucleotide
atgggtctatccggcgcgcaccaacgtttctgctca

SEQ ID NO: 7586 - DNA, 36 bp, Artificial Sequence
  Synthetic oligonucleotide
tccagcgcaaatcgtccgccacccgtatactctgta

SEQ ID NO: 7587 - DNA, 35 bp, Artificial Sequence
  Synthetic oligonucleotide
tccaactgggcacgtggtacttatgctccctccat

SEQ ID NO: 7588 - DNA, 38 bp, Artificial Sequence
  Synthetic oligonucleotide
ggggagggtacgggggttaagaggcggggaatccttga

SEQ ID NO: 7589 - DNA, 35 bp, Artificial Sequence
  Synthetic oligonucleotide
tgctcacctgcattttgtcctagtctcatctaaat

SEQ ID NO: 7590 - DNA, 35 bp, Artificial Sequence
  Synthetic oligonucleotide
gcattccgctgtgatcgttccccggattcaccccc

SEQ ID NO: 7591 - DNA, 35 bp, Artificial Sequence
  Synthetic oligonucleotide
tgcgggcccacgagctaacgattattgatcctccg

SEQ ID NO: 7592 - DNA, 35 bp, Artificial Sequence
  Synthetic oligonucleotide
gaccacgcgatagccccaacgcactgaacttactc

SEQ ID NO: 7593 - DNA, 36 bp, Artificial Sequence
  Synthetic oligonucleotide
tccacctctgcacggtgccactgtgcctgtgctaca

SEQ ID NO: 7594 - DNA, 35 bp, Artificial Sequence
  Synthetic oligonucleotide
atgcatcggtcccgttgaaacattgcatcactccc

SEQ ID NO: 7595 - DNA, 35 bp, Artificial Sequence
  Synthetic oligonucleotide
gaccctgtatagcacccatgcccctgttagttgcc

SEQ ID NO: 7596 - DNA, 35 bp, Artificial Sequence
  Synthetic oligonucleotide
gcgcccacacacttgtaccagtctctgctttgtcc

SEQ ID NO: 7597 - DNA, 36 bp, Artificial Sequence
  Synthetic oligonucleotide
taccgaccaacctcacgtcgaacaacgtgaccgaaa

SEQ ID NO: 7598 - DNA, 35 bp, Artificial Sequence
  Synthetic oligonucleotide
gtggacacggggggaggggggtgaggaggagtcac

SEQ ID NO: 7599 - DNA, 35 bp, Artificial Sequence
  Synthetic oligonucleotide
atcacgcaacgccgtatctcatccgtggccctcaa

SEQ ID NO: 7600 - DNA, 35 bp, Artificial Sequence
  Synthetic oligonucleotide
tccctccacattgtcgtttgccctgatcttcaagc

SEQ ID NO: 7601 - DNA, 35 bp, Artificial Sequence
  Synthetic oligonucleotide
ttgaacctccaccggttctgaaaggaactgctttc

SEQ ID NO: 7602 - DNA, 36 bp, Artificial Sequence
  Synthetic oligonucleotide
gccggaccatagtgtcaggccctactctgctccaca

SEQ ID NO: 7603 - DNA, 37 bp, Artificial Sequence
  Synthetic oligonucleotide
tgttctcccatctgacgcctacaattttgacctccga

SEQ ID NO: 7604 - DNA, 35 bp, Artificial Sequence
  Synthetic oligonucleotide
gacgccgcaccgcaaggcttatcatcactcgacct

SEQ ID NO: 7605 - DNA, 35 bp, Artificial Sequence
  Synthetic oligonucleotide
acatcacgtcacgccctcgccggctctattccctt

SEQ ID NO: 7606 - DNA, 35 bp, Artificial Sequence
  Synthetic oligonucleotide
tgtgccgtccgttgctttccgcccccgcagccatc

SEQ ID NO: 7607 - DNA, 35 bp, Artificial Sequence
  Synthetic oligonucleotide
acctgcgactaattcgtcaacacctctactcatgt

SEQ ID NO: 7608 - DNA, 35 bp, Artificial Sequence
  Synthetic oligonucleotide
ttgcccgcatctcccattttatgtctactgtccct

SEQ ID NO: 7609 - DNA, 36 bp, Artificial Sequence
  Synthetic oligonucleotide
gcctagcccccttgtccaactttcgcgtgccctgaa

SEQ ID NO: 7610 - DNA, 35 bp, Artificial Sequence
  Synthetic oligonucleotide
tccccccctgtctttggtcgcatatcaccgttctc

SEQ ID NO: 7611 - DNA, 35 bp, Artificial Sequence
  Synthetic oligonucleotide
tgccccctcaatgactgcttttccccttcacatgc

SEQ ID NO: 7612 - DNA, 35 bp, Artificial Sequence
  Synthetic oligonucleotide
tatctcccgcctccccttggttttctggtaccgta

SEQ ID NO: 7613 - DNA, 35 bp, Artificial Sequence
  Synthetic oligonucleotide
gagcaccgcggttggttctccatgcctgtctcatc

SEQ ID NO: 7614 - DNA, 35 bp, Artificial Sequence
  Synthetic oligonucleotide
gacacacctacaacggtgaccctctactgacctcc

SEQ ID NO: 7615 - DNA, 35 bp, Artificial Sequence
  Synthetic oligonucleotide
gaacacccattcttacgctggacctatttaggccc

SEQ ID NO: 7616 - DNA, 35 bp, Artificial Sequence
  Synthetic oligonucleotide
gttgcctgtacgtttttttgtgcgccagcctcttc

SEQ ID NO: 7617 - DNA, 36 bp, Artificial Sequence
  Synthetic oligonucleotide
actcccacatctgctatcctattgtcacctcgggga

SEQ ID NO: 7618 - DNA, 37 bp, Artificial Sequence
  Synthetic oligonucleotide
ttcgcaccacgcctgcatactctcatcgcctatccga

SEQ ID NO: 7619 - DNA, 35 bp, Artificial Sequence
  Synthetic oligonucleotide
gcacatccggcgtaggtcgacggagcctccacccc

SEQ ID NO: 7620 - DNA, 35 bp, Artificial Sequence
  Synthetic oligonucleotide
tccactgggtgtaggggaataggaagaagggggta

SEQ ID NO: 7621 - DNA, 35 bp, Artificial Sequence
  Synthetic oligonucleotide
tgcccctagccctcatggtcgcttccctaatatgc

SEQ ID NO: 7622 - DNA, 35 bp, Artificial Sequence
  Synthetic oligonucleotide
taggaacagagcaggggggcgggggcaagaactgg

SEQ ID NO: 7623 - DNA, 37 bp, Artificial Sequence
  Synthetic oligonucleotide
atgcgccacttcacatctgcccattacctatgcctga

SEQ ID NO: 7624 - DNA, 35 bp, Artificial Sequence
  Synthetic oligonucleotide
accctcgcccctatcgtttagtgcctattttgatc

SEQ ID NO: 7625 - DNA, 36 bp, Artificial Sequence
  Synthetic oligonucleotide
ataccgcgcaccgcctccctacatccgctttgacta

SEQ ID NO: 7626 - DNA, 35 bp, Artificial Sequence
  Synthetic oligonucleotide
tgtgcatgcacttgctgctaatacaattgcctttc

SEQ ID NO: 7627 - DNA, 35 bp, Artificial Sequence
  Synthetic oligonucleotide
gccacgcacgccattgcctacttactacggtgatt

SEQ ID NO: 7628 - DNA, 36 bp, Artificial Sequence
  Synthetic oligonucleotide
gtccccaccgcatactaacaacccctcgtgtccaca

SEQ ID NO: 7629 - DNA, 37 bp, Artificial Sequence
  Synthetic oligonucleotide
gatcccccgtcattccatcacgctccaccgttccgga

SEQ ID NO: 7630 - DNA, 35 bp, Artificial Sequence
  Synthetic oligonucleotide
tacttgcagcccctcctattgttccgtgtgctttc

SEQ ID NO: 7631 - DNA, 37 bp, Artificial Sequence
  Synthetic oligonucleotide
tgcgacgtgctgtctccccatcatccctgcctccgga

SEQ ID NO: 7632 - DNA, 35 bp, Artificial Sequence
  Synthetic oligonucleotide
ttgatggtggggatatggtgtgattgtgtgtgggg

SEQ ID NO: 7633 - DNA, 38 bp, Artificial Sequence
  Synthetic oligonucleotide
taggccaccacactatgcacgttcacttctattcttga

SEQ ID NO: 7634 - DNA, 35 bp, Artificial Sequence
  Synthetic oligonucleotide
tgaagcccctcatccgtacctgggtttgtttcgcc

SEQ ID NO: 7635 - DNA, 35 bp, Artificial Sequence
  Synthetic oligonucleotide
tgcaccacactgccttggtcatcactaatttgccg

SEQ ID NO: 7636 - DNA, 35 bp, Artificial Sequence
  Synthetic oligonucleotide
tccctcaccttgtccgttgtcgcaagctccatacc

SEQ ID NO: 7637 - DNA, 36 bp, Artificial Sequence
  Synthetic oligonucleotide
gccactgttagccactcgcgaccactccctttccga

SEQ ID NO: 7638 - DNA, 35 bp, Artificial Sequence
  Synthetic oligonucleotide
tccgacgcatattgagtcacccctgccccgtacct

SEQ ID NO: 7639 - DNA, 37 bp, Artificial Sequence
  Synthetic oligonucleotide
gacacccgcttccatcctacgcctgcatgaccaagga

SEQ ID NO: 7640 - DNA, 35 bp, Artificial Sequence
  Synthetic oligonucleotide
gcccccgcctgcaccctttcttaccgtttccggtg

SEQ ID NO: 7641 - DNA, 35 bp, Artificial Sequence
  Synthetic oligonucleotide
acttccactgtgctgtttaatcctctgcacccatt

SEQ ID NO: 7642 - DNA, 37 bp, Artificial Sequence
  Synthetic oligonucleotide
gtcagtgcctctagtacttttagctgccccccctcga

SEQ ID NO: 7643 - DNA, 35 bp, Artificial Sequence
  Synthetic oligonucleotide
acataccctgaaggccccgccaagtcccgctttac

SEQ ID NO: 7644 - DNA, 35 bp, Artificial Sequence
  Synthetic oligonucleotide
atgatgtagcgcacattgcccgtcacagccactct

SEQ ID NO: 7645 - DNA, 36 bp, Artificial Sequence
  Synthetic oligonucleotide
tgcccctcctgtcacccgccatccctcgcgcgaaca

SEQ ID NO: 7646 - DNA, 35 bp, Artificial Sequence
  Synthetic oligonucleotide
atgcggccacagacacaccgtttggctctctctcc

SEQ ID NO: 7647 - DNA, 36 bp, Artificial Sequence
  Synthetic oligonucleotide
ttggtcagcaccagtttccgcctcccttcaattgca

SEQ ID NO: 7648 - DNA, 35 bp, Artificial Sequence
  Synthetic oligonucleotide
tctcgcacatcgagcctccgttttacaataccatt

SEQ ID NO: 7649 - DNA, 37 bp, Artificial Sequence
  Synthetic oligonucleotide
tgacacactgaatacgtaccttgttgcacaccctcga

SEQ ID NO: 7650 - DNA, 35 bp, Artificial Sequence
  Synthetic oligonucleotide
ccaccaccgagtaagcactagggctactgaacata

SEQ ID NO: 7651 - DNA, 35 bp, Artificial Sequence
  Synthetic oligonucleotide
tacccttccaccgcccgatgcttggccaacgcatc

SEQ ID NO: 7652 - DNA, 35 bp, Artificial Sequence
  Synthetic oligonucleotide
gatgcggtgctccgggatcgtcatttctttccatc

SEQ ID NO: 7653 - DNA, 35 bp, Artificial Sequence
  Synthetic oligonucleotide
acattcccgcgttcaatttcatcccttcccgcacg

SEQ ID NO: 7654 - DNA, 35 bp, Artificial Sequence
  Synthetic oligonucleotide
atcaccatcacgcgagcattttacaccacgagcct

SEQ ID NO: 7655 - DNA, 35 bp, Artificial Sequence
  Synthetic oligonucleotide
tcctacgtcctacatccccacgcgcctgcattttg

SEQ ID NO: 7656 - DNA, 36 bp, Artificial Sequence
  Synthetic oligonucleotide
tcacgggaggggataggacgggagggattgacagta

SEQ ID NO: 7657 - DNA, 35 bp, Artificial Sequence
  Synthetic oligonucleotide
actcgttccatccgcttgagcataatgccctttag

SEQ ID NO: 7658 - DNA, 36 bp, Artificial Sequence
  Synthetic oligonucleotide
tccgcggccgccattccgttatgtctcctcagcgta

SEQ ID NO: 7659 - DNA, 35 bp, Artificial Sequence
  Synthetic oligonucleotide
atcctcaccgtcggttactttttggccactactcc

SEQ ID NO: 7660 - DNA, 38 bp, Artificial Sequence
  Synthetic oligonucleotide
agccaacgtagcgcttccgtctgccatcctcgaactga

SEQ ID NO: 7661 - DNA, 35 bp, Artificial Sequence
  Synthetic oligonucleotide
gacgacacgatgggggggctgggagggcaaccatg

SEQ ID NO: 7662 - DNA, 35 bp, Artificial Sequence
  Synthetic oligonucleotide
tgtgtcccctgtccgagcttctctctgcttcgcca

SEQ ID NO: 7663 - DNA, 36 bp, Artificial Sequence
  Synthetic oligonucleotide
ggaacctcgcctgagagttccatacacactctccat

SEQ ID NO: 7664 - DNA, 36 bp, Artificial Sequence
  Synthetic oligonucleotide
actaccactgccctacgcctgcactaggccatcaca

SEQ ID NO: 7665 - DNA, 36 bp, Artificial Sequence
  Synthetic oligonucleotide
atcgagtgccgccttcaaaccatgcagtcctgcctc

SEQ ID NO: 7666 - DNA, 35 bp, Artificial Sequence
  Synthetic oligonucleotide
ggttgggaggttgggggtgggacatgaaagggagg

SEQ ID NO: 7667 - DNA, 36 bp, Artificial Sequence
  Synthetic oligonucleotide
ggtcacctctcaatacgcttttcaggcacacccaca

SEQ ID NO: 7668 - DNA, 35 bp, Artificial Sequence
  Synthetic oligonucleotide
gcatcccccgaaggcctaactctctgttcctgcac

SEQ ID NO: 7669 - DNA, 35 bp, Artificial Sequence
  Synthetic oligonucleotide
aactcgctggtgttccgttcttcactgtacttgca

SEQ ID NO: 7670 - DNA, 35 bp, Artificial Sequence
  Synthetic oligonucleotide
tgtgccaccacgaccttcttttgccctccgttcgc

SEQ ID NO: 7671 - DNA, 35 bp, Artificial Sequence
  Synthetic oligonucleotide
acgcgcccccgctccgtaattctcgcacgaccccc

SEQ ID NO: 7672 - DNA, 36 bp, Artificial Sequence
  Synthetic oligonucleotide
tcatcacatccggagtgctcggtccttttgttccaa

SEQ ID NO: 7673 - DNA, 37 bp, Artificial Sequence
  Synthetic oligonucleotide
aagagcgggcggacggaaactgggctgggggttggga

SEQ ID NO: 7674 - DNA, 35 bp, Artificial Sequence
  Synthetic oligonucleotide
tctcctccgacgcacctatgccgatagaacctctc

SEQ ID NO: 7675 - DNA, 36 bp, Artificial Sequence
  Synthetic oligonucleotide
tgccccgtgacaacgtacgccacccactacccttca

SEQ ID NO: 7676 - DNA, 35 bp, Artificial Sequence
  Synthetic oligonucleotide
atgtgccttgactcacctgcgattctgcttccgcc

SEQ ID NO: 7677 - DNA, 35 bp, Artificial Sequence
  Synthetic oligonucleotide
ttcgagtgctccccacagttccataagccgctctc

SEQ ID NO: 7678 - DNA, 35 bp, Artificial Sequence
  Synthetic oligonucleotide
atggccactctgcgcctctgcctctacactccacg

SEQ ID NO: 7679 - DNA, 35 bp, Artificial Sequence
  Synthetic oligonucleotide
gatccatgcgcaatcagccctctgcaccacgcttt

SEQ ID NO: 7680 - DNA, 34 bp, Artificial Sequence
  Synthetic oligonucleotide
gtcgccaacattcgcccatggttttcaactctaa

SEQ ID NO: 7681 - DNA, 36 bp, Artificial Sequence
  Synthetic oligonucleotide
gctgacaacactttctgccaataacactgctgacca

SEQ ID NO: 7682 - DNA, 35 bp, Artificial Sequence
  Synthetic oligonucleotide
gtggacctcctccatatgtatatcctgtctctcgc

SEQ ID NO: 7683 - DNA, 37 bp, Artificial Sequence
  Synthetic oligonucleotide
tatgcaaccgtgggctggaggggtgggcgggatcgga

SEQ ID NO: 7684 - DNA, 35 bp, Artificial Sequence
  Synthetic oligonucleotide
tccgacgcgccgtagtcggttccccacatactctt

SEQ ID NO: 7685 - DNA, 37 bp, Artificial Sequence
  Synthetic oligonucleotide
gaccatgcatccccgctattctggcctttcactttga

SEQ ID NO: 7686 - DNA, 38 bp, Artificial Sequence
  Synthetic oligonucleotide
acaccatctccgcgcccatcatagtcatccttgaatga

SEQ ID NO: 7687 - DNA, 35 bp, Artificial Sequence
  Synthetic oligonucleotide
agcacgacacacccgctacccagtttgcgcccacc

SEQ ID NO: 7688 - DNA, 35 bp, Artificial Sequence
  Synthetic oligonucleotide
actctcagctggcatcaattatactttgcactccc

SEQ ID NO: 7689 - DNA, 35 bp, Artificial Sequence
  Synthetic oligonucleotide
gctccccgagcgccgtaaccctcctcaggtcacta

SEQ ID NO: 7690 - DNA, 35 bp, Artificial Sequence
  Synthetic oligonucleotide
acgtcatagccaaattgctgccctgtccaccacca

SEQ ID NO: 7691 - DNA, 38 bp, Artificial Sequence
  Synthetic oligonucleotide
tgatgcatgtcgcagtgtacgttgccttcctgccttga

SEQ ID NO: 7692 - DNA, 35 bp, Artificial Sequence
  Synthetic oligonucleotide
gtaccacccagcccttgcaaacgctccgtaggact

SEQ ID NO: 7693 - DNA, 35 bp, Artificial Sequence
  Synthetic oligonucleotide
gtacgcctcacgccgccccccgaaatcaatagccg

SEQ ID NO: 7694 - DNA, 34 bp, Artificial Sequence
  Synthetic oligonucleotide
tttgtcactcgatctgctattcaccctttttgcc

SEQ ID NO: 7695 - DNA, 38 bp, Artificial Sequence
  Synthetic oligonucleotide
cccacctatcagcaccccgccaaggatcagtctcatga

SEQ ID NO: 7696 - DNA, 35 bp, Artificial Sequence
  Synthetic oligonucleotide
acagcccaaccgggcttaatgccattgtacccctc

SEQ ID NO: 7697 - DNA, 35 bp, Artificial Sequence
  Synthetic oligonucleotide
tcggggccacacaagttcataacccttctcgcccg

SEQ ID NO: 7698 - DNA, 35 bp, Artificial Sequence
  Synthetic oligonucleotide
tgtgaggccccaatgctccttcagttcgccctcca

SEQ ID NO: 7699 - DNA, 34 bp, Artificial Sequence
  Synthetic oligonucleotide
acaatacaccacgttctccatccgcgcgctacgc

SEQ ID NO: 7700 - DNA, 35 bp, Artificial Sequence
  Synthetic oligonucleotide
tcacaggggtcgacgcccttcgttctcatgccctc

SEQ ID NO: 7701 - DNA, 37 bp, Artificial Sequence
  Synthetic oligonucleotide
tagcaatggctgcgaacggagggggggagggtgcgga

SEQ ID NO: 7702 - DNA, 36 bp, Artificial Sequence
  Synthetic oligonucleotide
ttgcgaccgcctttgctacttctctcctcccgcgta

SEQ ID NO: 7703 - DNA, 35 bp, Artificial Sequence
  Synthetic oligonucleotide
ttacgtccccctccgatctcatatacgccgggccc

SEQ ID NO: 7704 - DNA, 35 bp, Artificial Sequence
  Synthetic oligonucleotide
gtccccgccctttcgatcaaaatagatagcacctt

SEQ ID NO: 7705 - DNA, 36 bp, Artificial Sequence
  Synthetic oligonucleotide
tcccaccactcgcatcaagttgtcgtgattgcctca

SEQ ID NO: 7706 - DNA, 35 bp, Artificial Sequence
  Synthetic oligonucleotide
gcctcatatcccgttcccacgttcgtagtcgctac

SEQ ID NO: 7707 - DNA, 35 bp, Artificial Sequence
  Synthetic oligonucleotide
tcaaacggcctgtaatcctagcccctgtaccaccg

SEQ ID NO: 7708 - DNA, 35 bp, Artificial Sequence
  Synthetic oligonucleotide
ttccaccaactggagccgggatatctcctcaccac

SEQ ID NO: 7709 - DNA, 35 bp, Artificial Sequence
  Synthetic oligonucleotide
gccatccgcctctcctcacccgtacccttgacaaa

SEQ ID NO: 7710 - DNA, 36 bp, Artificial Sequence
  Synthetic oligonucleotide
tgaacgcccatcgccatcccatatcaagcactgtta

SEQ ID NO: 7711 - DNA, 35 bp, Artificial Sequence
  Synthetic oligonucleotide
tgtaacaccagagttagtccgacgcacccttctcc

SEQ ID NO: 7712 - DNA, 36 bp, Artificial Sequence
  Synthetic oligonucleotide
tcaccactcccttcatccgagatagcgtttcctgca

SEQ ID NO: 7713 - DNA, 37 bp, Artificial Sequence
  Synthetic oligonucleotide
agtaccgcagagtgtttcccgctcacctacaccctga

SEQ ID NO: 7714 - DNA, 37 bp, Artificial Sequence
  Synthetic oligonucleotide
ggaccacccctacgcgtgagcctctcctatactttga

SEQ ID NO: 7715 - DNA, 35 bp, Artificial Sequence
  Synthetic oligonucleotide
gtgcgaccccactgactccacttcaagtgactact

SEQ ID NO: 7716 - DNA, 35 bp, Artificial Sequence
  Synthetic oligonucleotide
gcctcgtgaactctgctgttacatcctttcgtgcc

SEQ ID NO: 7717 - DNA, 35 bp, Artificial Sequence
  Synthetic oligonucleotide
tactctgccctgtcccgcccgtctgccttctactg

SEQ ID NO: 7718 - DNA, 36 bp, Artificial Sequence
  Synthetic oligonucleotide
atccgccattcctccgagcgcgatctctgaatacca

SEQ ID NO: 7719 - DNA, 36 bp, Artificial Sequence
  Synthetic oligonucleotide
aaacccgatcccgcctcctatagtaggtacatccca

SEQ ID NO: 7720 - DNA, 36 bp, Artificial Sequence
  Synthetic oligonucleotide
acgtggggcgtggggggacgggcgggctggcagtaa

SEQ ID NO: 7721 - DNA, 36 bp, Artificial Sequence
  Synthetic oligonucleotide
tgcacggtaccattgcgccaagtcaccccgttcaca

SEQ ID NO: 7722 - DNA, 36 bp, Artificial Sequence
  Synthetic oligonucleotide
accaccaccaaacactcgatcgttcaccaggcttta

SEQ ID NO: 7723 - DNA, 35 bp, Artificial Sequence
  Synthetic oligonucleotide
tccacccactccggatctgtccacacagtcgcgaa

SEQ ID NO: 7724 - DNA, 36 bp, Artificial Sequence
  Synthetic oligonucleotide
tccactcaacagtccagccttgtgatcgttcgctta

SEQ ID NO: 7725 - DNA, 38 bp, Artificial Sequence
  Synthetic oligonucleotide
tccccccaacgccacattgatacctacgccagacctga

SEQ ID NO: 7726 - DNA, 35 bp, Artificial Sequence
  Synthetic oligonucleotide
gccccaaaggggaaaccctccccgcaacgcaccac

SEQ ID NO: 7727 - DNA, 38 bp, Artificial Sequence
  Synthetic oligonucleotide
gttacgtacagataccccttcaccgcccctctgcttga

SEQ ID NO: 7728 - DNA, 35 bp, Artificial Sequence
  Synthetic oligonucleotide
gcgcccccgctcatccacctgtacatgccatgatt

SEQ ID NO: 7729 - DNA, 35 bp, Artificial Sequence
  Synthetic oligonucleotide
ttggacacagcatgcatggccgctcacacacctta

SEQ ID NO: 7730 - DNA, 37 bp, Artificial Sequence
  Synthetic oligonucleotide
gtgaggaccgggagggtgggtatgggtaggtcaacga

SEQ ID NO: 7731 - DNA, 38 bp, Artificial Sequence
  Synthetic oligonucleotide
tgtccgaccactcccctgctagcgacacacaccattga

SEQ ID NO: 7732 - DNA, 35 bp, Artificial Sequence
  Synthetic oligonucleotide
gtggtcgctaccacattgccacccgaaccttactg

SEQ ID NO: 7733 - DNA, 37 bp, Artificial Sequence
  Synthetic oligonucleotide
gtcgagggggcactgaacctaagggagggaggcaaga

SEQ ID NO: 7734 - DNA, 35 bp, Artificial Sequence
  Synthetic oligonucleotide
gccatccgacgctccaggccatcactatccctaga

SEQ ID NO: 7735 - DNA, 37 bp, Artificial Sequence
  Synthetic oligonucleotide
gagaggggtggggagggcagggctaagtaacgtggga

SEQ ID NO: 7736 - DNA, 35 bp, Artificial Sequence
  Synthetic oligonucleotide
atcccatcgcgacgatccccgcgaaccagccctct

SEQ ID NO: 7737 - DNA, 36 bp, Artificial Sequence
  Synthetic oligonucleotide
gccaacacacactgggatactgtgctcttttaatta

SEQ ID NO: 7738 - DNA, 35 bp, Artificial Sequence
  Synthetic oligonucleotide
tactcccggtcccgccaccacccgtggtcctacga

SEQ ID NO: 7739 - DNA, 35 bp, Artificial Sequence
  Synthetic oligonucleotide
tcctacgcagggcctccaggctttcccactgtttc

SEQ ID NO: 7740 - DNA, 35 bp, Artificial Sequence
  Synthetic oligonucleotide
gtcactctaccggtcctggccaacaccgtttttcg

SEQ ID NO: 7741 - DNA, 35 bp, Artificial Sequence
  Synthetic oligonucleotide
gcccgtgcccgaatcatcgtttttttctgccacta

SEQ ID NO: 7742 - DNA, 36 bp, Artificial Sequence
  Synthetic oligonucleotide
gactgccccatcgtggcgccttccgtctttacgcta

SEQ ID NO: 7743 - DNA, 35 bp, Artificial Sequence
  Synthetic oligonucleotide
tagtgcgccctagagtagtcccgccccattccacg

SEQ ID NO: 7744 - DNA, 35 bp, Artificial Sequence
  Synthetic oligonucleotide
gttgtacccctcctgcttgctcatataacttcttt

SEQ ID NO: 7745 - DNA, 38 bp, Artificial Sequence
  Synthetic oligonucleotide
ttacgccccgcccctcgattacacactcaacacgctga

SEQ ID NO: 7746 - DNA, 38 bp, Artificial Sequence
  Synthetic oligonucleotide
tgatacgccagctttacccaccgcgactcgctctttga

SEQ ID NO: 7747 - DNA, 35 bp, Artificial Sequence
  Synthetic oligonucleotide
gtgacatccgctcttgaactacttatttcggtatc

SEQ ID NO: 7748 - DNA, 35 bp, Artificial Sequence
  Synthetic oligonucleotide
ggtcgaggggtgggcgagcgaaggaaagtacgtgg

SEQ ID NO: 7749 - DNA, 36 bp, Artificial Sequence
  Synthetic oligonucleotide
ttctacacccgcatccgtaacctggagccttggtta

SEQ ID NO: 7750 - DNA, 36 bp, Artificial Sequence
  Synthetic oligonucleotide
ggacactctctgagcccttcacctccacgcaaccga

SEQ ID NO: 7751 - DNA, 35 bp, Artificial Sequence
  Synthetic oligonucleotide
gcctgcaacacccaccgtgccgctccactcaacga

SEQ ID NO: 7752 - DNA, 37 bp, Artificial Sequence
  Synthetic oligonucleotide
gtacgccccacgtgatcctattgttccctgttatcga

SEQ ID NO: 7753 - DNA, 35 bp, Artificial Sequence
  Synthetic oligonucleotide
taagcctcgctccttactacggccttgttcccacc

SEQ ID NO: 7754 - DNA, 35 bp, Artificial Sequence
  Synthetic oligonucleotide
tgaacatctacccccgtccctttgccctatggacc

SEQ ID NO: 7755 - DNA, 37 bp, Artificial Sequence
  Synthetic oligonucleotide
ggatccgcctgttgtctctgcccgccccgtccgccga

SEQ ID NO: 7756 - DNA, 35 bp, Artificial Sequence
  Synthetic oligonucleotide
gtaagcagaccgtcctttgcattgccctggttccc

SEQ ID NO: 7757 - DNA, 35 bp, Artificial Sequence
  Synthetic oligonucleotide
ggatgcgctgttccgacgctagcatttgaactctc

SEQ ID NO: 7758 - DNA, 37 bp, Artificial Sequence
  Synthetic oligonucleotide
tctgcaccttccgcagcttttaccgaccccacttgga

SEQ ID NO: 7759 - DNA, 37 bp, Artificial Sequence
  Synthetic oligonucleotide
gatgcagaggatagcaggggtgggaggatgggcgtga

SEQ ID NO: 7760 - DNA, 35 bp, Artificial Sequence
  Synthetic oligonucleotide
tttcgggtccccgttcactatgaccgtaactttcc

SEQ ID NO: 7761 - DNA, 35 bp, Artificial Sequence
  Synthetic oligonucleotide
tcccatagcatatctgggcctaccactgtatctca

SEQ ID NO: 7762 - DNA, 36 bp, Artificial Sequence
  Synthetic oligonucleotide
acgacaccccaatgaaccttgcacccgccgctctga

SEQ ID NO: 7763 - DNA, 35 bp, Artificial Sequence
  Synthetic oligonucleotide
tgagccgatcgatcccattagcccctattgcccag

SEQ ID NO: 7764 - DNA, 35 bp, Artificial Sequence
  Synthetic oligonucleotide
acaccatccactgaggattcttcataccgaatttt

SEQ ID NO: 7765 - DNA, 35 bp, Artificial Sequence
  Synthetic oligonucleotide
gaaccacccttttcgtttccgtattcggaccgttc

SEQ ID NO: 7766 - DNA, 36 bp, Artificial Sequence
  Synthetic oligonucleotide
ttatcggcccccactcctgtatctatcaatgtgcca

SEQ ID NO: 7767 - DNA, 35 bp, Artificial Sequence
  Synthetic oligonucleotide
tccaaacacaatgtcctcccgcgaaccatcctgtt

SEQ ID NO: 7768 - DNA, 35 bp, Artificial Sequence
  Synthetic oligonucleotide
tgcacctcttcgttcaacgattctgccacctgtcc

SEQ ID NO: 7769 - DNA, 35 bp, Artificial Sequence
  Synthetic oligonucleotide
ttatgcgcatccttctgtacctgcttggtgtcctt

SEQ ID NO: 7770 - DNA, 35 bp, Artificial Sequence
  Synthetic oligonucleotide
aaagggtggggcggacatggggattgggaagtgga

SEQ ID NO: 7771 - DNA, 35 bp, Artificial Sequence
  Synthetic oligonucleotide
atcagggcacctgcctcgagctctattttaatctc

SEQ ID NO: 7772 - DNA, 36 bp, Artificial Sequence
  Synthetic oligonucleotide
ttcacgtgctacacctcccattgtgccctgttacaa

SEQ ID NO: 7773 - DNA, 35 bp, Artificial Sequence
  Synthetic oligonucleotide
gcccaggtacctgcccgaaaaactgcaatttgacc

SEQ ID NO: 7774 - DNA, 35 bp, Artificial Sequence
  Synthetic oligonucleotide
acccagcctctgccgttcttaatccacacttaaac

SEQ ID NO: 7775 - DNA, 35 bp, Artificial Sequence
  Synthetic oligonucleotide
acgcttggcaccgcgtgcggactcccccctccttt

SEQ ID NO: 7776 - DNA, 37 bp, Artificial Sequence
  Synthetic oligonucleotide
ggtgcgcagcccaccgttttaaacaccctgctccgga

SEQ ID NO: 7777 - DNA, 36 bp, Artificial Sequence
  Synthetic oligonucleotide
acccccatgccctggcatctggattatcgacactta

SEQ ID NO: 7778 - DNA, 36 bp, Artificial Sequence
  Synthetic oligonucleotide
taacgccctctgccgccctattctttacgtgatgca

SEQ ID NO: 7779 - DNA, 35 bp, Artificial Sequence
  Synthetic oligonucleotide
taagggaccagtgggatgggggattggttaatggg

SEQ ID NO: 7780 - DNA, 35 bp, Artificial Sequence
  Synthetic oligonucleotide
tgccactcctatcggttcccgtgcccattttggtt

SEQ ID NO: 7781 - DNA, 38 bp, Artificial Sequence
  Synthetic oligonucleotide
tgccgccgcttcacgtgcccttgcgcctgcttttgtga

SEQ ID NO: 7782 - DNA, 37 bp, Artificial Sequence
  Synthetic oligonucleotide
gtgggggggtgagggaggctggtggaaggttgagaga

SEQ ID NO: 7783 - DNA, 35 bp, Artificial Sequence
  Synthetic oligonucleotide
tctgccctgcctttagtttaactttttcacagttc

SEQ ID NO: 7784 - DNA, 36 bp, Artificial Sequence
  Synthetic oligonucleotide
attggccggggttccatctgtccacttttgtcaaca

SEQ ID NO: 7785 - DNA, 36 bp, Artificial Sequence
  Synthetic oligonucleotide
ggtgaaagggggggatgagggttccacggaaaggga

SEQ ID NO: 7786 - DNA, 37 bp, Artificial Sequence
  Synthetic oligonucleotide
tcagcgcccgctcaggcttatcttgccccacccctga

SEQ ID NO: 7787 - DNA, 37 bp, Artificial Sequence
  Synthetic oligonucleotide
gtgccgccgttgaatatcttcacctccacattcggga

SEQ ID NO: 7788 - DNA, 35 bp, Artificial Sequence
  Synthetic oligonucleotide
acgctcggtcaccgctcccttgtttgctaggccac

SEQ ID NO: 7789 - DNA, 35 bp, Artificial Sequence
  Synthetic oligonucleotide
ggacatggggaggtgtcaaggggaggatattgcag

SEQ ID NO: 7790 - DNA, 38 bp, Artificial Sequence
  Synthetic oligonucleotide
ttcacatcccactggtatcctgctgaacctcatgctga

SEQ ID NO: 7791 - DNA, 38 bp, Artificial Sequence
  Synthetic oligonucleotide
atcaccaccgaactagaacaccatatgacgctccgtga

SEQ ID NO: 7792 - DNA, 38 bp, Artificial Sequence
  Synthetic oligonucleotide
ttgactccctccatgtactctttgggtcaccctcgtga

SEQ ID NO: 7793 - DNA, 36 bp, Artificial Sequence
  Synthetic oligonucleotide
tcccccatcgccctgttgggtaccaactgaactcca

SEQ ID NO: 7794 - DNA, 37 bp, Artificial Sequence
  Synthetic oligonucleotide
tgagaacgcagagtactctccacgcacactcgattga

SEQ ID NO: 7795 - DNA, 36 bp, Artificial Sequence
  Synthetic oligonucleotide
ttacggccttgtactccatctgcgctatcgtccacc

SEQ ID NO: 7796 - DNA, 35 bp, Artificial Sequence
  Synthetic oligonucleotide
tgccaccgccggcgctttaacaagcacacacgacc

SEQ ID NO: 7797 - DNA, 37 bp, Artificial Sequence
  Synthetic oligonucleotide
gacgcaccaccacactattgcactacgggagactgga

SEQ ID NO: 7798 - DNA, 35 bp, Artificial Sequence
  Synthetic oligonucleotide
tctctggcctccatccactttgtgacactgcacac

SEQ ID NO: 7799 - DNA, 34 bp, Artificial Sequence
  Synthetic oligonucleotide
gccaacgccctccggtacttcgtttccatttggt

SEQ ID NO: 7800 - DNA, 36 bp, Artificial Sequence
  Synthetic oligonucleotide
gtgaaaacaaaggtggggaacatgggacgacttgga

SEQ ID NO: 7801 - DNA, 36 bp, Artificial Sequence
  Synthetic oligonucleotide
aaacacgtcaatattcatggccgcactgtcccttca

SEQ ID NO: 7802 - DNA, 37 bp, Artificial Sequence
  Synthetic oligonucleotide
gctgcgggggggtgggtgcgaagggttgaggagcaga

SEQ ID NO: 7803 - DNA, 35 bp, Artificial Sequence
  Synthetic oligonucleotide
gcccggtgcaacccgctgatccatccggcctacca

SEQ ID NO: 7804 - DNA, 35 bp, Artificial Sequence
  Synthetic oligonucleotide
tgagcacccccacataaacgctatctgtggctttc

SEQ ID NO: 7805 - DNA, 36 bp, Artificial Sequence
  Synthetic oligonucleotide
tcaggtcgccgcaaggtctttactattccgccatca

SEQ ID NO: 7806 - DNA, 36 bp, Artificial Sequence
  Synthetic oligonucleotide
gtctcccctcaacactatttcccgagacaggacatt

SEQ ID NO: 7807 - DNA, 35 bp, Artificial Sequence
  Synthetic oligonucleotide
attcggacaccccccgcccttctacatgtagctca

SEQ ID NO: 7808 - DNA, 36 bp, Artificial Sequence
  Synthetic oligonucleotide
gagcctccgccgttcctgttgatcgttctcacttga

SEQ ID NO: 7809 - DNA, 35 bp, Artificial Sequence
  Synthetic oligonucleotide
gacaggcccccctaatcttgtacatgcctcacttg

SEQ ID NO: 7810 - DNA, 35 bp, Artificial Sequence
  Synthetic oligonucleotide
gagtgagggagagtgcgggagggatttggggtggg

SEQ ID NO: 7811 - DNA, 37 bp, Artificial Sequence
  Synthetic oligonucleotide
gtgatggggggcaagggacgggtggatcgggtgtgga

SEQ ID NO: 7812 - DNA, 32 bp, Artificial Sequence
  Synthetic oligonucleotide
gcgaataccccttcaccactcgtttgcctatg

SEQ ID NO: 7813 - DNA, 35 bp, Artificial Sequence
  Synthetic oligonucleotide
aacaggccggctctcataatttccccaatgctgtc

SEQ ID NO: 7814 - DNA, 37 bp, Artificial Sequence
  Synthetic oligonucleotide
ttagaatcaggcgggtgaagggctaggggggagggga

SEQ ID NO: 7815 - DNA, 35 bp, Artificial Sequence
  Synthetic oligonucleotide
tcgcggggacgggggattccgggggttttgtgatg

SEQ ID NO: 7816 - DNA, 35 bp, Artificial Sequence
  Synthetic oligonucleotide
gaaccaggccaccaagtatcctgcacaccattcgc

SEQ ID NO: 7817 - DNA, 35 bp, Artificial Sequence
  Synthetic oligonucleotide
tgccccgacacgacctgcgggaccttaccatctgc

SEQ ID NO: 7818 - DNA, 35 bp, Artificial Sequence
  Synthetic oligonucleotide
ttagcacgcacctcgcgtgttttggccatttcttc

SEQ ID NO: 7819 - DNA, 35 bp, Artificial Sequence
  Synthetic oligonucleotide
gaccagcccgccgcatatgcgctctgcgcttttct

SEQ ID NO: 7820 - DNA, 35 bp, Artificial Sequence
  Synthetic oligonucleotide
gtgcgatcgcactcgactcattcaaagctttccac

SEQ ID NO: 7821 - DNA, 38 bp, Artificial Sequence
  Synthetic oligonucleotide
atgcctccccagcctgtcactccccgcgccattcttga

SEQ ID NO: 7822 - DNA, 37 bp, Artificial Sequence
  Synthetic oligonucleotide
gactacaacggtcccctctgcacccacccctcgccga

SEQ ID NO: 7823 - DNA, 35 bp, Artificial Sequence
  Synthetic oligonucleotide
atccaccgccccgtaaggaatgctcttcccaagct

SEQ ID NO: 7824 - DNA, 35 bp, Artificial Sequence
  Synthetic oligonucleotide
ttaaccggcgcctgcaccccagcccacaagtgcct

SEQ ID NO: 7825 - DNA, 37 bp, Artificial Sequence
  Synthetic oligonucleotide
gaacggtgaccggcggggcttagggaaggggagggga

SEQ ID NO: 7826 - DNA, 38 bp, Artificial Sequence
  Synthetic oligonucleotide
tcacacgcgctacaccatcgccctcctgtcctgtgtga

SEQ ID NO: 7827 - DNA, 35 bp, Artificial Sequence
  Synthetic oligonucleotide
tccgtgccccttcgatgagcccctgccttttgttc

SEQ ID NO: 7828 - DNA, 36 bp, Artificial Sequence
  Synthetic oligonucleotide
tgaaggccgcctgccatttcgttccccccttttcga

SEQ ID NO: 7829 - DNA, 35 bp, Artificial Sequence
  Synthetic oligonucleotide
ttatcgcccgggccccaccctgatcgctaccaacg

SEQ ID NO: 7830 - DNA, 35 bp, Artificial Sequence
  Synthetic oligonucleotide
tcacaccagccggccactatcatacgcatgcctct

SEQ ID NO: 7831 - DNA, 36 bp, Artificial Sequence
  Synthetic oligonucleotide
acactcccgacagccgcttcatcccctgtctatcaa

SEQ ID NO: 7832 - DNA, 35 bp, Artificial Sequence
  Synthetic oligonucleotide
gtgaccgcctctaatcgttgattcgcatcatacca

SEQ ID NO: 7833 - DNA, 35 bp, Artificial Sequence
  Synthetic oligonucleotide
gtagccttgtttgcgctcccgataaatcactctca

SEQ ID NO: 7834 - DNA, 35 bp, Artificial Sequence
  Synthetic oligonucleotide
gaactgcaacgtggccgaccgtcttcatcccaact

SEQ ID NO: 7835 - DNA, 35 bp, Artificial Sequence
  Synthetic oligonucleotide
gtgacgggagggaataaaggcggtgggcatgacga

SEQ ID NO: 7836 - DNA, 38 bp, Artificial Sequence
  Synthetic oligonucleotide
tgttaggacggtgggaaatattaggggcggggtggtga

SEQ ID NO: 7837 - DNA, 35 bp, Artificial Sequence
  Synthetic oligonucleotide
gtacccatgagggttctcaagaaacgatcccatcc

SEQ ID NO: 7838 - DNA, 37 bp, Artificial Sequence
  Synthetic oligonucleotide
tcgctccccagctgtcgcctcctactaccatctacga

SEQ ID NO: 7839 - DNA, 37 bp, Artificial Sequence
  Synthetic oligonucleotide
acgcgccccctccacatttatcaccatccctctggga

SEQ ID NO: 7840 - DNA, 35 bp, Artificial Sequence
  Synthetic oligonucleotide
agccccgcccctcagccgccttcccaaaagtgacc

SEQ ID NO: 7841 - DNA, 35 bp, Artificial Sequence
  Synthetic oligonucleotide
tccatcctgcccggatcacgttcgctgccggtttt

SEQ ID NO: 7842 - DNA, 35 bp, Artificial Sequence
  Synthetic oligonucleotide
tttcgcgatcaccgccaccgctccgccccctgtgc

SEQ ID NO: 7843 - DNA, 35 bp, Artificial Sequence
  Synthetic oligonucleotide
gaaccctcgtgcatacatacctcgctccagccact

SEQ ID NO: 7844 - DNA, 35 bp, Artificial Sequence
  Synthetic oligonucleotide
tgaccgttcgctcgctcccgcttgtttccagccta

SEQ ID NO: 7845 - DNA, 35 bp, Artificial Sequence
  Synthetic oligonucleotide
ttcgtgcgcacaccctctacaagccactgcctgca

SEQ ID NO: 7846 - DNA, 35 bp, Artificial Sequence
  Synthetic oligonucleotide
gacgttgttcgccctttcttgttcagaccctgctc

SEQ ID NO: 7847 - DNA, 35 bp, Artificial Sequence
  Synthetic oligonucleotide
gcttcgctccagcccctgtcctttgtccacctgat

SEQ ID NO: 7848 - DNA, 36 bp, Artificial Sequence
  Synthetic oligonucleotide
acctccgccggtccccttcttttgctcgccgttcta

SEQ ID NO: 7849 - DNA, 35 bp, Artificial Sequence
  Synthetic oligonucleotide
atcgactccaacccacaagccttcgcccatccagg

SEQ ID NO: 7850 - DNA, 35 bp, Artificial Sequence
  Synthetic oligonucleotide
gatgccgtccggtatgctagttctcttttttcctg

SEQ ID NO: 7851 - DNA, 35 bp, Artificial Sequence
  Synthetic oligonucleotide
tgacccccgtcgttcaaccctgttcctgcatgccg

SEQ ID NO: 7852 - DNA, 35 bp, Artificial Sequence
  Synthetic oligonucleotide
gtccctgcccgggagtacatttccgatttgcccta

SEQ ID NO: 7853 - DNA, 36 bp, Artificial Sequence
  Synthetic oligonucleotide
tagccaacccatcccgtgttctcataccccctggaa

SEQ ID NO: 7854 - DNA, 35 bp, Artificial Sequence
  Synthetic oligonucleotide
atgtcagaccctctgctctcttttctttcgttccg

SEQ ID NO: 7855 - DNA, 35 bp, Artificial Sequence
  Synthetic oligonucleotide
tcaggaaaggaggggaggtgagtcaatgggaaggc

SEQ ID NO: 7856 - DNA, 37 bp, Artificial Sequence
  Synthetic oligonucleotide
tagtacgcaggctcaagaacagtcaagggatggcaga

SEQ ID NO: 7857 - DNA, 37 bp, Artificial Sequence
  Synthetic oligonucleotide
aaccgcattccgcatgtcttctgccccctcctaccga

SEQ ID NO: 7858 - DNA, 37 bp, Artificial Sequence
  Synthetic oligonucleotide
atgcccgccctagccccattgtgcttaatctacccga

SEQ ID NO: 7859 - DNA, 37 bp, Artificial Sequence
  Synthetic oligonucleotide
aacataggccagccaccacatctcgttagaacctcga

SEQ ID NO: 7860 - DNA, 35 bp, Artificial Sequence
  Synthetic oligonucleotide
gtaggcctgacccatgggacctcttcatctgcttt

SEQ ID NO: 7861 - DNA, 35 bp, Artificial Sequence
  Synthetic oligonucleotide
atcagcccatcccatcccacgaagaccacaacgag

SEQ ID NO: 7862 - DNA, 37 bp, Artificial Sequence
  Synthetic oligonucleotide
acctcccccccacgtgtctgctaagttggaccgcaga

SEQ ID NO: 7863 - DNA, 35 bp, Artificial Sequence
  Synthetic oligonucleotide
gtctgatcgcgcgatctattggaccgccttccccc

SEQ ID NO: 7864 - DNA, 38 bp, Artificial Sequence
  Synthetic oligonucleotide
tcctccccactctagtgtaattccccctcacctcgtga

SEQ ID NO: 7865 - DNA, 36 bp, Artificial Sequence
  Synthetic oligonucleotide
gagcgtacccctgtccacctcggtcctttctgtgaa

SEQ ID NO: 7866 - DNA, 37 bp, Artificial Sequence
  Synthetic oligonucleotide
aaggggcgaaaaagggtgttgtgggtccatggaggga

SEQ ID NO: 7867 - DNA, 35 bp, Artificial Sequence
  Synthetic oligonucleotide
gcccatcctctgaccatcgcgctgtaccccttcag

SEQ ID NO: 7868 - DNA, 35 bp, Artificial Sequence
  Synthetic oligonucleotide
gtatgtacgtcccacgcgcttcattggaccactct

SEQ ID NO: 7869 - DNA, 37 bp, Artificial Sequence
  Synthetic oligonucleotide
tcaactgccaccctatcagaccttcgttacttcttga

SEQ ID NO: 7870 - DNA, 35 bp, Artificial Sequence
  Synthetic oligonucleotide
gcccactcgcaatgctacatgcatccaccgctgtt

SEQ ID NO: 7871 - DNA, 36 bp, Artificial Sequence
  Synthetic oligonucleotide
gttacgcccgagtactttaccaccccagtcccataa

SEQ ID NO: 7872 - DNA, 35 bp, Artificial Sequence
  Synthetic oligonucleotide
tacccgtgagaaccatcgcgctcttcatccgccct

SEQ ID NO: 7873 - DNA, 35 bp, Artificial Sequence
  Synthetic oligonucleotide
tgtacgccctcaccgctatccagttttggagtttt

SEQ ID NO: 7874 - DNA, 37 bp, Artificial Sequence
  Synthetic oligonucleotide
tgcacacgcgtgtttcctaccaccctctagctctcga

SEQ ID NO: 7875 - DNA, 38 bp, Artificial Sequence
  Synthetic oligonucleotide
acccgatcggtaaagggtgggaggggaaggggacttga

SEQ ID NO: 7876 - DNA, 37 bp, Artificial Sequence
  Synthetic oligonucleotide
tccctccgcaccttcccctcacaccatacagccccga

SEQ ID NO: 7877 - DNA, 36 bp, Artificial Sequence
  Synthetic oligonucleotide
atgtcgatccaactgttcaggccctcgacgtccctc

SEQ ID NO: 7878 - DNA, 36 bp, Artificial Sequence
  Synthetic oligonucleotide
gtgcgtgtaagggaggggggagagagggctggataa

SEQ ID NO: 7879 - DNA, 37 bp, Artificial Sequence
  Synthetic oligonucleotide
gaacacacacaattgtcctccgccgtgccatttctga

SEQ ID NO: 7880 - DNA, 37 bp, Artificial Sequence
  Synthetic oligonucleotide
accctccgtcgcagcgtgaccttctatccgctcttga

SEQ ID NO: 7881 - DNA, 35 bp, Artificial Sequence
  Synthetic oligonucleotide
acacacgcccgtgttccttttaccttcctagcgta

SEQ ID NO: 7882 - DNA, 35 bp, Artificial Sequence
  Synthetic oligonucleotide
gccccaaagcacgttatcagccctcgttttgttct

SEQ ID NO: 7883 - DNA, 35 bp, Artificial Sequence
  Synthetic oligonucleotide
tgaccaaacgtcctagctccccgctgccttgatcc

SEQ ID NO: 7884 - DNA, 35 bp, Artificial Sequence
  Synthetic oligonucleotide
tacccgcgctgcccgtgcttccgtttggtctctca

SEQ ID NO: 7885 - DNA, 38 bp, Artificial Sequence
  Synthetic oligonucleotide
tgtcccgccgccccctattcgatccgccctgcacctga

SEQ ID NO: 7886 - DNA, 35 bp, Artificial Sequence
  Synthetic oligonucleotide
gaacagggtggaaggatagggggaggtgcacgtga

SEQ ID NO: 7887 - DNA, 35 bp, Artificial Sequence
  Synthetic oligonucleotide
gtgcacccacgagtgctgcccgattggcccctttt

SEQ ID NO: 7888 - DNA, 35 bp, Artificial Sequence
  Synthetic oligonucleotide
ggaatcgggacgggggggaagggatataggggccg

SEQ ID NO: 7889 - DNA, 35 bp, Artificial Sequence
  Synthetic oligonucleotide
acctgcctcctggtgctagttggttctggtcgcct

SEQ ID NO: 7890 - DNA, 36 bp, Artificial Sequence
  Synthetic oligonucleotide
tccgcccctcctgttagtgccatgataacaaccaca

SEQ ID NO: 7891 - DNA, 35 bp, Artificial Sequence
  Synthetic oligonucleotide
atcacgccaaaacctacccatggctgtctcttgac

SEQ ID NO: 7892 - DNA, 35 bp, Artificial Sequence
  Synthetic oligonucleotide
tggacccaagcctcgtatggcgtcacgcaccatcc

SEQ ID NO: 7893 - DNA, 35 bp, Artificial Sequence
  Synthetic oligonucleotide
tcaacgcggggggagggcgtggggtgttggttgtc

SEQ ID NO: 7894 - DNA, 37 bp, Artificial Sequence
  Synthetic oligonucleotide
acagacgtgcgaagggcattggtggggaaggttggga

SEQ ID NO: 7895 - DNA, 35 bp, Artificial Sequence
  Synthetic oligonucleotide
tcccccggtcctcacggtatataccccgctaccgc

SEQ ID NO: 7896 - DNA, 35 bp, Artificial Sequence
  Synthetic oligonucleotide
gttatgccgccgcgtccgccccgttagctcatgcc

SEQ ID NO: 7897 - DNA, 35 bp, Artificial Sequence
  Synthetic oligonucleotide
gctccctccaatgactactgccgcagcttgcctct

SEQ ID NO: 7898 - DNA, 36 bp, Artificial Sequence
  Synthetic oligonucleotide
actcagccggcgcccttgcccgtctacccgtccaca

SEQ ID NO: 7899 - DNA, 35 bp, Artificial Sequence
  Synthetic oligonucleotide
accactacgggcccggactcccttctccgcacatc

SEQ ID NO: 7900 - DNA, 35 bp, Artificial Sequence
  Synthetic oligonucleotide
acctccacaccatcctcctgcgaaaaagttcgttc

SEQ ID NO: 7901 - DNA, 35 bp, Artificial Sequence
  Synthetic oligonucleotide
gaccccagtccggttggtcttgcctgcccctccaa

SEQ ID NO: 7902 - DNA, 37 bp, Artificial Sequence
  Synthetic oligonucleotide
gctcgccctcgtacgacttattatacttgccccggga

SEQ ID NO: 7903 - DNA, 34 bp, Artificial Sequence
  Synthetic oligonucleotide
tgaggccttgccccatctttgccacaagttcttg

SEQ ID NO: 7904 - DNA, 32 bp, Artificial Sequence
  Synthetic oligonucleotide
accacttcagccccgtatctccttggttctca

SEQ ID NO: 7905 - DNA, 35 bp, Artificial Sequence
  Synthetic oligonucleotide
tatccacccgatgttctccccgactcatggatgac

SEQ ID NO: 7906 - DNA, 35 bp, Artificial Sequence
  Synthetic oligonucleotide
gctcagtcgcgtgctcctctatcccccctgcgaat

SEQ ID NO: 7907 - DNA, 36 bp, Artificial Sequence
  Synthetic oligonucleotide
gccaggtccgacgtgccccccgccaccccccccgta

SEQ ID NO: 7908 - DNA, 37 bp, Artificial Sequence
  Synthetic oligonucleotide
taaccagcccatgacctgcttgaactatcctcgatga

SEQ ID NO: 7909 - DNA, 35 bp, Artificial Sequence
  Synthetic oligonucleotide
gtgcgcaggaccactcgccccctcactttgccctg

SEQ ID NO: 7910 - DNA, 37 bp, Artificial Sequence
  Synthetic oligonucleotide
tgacaaccgttgcgccgcctacacttttaccacctga

SEQ ID NO: 7911 - DNA, 38 bp, Artificial Sequence
  Synthetic oligonucleotide
aacagtacgggggagtaggggagaacggaggcatgtga

SEQ ID NO: 7912 - DNA, 36 bp, Artificial Sequence
  Synthetic oligonucleotide
ttggcaatgccccccgtatccatgcacccaggccta

SEQ ID NO: 7913 - DNA, 35 bp, Artificial Sequence
  Synthetic oligonucleotide
tccacccacgttgacaacctattctgactcgctca

SEQ ID NO: 7914 - DNA, 38 bp, Artificial Sequence
  Synthetic oligonucleotide
agcactcgactatcggcgttaccagttccttcctctga

SEQ ID NO: 7915 - DNA, 35 bp, Artificial Sequence
  Synthetic oligonucleotide
attctccgctgctttgtcccgacctcgcctcctag

SEQ ID NO: 7916 - DNA, 36 bp, Artificial Sequence
  Synthetic oligonucleotide
atgtccacacgccgtgctgtaagccatccgtcctca

SEQ ID NO: 7917 - DNA, 38 bp, Artificial Sequence
  Synthetic oligonucleotide
actcacccccctctgctttcgtgtttggccttgtgtga

SEQ ID NO: 7918 - DNA, 35 bp, Artificial Sequence
  Synthetic oligonucleotide
acttatagtggccgcctccttgctcgtcctcactg

SEQ ID NO: 7919 - DNA, 37 bp, Artificial Sequence
  Synthetic oligonucleotide
tgttgcctcacagtatattaccccgtaccacccttga

SEQ ID NO: 7920 - DNA, 35 bp, Artificial Sequence
  Synthetic oligonucleotide
tgcgacccccgcctccgttcttcgcctctcgcttt

SEQ ID NO: 7921 - DNA, 35 bp, Artificial Sequence
  Synthetic oligonucleotide
tccgtccggctctatcttcgtacatctgcgccacc

SEQ ID NO: 7922 - DNA, 35 bp, Artificial Sequence
  Synthetic oligonucleotide
gcctgccacttgtacatctgctcgtaccgtatcgc

SEQ ID NO: 7923 - DNA, 37 bp, Artificial Sequence
  Synthetic oligonucleotide
ttcgccccacccttggtcccgttgttaacgctacgga

SEQ ID NO: 7924 - DNA, 35 bp, Artificial Sequence
  Synthetic oligonucleotide
accaccctcgcttcccccgtaccgctgactctaca

SEQ ID NO: 7925 - DNA, 35 bp, Artificial Sequence
  Synthetic oligonucleotide
tcgaccccgtcccatcctggcttacacatgatcct

SEQ ID NO: 7926 - DNA, 36 bp, Artificial Sequence
  Synthetic oligonucleotide
agcccctaccgacccctgcgtagtcacctgccatga

SEQ ID NO: 7927 - DNA, 35 bp, Artificial Sequence
  Synthetic oligonucleotide
gatcgccctttgccacctttgctcaccgtttaaag

SEQ ID NO: 7928 - DNA, 35 bp, Artificial Sequence
  Synthetic oligonucleotide
gccatccactccgctgacgccttagttcgtcccta

SEQ ID NO: 7929 - DNA, 35 bp, Artificial Sequence
  Synthetic oligonucleotide
aaactccgctcactgctgaaaccaagttatacttc

SEQ ID NO: 7930 - DNA, 37 bp, Artificial Sequence
  Synthetic oligonucleotide
gtacgccacctgaagccgcctacacacatttctgtga

SEQ ID NO: 7931 - DNA, 37 bp, Artificial Sequence
  Synthetic oligonucleotide
aaaccacaccgcccccttgaaactgcttacactttga

SEQ ID NO: 7932 - DNA, 35 bp, Artificial Sequence
  Synthetic oligonucleotide
gacacgtgtgcctcatcctgctgcctctcagacga

SEQ ID NO: 7933 - DNA, 37 bp, Artificial Sequence
  Synthetic oligonucleotide
ggggagggctggggttaagtgggggttctgagtgtga

SEQ ID NO: 7934 - DNA, 36 bp, Artificial Sequence
  Synthetic oligonucleotide
caggtggggggcaatgaacgggcggcaatagagaca

SEQ ID NO: 7935 - DNA, 36 bp, Artificial Sequence
  Synthetic oligonucleotide
tcatcactcacacgccgtggttcatatgcacatgca

SEQ ID NO: 7936 - DNA, 37 bp, Artificial Sequence
  Synthetic oligonucleotide
tacacgggggggagggacgggatgacgcgccgaatga

SEQ ID NO: 7937 - DNA, 35 bp, Artificial Sequence
  Synthetic oligonucleotide
tctagaacgcgcatggctcgtaacaccaccccatt

SEQ ID NO: 7938 - DNA, 38 bp, Artificial Sequence
  Synthetic oligonucleotide
gagtgtccagccgcaccatgtccattcccgccctatga

SEQ ID NO: 7939 - DNA, 35 bp, Artificial Sequence
  Synthetic oligonucleotide
taaccgcattcgcatcctgactgatcgtacttttc

SEQ ID NO: 7940 - DNA, 35 bp, Artificial Sequence
  Synthetic oligonucleotide
tccgacaccgcgatattcgttcctctcggccccat

SEQ ID NO: 7941 - DNA, 37 bp, Artificial Sequence
  Synthetic oligonucleotide
gccacccctctccatgttaaagaatgttttcctctga

SEQ ID NO: 7942 - DNA, 35 bp, Artificial Sequence
  Synthetic oligonucleotide
tccacatgcactccacgggtcatcgtctcatcaca

SEQ ID NO: 7943 - DNA, 35 bp, Artificial Sequence
  Synthetic oligonucleotide
tcccaccgacgatcagacgacccacgttttgcaca

SEQ ID NO: 7944 - DNA, 38 bp, Artificial Sequence
  Synthetic oligonucleotide
tgatggtgggaggggaagcaggaggcgatcgggagtga

SEQ ID NO: 7945 - DNA, 36 bp, Artificial Sequence
  Synthetic oligonucleotide
tctcgccccaacaaccatgttcagcctctctgttca

SEQ ID NO: 7946 - DNA, 36 bp, Artificial Sequence
  Synthetic oligonucleotide
tacgcctccacgcacgtgccgcattttcaattccta

SEQ ID NO: 7947 - DNA, 35 bp, Artificial Sequence
  Synthetic oligonucleotide
actacgcgcactcctatctcctacacgcacatggt

SEQ ID NO: 7948 - DNA, 38 bp, Artificial Sequence
  Synthetic oligonucleotide
actgccctatccgcccagccactgttttacgcaactga

SEQ ID NO: 7949 - DNA, 35 bp, Artificial Sequence
  Synthetic oligonucleotide
gccgacccgcccgtctgctagtcccatctcccggt

SEQ ID NO: 7950 - DNA, 35 bp, Artificial Sequence
  Synthetic oligonucleotide
tagccccgacctgttacccgcaaactgttacgttc

SEQ ID NO: 7951 - DNA, 37 bp, Artificial Sequence
  Synthetic oligonucleotide
tagccgccccctcgctcctgccctcgtattactatga

SEQ ID NO: 7952 - DNA, 35 bp, Artificial Sequence
  Synthetic oligonucleotide
tacgcaagcacctcgttcccagcaatctttcatgc

SEQ ID NO: 7953 - DNA, 35 bp, Artificial Sequence
  Synthetic oligonucleotide
gtctcatccgacgtgcactgtgcctcgttaactcg

SEQ ID NO: 7954 - DNA, 35 bp, Artificial Sequence
  Synthetic oligonucleotide
gatgacactgcctccttacgggtaaccgggtatct

SEQ ID NO: 7955 - DNA, 35 bp, Artificial Sequence
  Synthetic oligonucleotide
ggtacactcctgcaactgtcaaccacaccacgaaa

SEQ ID NO: 7956 - DNA, 36 bp, Artificial Sequence
  Synthetic oligonucleotide
agtccacacagctccatacgcatccctgtcctgtca

SEQ ID NO: 7957 - DNA, 35 bp, Artificial Sequence
  Synthetic oligonucleotide
gcgtaactgctcgcatcgtcacttacacgtctccc

SEQ ID NO: 7958 - DNA, 35 bp, Artificial Sequence
  Synthetic oligonucleotide
actccctgcccctccaagaggacgtactgcgacct

SEQ ID NO: 7959 - DNA, 37 bp, Artificial Sequence
  Synthetic oligonucleotide
gaaacacccccgcgtgcgttatcagttcctcacctga

SEQ ID NO: 7960 - DNA, 37 bp, Artificial Sequence
  Synthetic oligonucleotide
accgggcacagttgcctggtactataatccccactga

SEQ ID NO: 7961 - DNA, 35 bp, Artificial Sequence
  Synthetic oligonucleotide
actcgccccaaaatcgcgtcccagctctcgccgac

SEQ ID NO: 7962 - DNA, 35 bp, Artificial Sequence
  Synthetic oligonucleotide
gtagcccctgacctatatgtcccttcaggctgccc

SEQ ID NO: 7963 - DNA, 35 bp, Artificial Sequence
  Synthetic oligonucleotide
tatccctccacgccctctgttcctcacggtcagtg

SEQ ID NO: 7964 - DNA, 35 bp, Artificial Sequence
  Synthetic oligonucleotide
tcagatcacatgcagtacctcactttaaccgctct

SEQ ID NO: 7965 - DNA, 35 bp, Artificial Sequence
  Synthetic oligonucleotide
tgtgcgccattcgaccccccattcacgccatttaa

SEQ ID NO: 7966 - DNA, 35 bp, Artificial Sequence
  Synthetic oligonucleotide
acagcctatgcctcacttacgcgcccctcacaacc

SEQ ID NO: 7967 - DNA, 35 bp, Artificial Sequence
  Synthetic oligonucleotide
gaccacgaggcattttctttggaaccgttccctcc

SEQ ID NO: 7968 - DNA, 36 bp, Artificial Sequence
  Synthetic oligonucleotide
acaaaaagggtgagtgtggtgggcgggagaacggca

SEQ ID NO: 7969 - DNA, 36 bp, Artificial Sequence
  Synthetic oligonucleotide
tccttgcacccccgcccgtcctcatcgcagatgtga

SEQ ID NO: 7970 - DNA, 36 bp, Artificial Sequence
  Synthetic oligonucleotide
gcgacccgtagggagcttgcctacactccgcattaa

SEQ ID NO: 7971 - DNA, 35 bp, Artificial Sequence
  Synthetic oligonucleotide
ttacgccacacaatgcgaaccgaccatgcatccca

SEQ ID NO: 7972 - DNA, 36 bp, Artificial Sequence
  Synthetic oligonucleotide
atccccacgccacctcatactcctaagggctatcca

SEQ ID NO: 7973 - DNA, 35 bp, Artificial Sequence
  Synthetic oligonucleotide
gacggaagggaagggggtttgcgggcaaggatagg

SEQ ID NO: 7974 - DNA, 36 bp, Artificial Sequence
  Synthetic oligonucleotide
tcgaccatccctccttgtagtctcaaagccttctaa

SEQ ID NO: 7975 - DNA, 36 bp, Artificial Sequence
  Synthetic oligonucleotide
gaactcgcatccgagtgacctggtcccctccccgca

SEQ ID NO: 7976 - DNA, 37 bp, Artificial Sequence
  Synthetic oligonucleotide
gcaacacggttgccggcctatttctctctgttcacga

SEQ ID NO: 7977 - DNA, 35 bp, Artificial Sequence
  Synthetic oligonucleotide
tacgccccagcccttccatatcgtcaaccggcgac

SEQ ID NO: 7978 - DNA, 35 bp, Artificial Sequence
  Synthetic oligonucleotide
acacctgcctcccataatctccgtgctctaagtcg

SEQ ID NO: 7979 - DNA, 35 bp, Artificial Sequence
  Synthetic oligonucleotide
agctaagcccgcgcatcgttcttgcccatccctca

SEQ ID NO: 7980 - DNA, 37 bp, Artificial Sequence
  Synthetic oligonucleotide
tgtctccatcaccgcagtttccgcccttaggtcccga

SEQ ID NO: 7981 - DNA, 37 bp, Artificial Sequence
  Synthetic oligonucleotide
ttctggggcggtggttctaagttggtggaggagggga

SEQ ID NO: 7982 - DNA, 35 bp, Artificial Sequence
  Synthetic oligonucleotide
tgcccggtcctgtttccctagtttgctgttgcatc

SEQ ID NO: 7983 - DNA, 36 bp, Artificial Sequence
  Synthetic oligonucleotide
tcccccgagcctccctgcgcgaagaacgcctcacta

SEQ ID NO: 7984 - DNA, 35 bp, Artificial Sequence
  Synthetic oligonucleotide
agccctgtccctcagcgtgcctcacctcatagtta

SEQ ID NO: 7985 - DNA, 35 bp, Artificial Sequence
  Synthetic oligonucleotide
tcacccgggagattgctccatcccaagtgcccacc

SEQ ID NO: 7986 - DNA, 35 bp, Artificial Sequence
  Synthetic oligonucleotide
tactgccaacgccgacccccacgcagatataccta

SEQ ID NO: 7987 - DNA, 34 bp, Artificial Sequence
  Synthetic oligonucleotide
tctgagccatccggttggaccatctagcatttcc

SEQ ID NO: 7988 - DNA, 36 bp, Artificial Sequence
  Synthetic oligonucleotide
tcaacctcaatatacgctgccttgctcccttgttca

SEQ ID NO: 7989 - DNA, 35 bp, Artificial Sequence
  Synthetic oligonucleotide
tgtgatccctcgaggccattactaccatccttttg

SEQ ID NO: 7990 - DNA, 37 bp, Artificial Sequence
  Synthetic oligonucleotide
tcccactccccccagctgcgcaatcctacgttgctga

SEQ ID NO: 7991 - DNA, 38 bp, Artificial Sequence
  Synthetic oligonucleotide
tttgccccccactatcgatttgcgtcatcacgctttga

SEQ ID NO: 7992 - DNA, 35 bp, Artificial Sequence
  Synthetic oligonucleotide
gccctccgcaggtctaattattgatgatcccaccc

SEQ ID NO: 7993 - DNA, 36 bp, Artificial Sequence
  Synthetic oligonucleotide
tgcctcacgccgtttgttccgcaccccccttgatga

SEQ ID NO: 7994 - DNA, 36 bp, Artificial Sequence
  Synthetic oligonucleotide
acccatccggcctgttccgccacaacgatttactca

SEQ ID NO: 7995 - DNA, 37 bp, Artificial Sequence
  Synthetic oligonucleotide
gaccggccaaaatcgatatcgcgtaacctgcctccga

SEQ ID NO: 7996 - DNA, 35 bp, Artificial Sequence
  Synthetic oligonucleotide
aactcaggcaccccccaccagccgttcatcaaccc

SEQ ID NO: 7997 - DNA, 35 bp, Artificial Sequence
  Synthetic oligonucleotide
tcacgtcgcatcaccgggacctacattcatctgca

SEQ ID NO: 7998 - DNA, 35 bp, Artificial Sequence
  Synthetic oligonucleotide
ttgtccgactgcataacgtctgttcacttcctggt

SEQ ID NO: 7999 - DNA, 35 bp, Artificial Sequence
  Synthetic oligonucleotide
atgagcacccggcgaacggcatcacaaacctcccg

SEQ ID NO: 8000 - DNA, 33 bp, Artificial Sequence
  Synthetic oligonucleotide
gcgctcccgtcaatctcacccgtccacatcctc

SEQ ID NO: 8001 - DNA, 35 bp, Artificial Sequence
  Synthetic oligonucleotide
aaagggagggacggggccgggattcagagtagacg

SEQ ID NO: 8002 - DNA, 35 bp, Artificial Sequence
  Synthetic oligonucleotide
atacgccatcgcacggtctatgctactacctttat

SEQ ID NO: 8003 - DNA, 35 bp, Artificial Sequence
  Synthetic oligonucleotide
accagtgcctgccttcacattcggtctcattttaa

SEQ ID NO: 8004 - DNA, 37 bp, Artificial Sequence
  Synthetic oligonucleotide
accgggacagttggggaatggggactggtgggcggga

SEQ ID NO: 8005 - DNA, 35 bp, Artificial Sequence
  Synthetic oligonucleotide
gccccccgccctgggtttcttactccagcaaccgc

SEQ ID NO: 8006 - DNA, 35 bp, Artificial Sequence
  Synthetic oligonucleotide
gtggctccccccttacctgcgctttagatcgctct

SEQ ID NO: 8007 - DNA, 36 bp, Artificial Sequence
  Synthetic oligonucleotide
ttgcgtgccaatccgttttgcttgatccacactcca

SEQ ID NO: 8008 - DNA, 35 bp, Artificial Sequence
  Synthetic oligonucleotide
gagtgaacggggactaggaggggaaaacgcaggcg

SEQ ID NO: 8009 - DNA, 38 bp, Artificial Sequence
  Synthetic oligonucleotide
tccgcaagccgcacgctcgaaaacccgcccttgactga

SEQ ID NO: 8010 - DNA, 38 bp, Artificial Sequence
  Synthetic oligonucleotide
agggcgcctcctgtgccgcctgcccgaacctgccttga

SEQ ID NO: 8011 - DNA, 35 bp, Artificial Sequence
  Synthetic oligonucleotide
atcagtccatccgtgcccgtccgccactagtccac

SEQ ID NO: 8012 - DNA, 35 bp, Artificial Sequence
  Synthetic oligonucleotide
ttctgccctgtgccctgttaccggtccaaataaat

SEQ ID NO: 8013 - DNA, 35 bp, Artificial Sequence
  Synthetic oligonucleotide
acgcaccacccgactagtaataccctcagctaaac

SEQ ID NO: 8014 - DNA, 37 bp, Artificial Sequence
  Synthetic oligonucleotide
tccgccagatattccacgccaagactctgcttcccga

SEQ ID NO: 8015 - DNA, 35 bp, Artificial Sequence
  Synthetic oligonucleotide
gagccacacgtgagtcctccatcactcattcctgt

SEQ ID NO: 8016 - DNA, 35 bp, Artificial Sequence
  Synthetic oligonucleotide
gtgatgctgacctcaccttgtccttgcttgtttgt

SEQ ID NO: 8017 - DNA, 36 bp, Artificial Sequence
  Synthetic oligonucleotide
gccatcagcctccctaacctacggtgacgcttgctc

SEQ ID NO: 8018 - DNA, 35 bp, Artificial Sequence
  Synthetic oligonucleotide
tgcacccaaccggtcttgcctaatctgcacataat

SEQ ID NO: 8019 - DNA, 36 bp, Artificial Sequence
  Synthetic oligonucleotide
gaaggcctcgccgtaactgcatactctagcctttca

SEQ ID NO: 8020 - DNA, 35 bp, Artificial Sequence
  Synthetic oligonucleotide
agtgtgcaccccctgaccgcagtgaccgcccctac

SEQ ID NO: 8021 - DNA, 34 bp, Artificial Sequence
  Synthetic oligonucleotide
gtccttcccgcccgaataggagagccctggtacc

SEQ ID NO: 8022 - DNA, 35 bp, Artificial Sequence
  Synthetic oligonucleotide
accgccccacttcattcccggcacccatgcacccg

SEQ ID NO: 8023 - DNA, 36 bp, Artificial Sequence
  Synthetic oligonucleotide
tgtgacccgctgtatcccctaacactggagccatca

SEQ ID NO: 8024 - DNA, 35 bp, Artificial Sequence
  Synthetic oligonucleotide
aaaaccagcctccatccttaatcctggacccccga

SEQ ID NO: 8025 - DNA, 38 bp, Artificial Sequence
  Synthetic oligonucleotide
tccgagatccacgccacccgtttatgccatcatcttga

SEQ ID NO: 8026 - DNA, 38 bp, Artificial Sequence
  Synthetic oligonucleotide
tctggcccatatgctgcaacatctactcctgcctttga

SEQ ID NO: 8027 - DNA, 35 bp, Artificial Sequence
  Synthetic oligonucleotide
gcacctaactccgactctgtctgcggaccgattta

SEQ ID NO: 8028 - DNA, 35 bp, Artificial Sequence
  Synthetic oligonucleotide
tgttatccaggcacatctaccctgcttcctttgcg

SEQ ID NO: 8029 - DNA, 35 bp, Artificial Sequence
  Synthetic oligonucleotide
gacacaccgtaggaacatctctccccagtctgcct

SEQ ID NO: 8030 - DNA, 35 bp, Artificial Sequence
  Synthetic oligonucleotide
tgtttcgccgatcctcatgtctgcttaccatattg

SEQ ID NO: 8031 - DNA, 38 bp, Artificial Sequence
  Synthetic oligonucleotide
tgttccctccgtatggcttcttcgaccacctttcctga

SEQ ID NO: 8032 - DNA, 35 bp, Artificial Sequence
  Synthetic oligonucleotide
gacacccgcccagttcgcgtatctcattacttgat

SEQ ID NO: 8033 - DNA, 36 bp, Artificial Sequence
  Synthetic oligonucleotide
tcccaccgccgccgatacgctatgcgctctttagga

SEQ ID NO: 8034 - DNA, 37 bp, Artificial Sequence
  Synthetic oligonucleotide
tccgatctcccaccgcctgtgcccacccccttggcta

SEQ ID NO: 8035 - DNA, 35 bp, Artificial Sequence
  Synthetic oligonucleotide
gcctccccactgaccgtacaactggcgtatcttca

SEQ ID NO: 8036 - DNA, 36 bp, Artificial Sequence
  Synthetic oligonucleotide
agaccggcctctgatcccacccgcaacctaccgcga

SEQ ID NO: 8037 - DNA, 38 bp, Artificial Sequence
  Synthetic oligonucleotide
acaccctcacctgaccatctagtgctatcaaaatttga

SEQ ID NO: 8038 - DNA, 36 bp, Artificial Sequence
  Synthetic oligonucleotide
acaccacctatccctgcatacagttagtttctagga

SEQ ID NO: 8039 - DNA, 36 bp, Artificial Sequence
  Synthetic oligonucleotide
tcaccgctcctgtctctttactgtacacccccaaca

SEQ ID NO: 8040 - DNA, 36 bp, Artificial Sequence
  Synthetic oligonucleotide
tgctacacacaccatgtctatcctcggtttacgtta

SEQ ID NO: 8041 - DNA, 36 bp, Artificial Sequence
  Synthetic oligonucleotide
gtcgccactccagcccatacaccgttccgatctcga

SEQ ID NO: 8042 - DNA, 35 bp, Artificial Sequence
  Synthetic oligonucleotide
atgtccgagcgcgcgtaacccctgcaaatttcgcc

SEQ ID NO: 8043 - DNA, 37 bp, Artificial Sequence
  Synthetic oligonucleotide
gtggtggggccgtagggggattggggtctcagggcga

SEQ ID NO: 8044 - DNA, 35 bp, Artificial Sequence
  Synthetic oligonucleotide
tgttaccgccaggtaccactttctcttcttcatcg

SEQ ID NO: 8045 - DNA, 36 bp, Artificial Sequence
  Synthetic oligonucleotide
tagcaacagtgcagccctccccttatcgcacctcga

SEQ ID NO: 8046 - DNA, 38 bp, Artificial Sequence
  Synthetic oligonucleotide
tcctccacgcggttctgcacacactatcacgtacttga

SEQ ID NO: 8047 - DNA, 35 bp, Artificial Sequence
  Synthetic oligonucleotide
tttcccgcgcccacctgctggccaactccccgttg

SEQ ID NO: 8048 - DNA, 35 bp, Artificial Sequence
  Synthetic oligonucleotide
aaggaccgagctcctcctatccctccccaccgtgg

SEQ ID NO: 8049 - DNA, 37 bp, Artificial Sequence
  Synthetic oligonucleotide
tcgagaaggggacggggggatggttaggaggctaaga

SEQ ID NO: 8050 - DNA, 35 bp, Artificial Sequence
  Synthetic oligonucleotide
tgccaactgcactggctccgaagtatcggccccca

SEQ ID NO: 8051 - DNA, 35 bp, Artificial Sequence
  Synthetic oligonucleotide
tcaaacatgcgcccagcccggtctagacccctacc

SEQ ID NO: 8052 - DNA, 35 bp, Artificial Sequence
  Synthetic oligonucleotide
aacccccaaccacaacttggataccgaacacggta

SEQ ID NO: 8053 - DNA, 35 bp, Artificial Sequence
  Synthetic oligonucleotide
gtgacggggagtgggtggaacgggatatgagcagc

SEQ ID NO: 8054 - DNA, 35 bp, Artificial Sequence
  Synthetic oligonucleotide
gtatggaggccaagttgggttggggtggaggatgg

SEQ ID NO: 8055 - DNA, 35 bp, Artificial Sequence
  Synthetic oligonucleotide
tgcaccattatcgcaacatcatcaacccgtcgatc

SEQ ID NO: 8056 - DNA, 38 bp, Artificial Sequence
  Synthetic oligonucleotide
gacgcaccgggaggtcgctgatcccacctagtacctga

SEQ ID NO: 8057 - DNA, 35 bp, Artificial Sequence
  Synthetic oligonucleotide
ttatcgacagagccacgaccctcccatctcgcagc

SEQ ID NO: 8058 - DNA, 35 bp, Artificial Sequence
  Synthetic oligonucleotide
agatcggccttgcactttggtaccgtttgtccctt

SEQ ID NO: 8059 - DNA, 35 bp, Artificial Sequence
  Synthetic oligonucleotide
gccggttgagtccgcgatttcttagttccccctac

SEQ ID NO: 8060 - DNA, 35 bp, Artificial Sequence
  Synthetic oligonucleotide
tgtgagcgcacatctcctgcaagctccattaaact

SEQ ID NO: 8061 - DNA, 35 bp, Artificial Sequence
  Synthetic oligonucleotide
gcctagctgctccttggcgtctcctattggtcccc

SEQ ID NO: 8062 - DNA, 35 bp, Artificial Sequence
  Synthetic oligonucleotide
gccccgttcgtcgcctgccccccgccggttgtttt

SEQ ID NO: 8063 - DNA, 37 bp, Artificial Sequence
  Synthetic oligonucleotide
ttgatgtgacagggccgcccactcttttcacctttga

SEQ ID NO: 8064 - DNA, 35 bp, Artificial Sequence
  Synthetic oligonucleotide
gtttgccggacgaattattttagttcacccccttt

SEQ ID NO: 8065 - DNA, 35 bp, Artificial Sequence
  Synthetic oligonucleotide
aatgccctccaggcggtcgccccgtttcttcccaa

SEQ ID NO: 8066 - DNA, 38 bp, Artificial Sequence
  Synthetic oligonucleotide
tgcacacccgttcgcatattcgagttctctgcctctga

SEQ ID NO: 8067 - DNA, 35 bp, Artificial Sequence
  Synthetic oligonucleotide
gccaaacgtcggttccctaactcccgctgctacct

SEQ ID NO: 8068 - DNA, 35 bp, Artificial Sequence
  Synthetic oligonucleotide
atcctcccagcctgtccctccggtcctttaaaagc

SEQ ID NO: 8069 - DNA, 35 bp, Artificial Sequence
  Synthetic oligonucleotide
gacgcccgaccggtaacctgaatcactgggccttc

SEQ ID NO: 8070 - DNA, 35 bp, Artificial Sequence
  Synthetic oligonucleotide
gcactatccttcccccgctacctgcgctgagccga

SEQ ID NO: 8071 - DNA, 36 bp, Artificial Sequence
  Synthetic oligonucleotide
gtatcgcccctgcgaattgtactgcctctaccttga

SEQ ID NO: 8072 - DNA, 35 bp, Artificial Sequence
  Synthetic oligonucleotide
acgcccttcattctggtcatgtcacgtaacttcct

SEQ ID NO: 8073 - DNA, 35 bp, Artificial Sequence
  Synthetic oligonucleotide
accatccatccaggtgcgtgccaaaacgcccttcc

SEQ ID NO: 8074 - DNA, 36 bp, Artificial Sequence
  Synthetic oligonucleotide
gtgagtacggtagggcagggaacgggaaggggctca

SEQ ID NO: 8075 - DNA, 36 bp, Artificial Sequence
  Synthetic oligonucleotide
agcggggaagggtgggggtgcctgaacgggtctcga

SEQ ID NO: 8076 - DNA, 37 bp, Artificial Sequence
  Synthetic oligonucleotide
ggacccttcatcggctcgctcctctcttcatacgtga

SEQ ID NO: 8077 - DNA, 37 bp, Artificial Sequence
  Synthetic oligonucleotide
taacaccctcccgaattgatcgactgaaacttttaga

SEQ ID NO: 8078 - DNA, 35 bp, Artificial Sequence
  Synthetic oligonucleotide
actacacgcggccatttcccgggttcgaaccttct

SEQ ID NO: 8079 - DNA, 37 bp, Artificial Sequence
  Synthetic oligonucleotide
tcccatgtccgcgaacatctttgggctttcttttgga

SEQ ID NO: 8080 - DNA, 35 bp, Artificial Sequence
  Synthetic oligonucleotide
tcaggcccagccgttccctacacgttgctagcccc

SEQ ID NO: 8081 - DNA, 36 bp, Artificial Sequence
  Synthetic oligonucleotide
tcagcaatccacacagtgcacgcttcccttggccga

SEQ ID NO: 8082 - DNA, 38 bp, Artificial Sequence
  Synthetic oligonucleotide
atgggggtggaggagtagggccgaatgttgcagtgtga

SEQ ID NO: 8083 - DNA, 35 bp, Artificial Sequence
  Synthetic oligonucleotide
tccagtgccgccacttgctactatcccatctagca

SEQ ID NO: 8084 - DNA, 38 bp, Artificial Sequence
  Synthetic oligonucleotide
atgcaatctgctgcttttccctgttttcgctccggtga

SEQ ID NO: 8085 - DNA, 37 bp, Artificial Sequence
  Synthetic oligonucleotide
acactcgcagcaacccagcctctctgcctctcctgga

SEQ ID NO: 8086 - DNA, 35 bp, Artificial Sequence
  Synthetic oligonucleotide
ccctgccccgcccacgagcctttgaaatcggtttc

SEQ ID NO: 8087 - DNA, 37 bp, Artificial Sequence
  Synthetic oligonucleotide
atggaccaggtcccatgcgtcgtagcaccttccctaa

SEQ ID NO: 8088 - DNA, 36 bp, Artificial Sequence
  Synthetic oligonucleotide
accgacgcatgttgaaatctgccccatgtaatacca

SEQ ID NO: 8089 - DNA, 35 bp, Artificial Sequence
  Synthetic oligonucleotide
gggatccgcgcctatgccacatgttctacgcttca

SEQ ID NO: 8090 - DNA, 38 bp, Artificial Sequence
  Synthetic oligonucleotide
acgcaccagcccccacgccgtaacctgaatgcctttga

SEQ ID NO: 8091 - DNA, 35 bp, Artificial Sequence
  Synthetic oligonucleotide
cggtgaggagggtggtgtggggttcttgtggtacg

SEQ ID NO: 8092 - DNA, 35 bp, Artificial Sequence
  Synthetic oligonucleotide
agcccgtcgcacgtaccagtgtccatttcgcccat

SEQ ID NO: 8093 - DNA, 36 bp, Artificial Sequence
  Synthetic oligonucleotide
actaacgccatatggccccgcaacgctacgctccca

SEQ ID NO: 8094 - DNA, 37 bp, Artificial Sequence
  Synthetic oligonucleotide
attgtagcgcagcccaaagccacttctaccttccaga

SEQ ID NO: 8095 - DNA, 35 bp, Artificial Sequence
  Synthetic oligonucleotide
taccccgcctactccgaatgcaacatgactatatt

SEQ ID NO: 8096 - DNA, 38 bp, Artificial Sequence
  Synthetic oligonucleotide
acgatagggtgggaggggagtgaagggccgggtagtga

SEQ ID NO: 8097 - DNA, 35 bp, Artificial Sequence
  Synthetic oligonucleotide
atgcccatcgttccccggctttgcaattgctcctg

SEQ ID NO: 8098 - DNA, 37 bp, Artificial Sequence
  Synthetic oligonucleotide
gaccgctccactgtacgtacgttcccatcgccgccga

SEQ ID NO: 8099 - DNA, 35 bp, Artificial Sequence
  Synthetic oligonucleotide
actttccgacctgactccatatgcccgccctggcc

SEQ ID NO: 8100 - DNA, 35 bp, Artificial Sequence
  Synthetic oligonucleotide
gcactcacgtttctaggcccccatgctcagcccct

SEQ ID NO: 8101 - DNA, 37 bp, Artificial Sequence
  Synthetic oligonucleotide
gacaagggggtgagggtaatatagtgtagggtgtgga

SEQ ID NO: 8102 - DNA, 35 bp, Artificial Sequence
  Synthetic oligonucleotide
tccgtaccaccatggcctaccccttcgtttgtata

SEQ ID NO: 8103 - DNA, 36 bp, Artificial Sequence
  Synthetic oligonucleotide
aacgaccacctccagccaccggcaacgatgccccca

SEQ ID NO: 8104 - DNA, 38 bp, Artificial Sequence
  Synthetic oligonucleotide
accacgtgaggttgtaggaagggagggaggggcaatga

SEQ ID NO: 8105 - DNA, 35 bp, Artificial Sequence
  Synthetic oligonucleotide
ggacaaggccacgtctatcagctacacctgtccta

SEQ ID NO: 8106 - DNA, 35 bp, Artificial Sequence
  Synthetic oligonucleotide
gcaaccccacgacgggccacgttctctcatgaaac

SEQ ID NO: 8107 - DNA, 35 bp, Artificial Sequence
  Synthetic oligonucleotide
tccggtgggatggaaaggaaagaagggggagcacg

SEQ ID NO: 8108 - DNA, 35 bp, Artificial Sequence
  Synthetic oligonucleotide
ggacccacccggttgatcctacacattctgacttt

SEQ ID NO: 8109 - DNA, 38 bp, Artificial Sequence
  Synthetic oligonucleotide
gacgaagcccatggtttgccgccgtacccatacactga

SEQ ID NO: 8110 - DNA, 36 bp, Artificial Sequence
  Synthetic oligonucleotide
gccacacgccacatctcaaggaccccgtgttacata

SEQ ID NO: 8111 - DNA, 35 bp, Artificial Sequence
  Synthetic oligonucleotide
taacagcccaaaaggccaagcacttacaccatatc

SEQ ID NO: 8112 - DNA, 38 bp, Artificial Sequence
  Synthetic oligonucleotide
tacgccatgcatttggttcgcaccactggcctttttga

SEQ ID NO: 8113 - DNA, 35 bp, Artificial Sequence
  Synthetic oligonucleotide
actccacgttgcaccgccccccagcgttctaaccg

SEQ ID NO: 8114 - DNA, 35 bp, Artificial Sequence
  Synthetic oligonucleotide
gagggccctccagtatatcactaagtcattgccac

SEQ ID NO: 8115 - DNA, 35 bp, Artificial Sequence
  Synthetic oligonucleotide
acatgggggggcgggttataatgtcagggttgaca

SEQ ID NO: 8116 - DNA, 35 bp, Artificial Sequence
  Synthetic oligonucleotide
ggacccctcgctccccatgaactaccgacatctag

SEQ ID NO: 8117 - DNA, 35 bp, Artificial Sequence
  Synthetic oligonucleotide
acccccccagcctcatatacgtcgaaacctcctct

SEQ ID NO: 8118 - DNA, 35 bp, Artificial Sequence
  Synthetic oligonucleotide
aatgccgccaatctttcatggttccagccactcca

SEQ ID NO: 8119 - DNA, 35 bp, Artificial Sequence
  Synthetic oligonucleotide
acaaagtgggatgagggtttacagggaagtagagg

SEQ ID NO: 8120 - DNA, 37 bp, Artificial Sequence
  Synthetic oligonucleotide
gagacgggcgaattaggggatcgggttcagggaggga

SEQ ID NO: 8121 - DNA, 35 bp, Artificial Sequence
  Synthetic oligonucleotide
ggtaccgcctcaacaggccacccttctcacattcg

SEQ ID NO: 8122 - DNA, 37 bp, Artificial Sequence
  Synthetic oligonucleotide
gatgccacactctacggtctctgccacattcttagga

SEQ ID NO: 8123 - DNA, 36 bp, Artificial Sequence
  Synthetic oligonucleotide
gtgaccacatcctgccttaccgtgactcgacgttga

SEQ ID NO: 8124 - DNA, 35 bp, Artificial Sequence
  Synthetic oligonucleotide
gccctgcccctatcacgtgtccctgcgtgtaactc

SEQ ID NO: 8125 - DNA, 37 bp, Artificial Sequence
  Synthetic oligonucleotide
gacgctccactgcctacctccgtctgtttgatcccga

SEQ ID NO: 8126 - DNA, 37 bp, Artificial Sequence
  Synthetic oligonucleotide
aaactgtgagggagggacggggcaaggaggaaatgga

SEQ ID NO: 8127 - DNA, 37 bp, Artificial Sequence
  Synthetic oligonucleotide
gtacccacggtgcctgaccattaacttgcctgtatga

SEQ ID NO: 8128 - DNA, 35 bp, Artificial Sequence
  Synthetic oligonucleotide
tcacacctctcatacccggacacaaggagttgtct

SEQ ID NO: 8129 - DNA, 35 bp, Artificial Sequence
  Synthetic oligonucleotide
tgaccattgccccccgtatgtttgacgtactgcac

SEQ ID NO: 8130 - DNA, 37 bp, Artificial Sequence
  Synthetic oligonucleotide
gaatgggagggtggatagggcgaggatggaaatccga

SEQ ID NO: 8131 - DNA, 36 bp, Artificial Sequence
  Synthetic oligonucleotide
tgagagcctccccatcgcgcccatacatccttgtca

SEQ ID NO: 8132 - DNA, 36 bp, Artificial Sequence
  Synthetic oligonucleotide
acagcccctaggcctactttagtccctgcaccctgc

SEQ ID NO: 8133 - DNA, 35 bp, Artificial Sequence
  Synthetic oligonucleotide
accctgtcggcgatccctttttggaccgctcccac

SEQ ID NO: 8134 - DNA, 33 bp, Artificial Sequence
  Synthetic oligonucleotide
tcaggccccccatttcacccttacggttgttac

SEQ ID NO: 8135 - DNA, 36 bp, Artificial Sequence
  Synthetic oligonucleotide
aatatcgcctggtccttgcccttcacccgtggtgca

SEQ ID NO: 8136 - DNA, 35 bp, Artificial Sequence
  Synthetic oligonucleotide
gctcgccctgcgttactgctacatctacccaccgg

SEQ ID NO: 8137 - DNA, 37 bp, Artificial Sequence
  Synthetic oligonucleotide
gtggagtggcgggaagggaacataaggcggagggaga

SEQ ID NO: 8138 - DNA, 36 bp, Artificial Sequence
  Synthetic oligonucleotide
ggtcctcccactcgtgccatagctacctacgcttta

SEQ ID NO: 8139 - DNA, 35 bp, Artificial Sequence
  Synthetic oligonucleotide
gcacaccgggctgcacaaacttacgggcactctcc

SEQ ID NO: 8140 - DNA, 35 bp, Artificial Sequence
  Synthetic oligonucleotide
atccgcccccatcgtcaatggtcatgttctcgctg

SEQ ID NO: 8141 - DNA, 37 bp, Artificial Sequence
  Synthetic oligonucleotide
gtcaagtagggtgggtgggtggaatgcaattgggcga

SEQ ID NO: 8142 - DNA, 35 bp, Artificial Sequence
  Synthetic oligonucleotide
gtaattgccacccacccatggtctaccttgaaacc

SEQ ID NO: 8143 - DNA, 35 bp, Artificial Sequence
  Synthetic oligonucleotide
tgtagccacgctggagccgccctgattcttaccca

SEQ ID NO: 8144 - DNA, 37 bp, Artificial Sequence
  Synthetic oligonucleotide
gtgcacttgccccctctcgctaatcctggcccttgga

SEQ ID NO: 8145 - DNA, 35 bp, Artificial Sequence
  Synthetic oligonucleotide
gccgacgcctccccctttgaaacggaatctacgcc

SEQ ID NO: 8146 - DNA, 35 bp, Artificial Sequence
  Synthetic oligonucleotide
acgatgggggtgagggtgggggtcagaaagcatgt

SEQ ID NO: 8147 - DNA, 36 bp, Artificial Sequence
  Synthetic oligonucleotide
tcaaatgcgcaacgcgtcacacttcttcccttgcac

SEQ ID NO: 8148 - DNA, 36 bp, Artificial Sequence
  Synthetic oligonucleotide
aaccaccgcttgcctggtctatgttcgtccccgaaa

SEQ ID NO: 8149 - DNA, 36 bp, Artificial Sequence
  Synthetic oligonucleotide
tacatactgtcaccctgccttgaactgccctaccta

SEQ ID NO: 8150 - DNA, 34 bp, Artificial Sequence
  Synthetic oligonucleotide
tcaacccccggccgacactcttcatttatgttgt

SEQ ID NO: 8151 - DNA, 35 bp, Artificial Sequence
  Synthetic oligonucleotide
tgtggaccaacgttctgtcttctccttgtaccgac

SEQ ID NO: 8152 - DNA, 35 bp, Artificial Sequence
  Synthetic oligonucleotide
aaaacactggccagcggggtggagtgggtggtgtg

SEQ ID NO: 8153 - DNA, 36 bp, Artificial Sequence
  Synthetic oligonucleotide
atggccacgcaccatctgaccgttcattaaattaca

SEQ ID NO: 8154 - DNA, 37 bp, Artificial Sequence
  Synthetic oligonucleotide
gtactccccccgatgcccttttacgccctctgaagga

SEQ ID NO: 8155 - DNA, 36 bp, Artificial Sequence
  Synthetic oligonucleotide
aacacccgacctatatggttcacagaagccacttca

SEQ ID NO: 8156 - DNA, 35 bp, Artificial Sequence
  Synthetic oligonucleotide
atgtgcctccgtccaatagccccttttcaacttgt

SEQ ID NO: 8157 - DNA, 38 bp, Artificial Sequence
  Synthetic oligonucleotide
gccttcagcccgccacatactactagcttccatcttga

SEQ ID NO: 8158 - DNA, 36 bp, Artificial Sequence
  Synthetic oligonucleotide
gcgaggccccatcaagctcttatgtctcgaacctga

SEQ ID NO: 8159 - DNA, 32 bp, Artificial Sequence
  Synthetic oligonucleotide
tgacaagaccccaattccaccacgtccgctca

SEQ ID NO: 8160 - DNA, 35 bp, Artificial Sequence
  Synthetic oligonucleotide
tgatcgaaccgctagccacaccaggtaccaccacc

SEQ ID NO: 8161 - DNA, 37 bp, Artificial Sequence
  Synthetic oligonucleotide
gcactctaggtcaggagggggggatggtaggccggga

SEQ ID NO: 8162 - DNA, 35 bp, Artificial Sequence
  Synthetic oligonucleotide
tcgtatcgccaactcttttttagctccacgccctt

SEQ ID NO: 8163 - DNA, 38 bp, Artificial Sequence
  Synthetic oligonucleotide
tcagtccacccatcccatgctagtaccagtaaacttga

SEQ ID NO: 8164 - DNA, 35 bp, Artificial Sequence
  Synthetic oligonucleotide
tcccctcctccacatccttttaattcggggacctt

SEQ ID NO: 8165 - DNA, 36 bp, Artificial Sequence
  Synthetic oligonucleotide
gacttgcgatccccccccagcatggtgttaccctca

SEQ ID NO: 8166 - DNA, 35 bp, Artificial Sequence
  Synthetic oligonucleotide
tccaccttacgtttgtttgatcttttccagccagg

SEQ ID NO: 8167 - DNA, 36 bp, Artificial Sequence
  Synthetic oligonucleotide
attcgaccgctacccatagtacatctcctgttccaa

SEQ ID NO: 8168 - DNA, 35 bp, Artificial Sequence
  Synthetic oligonucleotide
tctaacacagacggcctgcaacttacttcgcactc

SEQ ID NO: 8169 - DNA, 35 bp, Artificial Sequence
  Synthetic oligonucleotide
ttccaatccatcccgagcgttatcgagcctgaact

SEQ ID NO: 8170 - DNA, 35 bp, Artificial Sequence
  Synthetic oligonucleotide
aagtcggggtagggtggttgagggggagtaggtaa

SEQ ID NO: 8171 - DNA, 35 bp, Artificial Sequence
  Synthetic oligonucleotide
agatcccgcacatgcgctaccatccccctactatg

SEQ ID NO: 8172 - DNA, 35 bp, Artificial Sequence
  Synthetic oligonucleotide
taatcccccccgaacacgcccgtacgcaccatgta

SEQ ID NO: 8173 - DNA, 36 bp, Artificial Sequence
  Synthetic oligonucleotide
gccacgccacattcaccccagccccgcaggcatgca

SEQ ID NO: 8174 - DNA, 35 bp, Artificial Sequence
  Synthetic oligonucleotide
accacacctccgacactgtactcatcgaaggaatt

SEQ ID NO: 8175 - DNA, 35 bp, Artificial Sequence
  Synthetic oligonucleotide
tgttgcccgtttttcacatttgtcctgttcccgta

SEQ ID NO: 8176 - DNA, 35 bp, Artificial Sequence
  Synthetic oligonucleotide
atagtcaccacccttcccgccatggtttgtagtcc

SEQ ID NO: 8177 - DNA, 38 bp, Artificial Sequence
  Synthetic oligonucleotide
ggtcgccgcaccgccccgtcccaccaacctgaaggtga

SEQ ID NO: 8178 - DNA, 35 bp, Artificial Sequence
  Synthetic oligonucleotide
tgccgatccatgtctgcggggctttttctatcttt

SEQ ID NO: 8179 - DNA, 38 bp, Artificial Sequence
  Synthetic oligonucleotide
gtgtgcagaagtcctctagcctcgttcgacccacctga

SEQ ID NO: 8180 - DNA, 35 bp, Artificial Sequence
  Synthetic oligonucleotide
gaccactgtctcgccacgaatcatcttatcatccg

SEQ ID NO: 8181 - DNA, 35 bp, Artificial Sequence
  Synthetic oligonucleotide
gtcctccctcagctattgccctactccccgcataa

SEQ ID NO: 8182 - DNA, 36 bp, Artificial Sequence
  Synthetic oligonucleotide
gaccttcgccctccgcatttatacccgacttgaata

SEQ ID NO: 8183 - DNA, 35 bp, Artificial Sequence
  Synthetic oligonucleotide
ttcaacatcacggtccccttattgtatcgatcccc

SEQ ID NO: 8184 - DNA, 35 bp, Artificial Sequence
  Synthetic oligonucleotide
agttccgtcgccagccgaccgccactcctcgtccc

SEQ ID NO: 8185 - DNA, 35 bp, Artificial Sequence
  Synthetic oligonucleotide
tcccccctccgctacatgacccgcgactagggttc

SEQ ID NO: 8186 - DNA, 35 bp, Artificial Sequence
  Synthetic oligonucleotide
gtgtgccaacttaccgccctaatatgtaccgtacc

SEQ ID NO: 8187 - DNA, 38 bp, Artificial Sequence
  Synthetic oligonucleotide
gaacatcgcatgtttgctgccatctcatacacccttga

SEQ ID NO: 8188 - DNA, 36 bp, Artificial Sequence
  Synthetic oligonucleotide
atgccctcccgttggtccctccccatcccaagagaa

SEQ ID NO: 8189 - DNA, 35 bp, Artificial Sequence
  Synthetic oligonucleotide
gacaccacccctcacacccccaggtgaacctgata

SEQ ID NO: 8190 - DNA, 38 bp, Artificial Sequence
  Synthetic oligonucleotide
aatacggtgggaaggaggaatgggggtagaacgattga

SEQ ID NO: 8191 - DNA, 36 bp, Artificial Sequence
  Synthetic oligonucleotide
gtctgtgcccacgctgcgatcctccctacgtttcta

SEQ ID NO: 8192 - DNA, 35 bp, Artificial Sequence
  Synthetic oligonucleotide
gcgcccatctcattgcctcgttatatgcccaccga

SEQ ID NO: 8193 - DNA, 37 bp, Artificial Sequence
  Synthetic oligonucleotide
gttcccgccacctgtgggttcaatgcatttcctccga

SEQ ID NO: 8194 - DNA, 35 bp, Artificial Sequence
  Synthetic oligonucleotide
agaccacagctcctcgcctattccccagtgccgac

SEQ ID NO: 8195 - DNA, 35 bp, Artificial Sequence
  Synthetic oligonucleotide
gcccatcacctgtggtcttcctggccgtgccgcac

SEQ ID NO: 8196 - DNA, 35 bp, Artificial Sequence
  Synthetic oligonucleotide
tgctcagtccgctgtctttgacccttcttagccac

SEQ ID NO: 8197 - DNA, 35 bp, Artificial Sequence
  Synthetic oligonucleotide
ggacgccactttgtttccgggccctgtttttcgct

SEQ ID NO: 8198 - DNA, 35 bp, Artificial Sequence
  Synthetic oligonucleotide
tcaccactggacactgagcccaaacactgtcgtaa

SEQ ID NO: 8199 - DNA, 35 bp, Artificial Sequence
  Synthetic oligonucleotide
gcccaccccaattgctggttctagcccatactgtg

SEQ ID NO: 8200 - DNA, 36 bp, Artificial Sequence
  Synthetic oligonucleotide
tccacacacctgcactttttcgatatgaacacgaca

SEQ ID NO: 8201 - DNA, 35 bp, Artificial Sequence
  Synthetic oligonucleotide
ttcatcaccgcataactgaccatcaccaatgtgcc

SEQ ID NO: 8202 - DNA, 35 bp, Artificial Sequence
  Synthetic oligonucleotide
atgacgtgctgcatggaatccggccaactatcctg

SEQ ID NO: 8203 - DNA, 36 bp, Artificial Sequence
  Synthetic oligonucleotide
acccaggctttgcctcgcacccctcccaggccacca

SEQ ID NO: 8204 - DNA, 37 bp, Artificial Sequence
  Synthetic oligonucleotide
tagccccaaaagccccagccctcgtctcagtacccga

SEQ ID NO: 8205 - DNA, 35 bp, Artificial Sequence
  Synthetic oligonucleotide
tacactccgcccctgtgttgctgacctttattacg

SEQ ID NO: 8206 - DNA, 35 bp, Artificial Sequence
  Synthetic oligonucleotide
gcccaccagggcggtctaaagctcacccaccttgc

SEQ ID NO: 8207 - DNA, 35 bp, Artificial Sequence
  Synthetic oligonucleotide
gtcgcccctgtaccttccctaccagccctttgaag

SEQ ID NO: 8208 - DNA, 36 bp, Artificial Sequence
  Synthetic oligonucleotide
tagccacccgcgctccacttgtccctattcataaca

SEQ ID NO: 8209 - DNA, 37 bp, Artificial Sequence
  Synthetic oligonucleotide
cccattcaactgaatcgttaccacttcggactctcga

SEQ ID NO: 8210 - DNA, 32 bp, Artificial Sequence
  Synthetic oligonucleotide
ttgccgtgccaccccgctcgttcatccttata

SEQ ID NO: 8211 - DNA, 36 bp, Artificial Sequence
  Synthetic oligonucleotide
tcccgctgccacattgttagcttctatattgcccca

SEQ ID NO: 8212 - DNA, 36 bp, Artificial Sequence
  Synthetic oligonucleotide
tccacggaccatgaatttgcccctgttctaatctta

SEQ ID NO: 8213 - DNA, 35 bp, Artificial Sequence
  Synthetic oligonucleotide
ttaggcacgtacgccgccccatccactgtatatcc

SEQ ID NO: 8214 - DNA, 35 bp, Artificial Sequence
  Synthetic oligonucleotide
ttctcgtccagcaccgcattacgcacgatccccct

SEQ ID NO: 8215 - DNA, 38 bp, Artificial Sequence
  Synthetic oligonucleotide
taacccacgctcgatatccagggcctcgtttctcttga

SEQ ID NO: 8216 - DNA, 35 bp, Artificial Sequence
  Synthetic oligonucleotide
gcaatcacctctggcttcgtgactatcgcttaccc

SEQ ID NO: 8217 - DNA, 37 bp, Artificial Sequence
  Synthetic oligonucleotide
gcggaccccgccgacgagttcaaacgctccttcctga

SEQ ID NO: 8218 - DNA, 36 bp, Artificial Sequence
  Synthetic oligonucleotide
tcacctccccctcatatcgccacggtcttggataga

SEQ ID NO: 8219 - DNA, 35 bp, Artificial Sequence
  Synthetic oligonucleotide
gacaattacgctcatcaccttgtcactgatctacc

SEQ ID NO: 8220 - DNA, 36 bp, Artificial Sequence
  Synthetic oligonucleotide
acgcgcccggccggaagctactccttgtcccatcaa

SEQ ID NO: 8221 - DNA, 35 bp, Artificial Sequence
  Synthetic oligonucleotide
tccctcgccgttctctgtcactaagctcactcgga

SEQ ID NO: 8222 - DNA, 38 bp, Artificial Sequence
  Synthetic oligonucleotide
gtctccatccgttctcactgcctatttcgtcatcctga

SEQ ID NO: 8223 - DNA, 35 bp, Artificial Sequence
  Synthetic oligonucleotide
tcccgccgccagtggatccgttgcatctctcacac

SEQ ID NO: 8224 - DNA, 38 bp, Artificial Sequence
  Synthetic oligonucleotide
gctgcccctaacgccacgtcttgcccgcccacccatga

SEQ ID NO: 8225 - DNA, 35 bp, Artificial Sequence
  Synthetic oligonucleotide
aactacaccttggcaccacctatgattctatgccc

SEQ ID NO: 8226 - DNA, 34 bp, Artificial Sequence
  Synthetic oligonucleotide
gtgatcaggggacgggaatgggaggggcgtagag

SEQ ID NO: 8227 - DNA, 36 bp, Artificial Sequence
  Synthetic oligonucleotide
gcaccccccctatgtagctcactcacggcctgtaaa

SEQ ID NO: 8228 - DNA, 38 bp, Artificial Sequence
  Synthetic oligonucleotide
tgccgacgtccagctcttaccaccgctgcttccgctga

SEQ ID NO: 8229 - DNA, 35 bp, Artificial Sequence
  Synthetic oligonucleotide
atgtggggccccagaagctacaaccgaactcccat

SEQ ID NO: 8230 - DNA, 36 bp, Artificial Sequence
  Synthetic oligonucleotide
ttcatggggggggtggagagagggtattcgtacgaa

SEQ ID NO: 8231 - DNA, 35 bp, Artificial Sequence
  Synthetic oligonucleotide
gactccatgacctatactgcacattctccatccga

SEQ ID NO: 8232 - DNA, 35 bp, Artificial Sequence
  Synthetic oligonucleotide
aacactcctccttctaagctgcacggtcttcttac

SEQ ID NO: 8233 - DNA, 36 bp, Artificial Sequence
  Synthetic oligonucleotide
gcaccgcctatccactgggctttacagggccccata

SEQ ID NO: 8234 - DNA, 35 bp, Artificial Sequence
  Synthetic oligonucleotide
ttggacacggcgaccgcgttacactcacccttctg

SEQ ID NO: 8235 - DNA, 35 bp, Artificial Sequence
  Synthetic oligonucleotide
tcacatcgctgtcgaacgcctgggcttctattctt

SEQ ID NO: 8236 - DNA, 35 bp, Artificial Sequence
  Synthetic oligonucleotide
gaaaccaccccgcgccgatactcaccgtcccgttt

SEQ ID NO: 8237 - DNA, 37 bp, Artificial Sequence
  Synthetic oligonucleotide
accacacacaactcctatccagtcatcatcgtcatga

SEQ ID NO: 8238 - DNA, 35 bp, Artificial Sequence
  Synthetic oligonucleotide
gaaatgccagcctgcacatccgtagccaccctgct

SEQ ID NO: 8239 - DNA, 35 bp, Artificial Sequence
  Synthetic oligonucleotide
tctccgccacctgcttactgtttcaaatcgcacaa

SEQ ID NO: 8240 - DNA, 35 bp, Artificial Sequence
  Synthetic oligonucleotide
gaccccagtccccgcatgttcctcattgccactat

SEQ ID NO: 8241 - DNA, 35 bp, Artificial Sequence
  Synthetic oligonucleotide
atccccgccagggcttcttctctcactttatgtgt

SEQ ID NO: 8242 - DNA, 35 bp, Artificial Sequence
  Synthetic oligonucleotide
gtggtaaccggcggaggtgagggggaacaaaaggg

SEQ ID NO: 8243 - DNA, 35 bp, Artificial Sequence
  Synthetic oligonucleotide
acgacccaaccgtttctcccaacggacctgtacct

SEQ ID NO: 8244 - DNA, 36 bp, Artificial Sequence
  Synthetic oligonucleotide
gcacggaaaggagaattggatgatcaggaggatgaa

SEQ ID NO: 8245 - DNA, 35 bp, Artificial Sequence
  Synthetic oligonucleotide
atgcccttgccgctcacttctccgaagccacctat

SEQ ID NO: 8246 - DNA, 35 bp, Artificial Sequence
  Synthetic oligonucleotide
gcacacgtgctccaccgcacctgcgctcgctttcc

SEQ ID NO: 8247 - DNA, 35 bp, Artificial Sequence
  Synthetic oligonucleotide
tgcatgcgccacacctcgccattgcagttatcttc

SEQ ID NO: 8248 - DNA, 36 bp, Artificial Sequence
  Synthetic oligonucleotide
gatcaggccgaccgctccatctgctcgtcgtttcca

SEQ ID NO: 8249 - DNA, 37 bp, Artificial Sequence
  Synthetic oligonucleotide
gatgcgcacttgcttccgataaccaccgctcctagga

SEQ ID NO: 8250 - DNA, 35 bp, Artificial Sequence
  Synthetic oligonucleotide
tcagcactgcctgttcatgtcatgcctccatttgt

SEQ ID NO: 8251 - DNA, 35 bp, Artificial Sequence
  Synthetic oligonucleotide
ttctgcctccgggactcttaactctgccgcactcg

SEQ ID NO: 8252 - DNA, 37 bp, Artificial Sequence
  Synthetic oligonucleotide
tcagtccaccgcacctttaatatgttcgctttagcga

SEQ ID NO: 8253 - DNA, 36 bp, Artificial Sequence
  Synthetic oligonucleotide
tctcgaacacgcaggtctttgtcgcctcccctctta

SEQ ID NO: 8254 - DNA, 37 bp, Artificial Sequence
  Synthetic oligonucleotide
gtgatgagaagcgggggctggagggggagggactgga

SEQ ID NO: 8255 - DNA, 37 bp, Artificial Sequence
  Synthetic oligonucleotide
gtcttgcaccctcaacgttactaccaccagccccgga

SEQ ID NO: 8256 - DNA, 37 bp, Artificial Sequence
  Synthetic oligonucleotide
accctacatcaatgttcacccttgccactcattatga

SEQ ID NO: 8257 - DNA, 35 bp, Artificial Sequence
  Synthetic oligonucleotide
accccaatcaccgtcccccggcggatcgctcacac

SEQ ID NO: 8258 - DNA, 36 bp, Artificial Sequence
  Synthetic oligonucleotide
atagggaaaggtcggggacagggggagatacttgta

SEQ ID NO: 8259 - DNA, 35 bp, Artificial Sequence
  Synthetic oligonucleotide
gtccgaatccctagctctgttcctcgattgcgccg

SEQ ID NO: 8260 - DNA, 35 bp, Artificial Sequence
  Synthetic oligonucleotide
attgcaccctcggccccccttcacccgcacggaga

SEQ ID NO: 8261 - DNA, 35 bp, Artificial Sequence
  Synthetic oligonucleotide
gccaactgactcaccctactcctacataggtacat

SEQ ID NO: 8262 - DNA, 35 bp, Artificial Sequence
  Synthetic oligonucleotide
tgataccggcatggcttaacttactcacacacgct

SEQ ID NO: 8263 - DNA, 35 bp, Artificial Sequence
  Synthetic oligonucleotide
gaccagggcccactcaccgacacacaagcctttgc

SEQ ID NO: 8264 - DNA, 37 bp, Artificial Sequence
  Synthetic oligonucleotide
gaccgcacgtggtttcgtttttagctctgccttccga

SEQ ID NO: 8265 - DNA, 35 bp, Artificial Sequence
  Synthetic oligonucleotide
acgacgggccacgtgtttcatcctcgctttttcac

SEQ ID NO: 8266 - DNA, 37 bp, Artificial Sequence
  Synthetic oligonucleotide
tgtcccctgcctgccactcgttacgcacccgcccgga

SEQ ID NO: 8267 - DNA, 37 bp, Artificial Sequence
  Synthetic oligonucleotide
tctcgaaccatcactggattagcctacactgatttga

SEQ ID NO: 8268 - DNA, 37 bp, Artificial Sequence
  Synthetic oligonucleotide
accgacccgcccaagctctatcttcacagtttcgtga

SEQ ID NO: 8269 - DNA, 36 bp, Artificial Sequence
  Synthetic oligonucleotide
gagccatccgcccgcaccgtaattcacctcatgtaa

SEQ ID NO: 8270 - DNA, 35 bp, Artificial Sequence
  Synthetic oligonucleotide
gcccctccctcatggctacgccccggtacctacac

SEQ ID NO: 8271 - DNA, 35 bp, Artificial Sequence
  Synthetic oligonucleotide
tcccgactcggccaccatgcaagctctccaatcca

SEQ ID NO: 8272 - DNA, 35 bp, Artificial Sequence
  Synthetic oligonucleotide
taatccacgtcacatcccgccgccattccgaccac

SEQ ID NO: 8273 - DNA, 35 bp, Artificial Sequence
  Synthetic oligonucleotide
gagaaggtggtggaaagggcggggagcgagcggag

SEQ ID NO: 8274 - DNA, 35 bp, Artificial Sequence
  Synthetic oligonucleotide
acgtcctccttcacgtgtttcctccgccccctccg

SEQ ID NO: 8275 - DNA, 37 bp, Artificial Sequence
  Synthetic oligonucleotide
ttagcatgtgcctgttcctacttatgcccttttgtga

SEQ ID NO: 8276 - DNA, 35 bp, Artificial Sequence
  Synthetic oligonucleotide
gagcaccacttcgctccagagcctcccctccccga

SEQ ID NO: 8277 - DNA, 35 bp, Artificial Sequence
  Synthetic oligonucleotide
tcactgcacgcgcgaacattctcctgcaacttttt

SEQ ID NO: 8278 - DNA, 38 bp, Artificial Sequence
  Synthetic oligonucleotide
gcaaggggagggttaagggaatcggaggtaacggttga

SEQ ID NO: 8279 - DNA, 35 bp, Artificial Sequence
  Synthetic oligonucleotide
acagccacctcatcccgatgattgccctacgccca

SEQ ID NO: 8280 - DNA, 37 bp, Artificial Sequence
  Synthetic oligonucleotide
gctgcattcactcctgtacgatcgccgccttcctcga

SEQ ID NO: 8281 - DNA, 35 bp, Artificial Sequence
  Synthetic oligonucleotide
tctcacgtgacagtcctccgcctattgttcccgct

SEQ ID NO: 8282 - DNA, 36 bp, Artificial Sequence
  Synthetic oligonucleotide
tcgcccacccttctccgtcttgtcgctacacgttaa

SEQ ID NO: 8283 - DNA, 35 bp, Artificial Sequence
  Synthetic oligonucleotide
tgtctccggaggccactccctgttccatgcatttc

SEQ ID NO: 8284 - DNA, 37 bp, Artificial Sequence
  Synthetic oligonucleotide
gacagtgcggatccgtctctgcaccattttcacccga

SEQ ID NO: 8285 - DNA, 35 bp, Artificial Sequence
  Synthetic oligonucleotide
atcccgcacccatctaacttaagttatcgacacac

SEQ ID NO: 8286 - DNA, 35 bp, Artificial Sequence
  Synthetic oligonucleotide
tacgatgctcccgtacgttctgtccagcactttca

SEQ ID NO: 8287 - DNA, 37 bp, Artificial Sequence
  Synthetic oligonucleotide
tcagagcccgcccacattcgcataactctcgtctcga

SEQ ID NO: 8288 - DNA, 36 bp, Artificial Sequence
  Synthetic oligonucleotide
accacccctacatgtgaacatcatcaactgtcctga

SEQ ID NO: 8289 - DNA, 36 bp, Artificial Sequence
  Synthetic oligonucleotide
gactgtccgaccccgatgtacctgcccctttcgcga

SEQ ID NO: 8290 - DNA, 37 bp, Artificial Sequence
  Synthetic oligonucleotide
aacgggaaggggtggggtacattagggaccattggga

SEQ ID NO: 8291 - DNA, 35 bp, Artificial Sequence
  Synthetic oligonucleotide
attacccaccgctcttcggaagccacactcaccgc

SEQ ID NO: 8292 - DNA, 35 bp, Artificial Sequence
  Synthetic oligonucleotide
agtccgccgtacccgtctcaatccttcgagcccgc

SEQ ID NO: 8293 - DNA, 36 bp, Artificial Sequence
  Synthetic oligonucleotide
aaccaccagtaacttccgtaaggaggccataccaca

SEQ ID NO: 8294 - DNA, 37 bp, Artificial Sequence
  Synthetic oligonucleotide
tgcccacaatgccctcaaccgtgctgcttcccttgga

SEQ ID NO: 8295 - DNA, 36 bp, Artificial Sequence
  Synthetic oligonucleotide
tctccaccacacttcattccgagatagggtctagca

SEQ ID NO: 8296 - DNA, 36 bp, Artificial Sequence
  Synthetic oligonucleotide
tacgcgcacgcatgcgcctcctgccattgttactta

SEQ ID NO: 8297 - DNA, 35 bp, Artificial Sequence
  Synthetic oligonucleotide
acctatgcccccccctctccaagcagagcgaaacc

SEQ ID NO: 8298 - DNA, 36 bp, Artificial Sequence
  Synthetic oligonucleotide
tacctaccgaaaggggatattgcgcccaccccccca

SEQ ID NO: 8299 - DNA, 35 bp, Artificial Sequence
  Synthetic oligonucleotide
gtgacagtcccttccagttgtggccgctctccgtc

SEQ ID NO: 8300 - DNA, 36 bp, Artificial Sequence
  Synthetic oligonucleotide
tcctccaccgtcccacgttttacgttgtcttgctta

SEQ ID NO: 8301 - DNA, 36 bp, Artificial Sequence
  Synthetic oligonucleotide
agcaacctcaactcgctatctgacacccatggctca

SEQ ID NO: 8302 - DNA, 37 bp, Artificial Sequence
  Synthetic oligonucleotide
taggaagaaggaagggcaaaatgcaacgggagtaaga

SEQ ID NO: 8303 - DNA, 35 bp, Artificial Sequence
  Synthetic oligonucleotide
tggatgagaggaatgaaggggaaggcgattgtggg

SEQ ID NO: 8304 - DNA, 35 bp, Artificial Sequence
  Synthetic oligonucleotide
gaacctgcacggttgcattcccccagtttggctta

SEQ ID NO: 8305 - DNA, 35 bp, Artificial Sequence
  Synthetic oligonucleotide
tccacctggccaaccaactataggggcgaatacgc

SEQ ID NO: 8306 - DNA, 35 bp, Artificial Sequence
  Synthetic oligonucleotide
tcgatcacctgtccgctcagttcgttctctcccgt

SEQ ID NO: 8307 - DNA, 35 bp, Artificial Sequence
  Synthetic oligonucleotide
tatgcatgacgcacctacgagttaataccctgctt

SEQ ID NO: 8308 - DNA, 37 bp, Artificial Sequence
  Synthetic oligonucleotide
gacagccttcgcctgctgccctggatcctgcccctga

SEQ ID NO: 8309 - DNA, 36 bp, Artificial Sequence
  Synthetic oligonucleotide
ggtcacacgtccttttccatcacgcacattcgcgca

SEQ ID NO: 8310 - DNA, 37 bp, Artificial Sequence
  Synthetic oligonucleotide
tgttccgccctgcatttacactttttgagtccactga

SEQ ID NO: 8311 - DNA, 35 bp, Artificial Sequence
  Synthetic oligonucleotide
gatgccaaggggggcttgagggagggtaaacaacc

SEQ ID NO: 8312 - DNA, 38 bp, Artificial Sequence
  Synthetic oligonucleotide
gccttgccacccatgccatgtctctttcagtctattga

SEQ ID NO: 8313 - DNA, 35 bp, Artificial Sequence
  Synthetic oligonucleotide
atgcctcgatttgctgccagcgatccgcccacccc

SEQ ID NO: 8314 - DNA, 37 bp, Artificial Sequence
  Synthetic oligonucleotide
atagatggaggagtgagggggggatgggacggcgtga

SEQ ID NO: 8315 - DNA, 35 bp, Artificial Sequence
  Synthetic oligonucleotide
tcacctggtccatcattcatactttcgtgcttgct

SEQ ID NO: 8316 - DNA, 35 bp, Artificial Sequence
  Synthetic oligonucleotide
tgccccccccgttgtaaagccctctacttagtatt

SEQ ID NO: 8317 - DNA, 35 bp, Artificial Sequence
  Synthetic oligonucleotide
tgccattcatcggacccttgccgtaccatatccta

SEQ ID NO: 8318 - DNA, 37 bp, Artificial Sequence
  Synthetic oligonucleotide
actcgccctccgatggcctcagcgtatcccccttcga

SEQ ID NO: 8319 - DNA, 35 bp, Artificial Sequence
  Synthetic oligonucleotide
tataccgacgtgctctgactatctgcgaaccacac

SEQ ID NO: 8320 - DNA, 35 bp, Artificial Sequence
  Synthetic oligonucleotide
gcatccgcctgtcactggctctcaggttcactgtc

SEQ ID NO: 8321 - DNA, 36 bp, Artificial Sequence
  Synthetic oligonucleotide
tcgcaattcagtcgccgtacttctcctcgttatcca

SEQ ID NO: 8322 - DNA, 35 bp, Artificial Sequence
  Synthetic oligonucleotide
tcccacctccgttctaatgcagactttccccgtca

SEQ ID NO: 8323 - DNA, 35 bp, Artificial Sequence
  Synthetic oligonucleotide
atgcgtactcagcaaaccccccctcatgctctgtt

SEQ ID NO: 8324 - DNA, 35 bp, Artificial Sequence
  Synthetic oligonucleotide
gaagtggaagacgggtgggggactgggttgggaag

SEQ ID NO: 8325 - DNA, 35 bp, Artificial Sequence
  Synthetic oligonucleotide
tacctccactgcgcaccgccccataccgacactag

SEQ ID NO: 8326 - DNA, 38 bp, Artificial Sequence
  Synthetic oligonucleotide
tccgactccccttgatcttaggtaccatccccagttga

SEQ ID NO: 8327 - DNA, 38 bp, Artificial Sequence
  Synthetic oligonucleotide
gatcaacctcatcactgctcgaaacaattcctccgtga

SEQ ID NO: 8328 - DNA, 35 bp, Artificial Sequence
  Synthetic oligonucleotide
acctccgggccactactttaacactgcttgtttcc

SEQ ID NO: 8329 - DNA, 38 bp, Artificial Sequence
  Synthetic oligonucleotide
tgccactgtcttgccattccccagccatttgcccctga

SEQ ID NO: 8330 - DNA, 36 bp, Artificial Sequence
  Synthetic oligonucleotide
aacacgccctgaacacgctctcactgtccggttaca

SEQ ID NO: 8331 - DNA, 37 bp, Artificial Sequence
  Synthetic oligonucleotide
tcacccaagcctcgtgaggcgtactacatatccacga

SEQ ID NO: 8332 - DNA, 34 bp, Artificial Sequence
  Synthetic oligonucleotide
atcactccccacttctgcaaaccgcacaggctga

SEQ ID NO: 8333 - DNA, 35 bp, Artificial Sequence
  Synthetic oligonucleotide
tgccgagccgcccacatctgccatcgctccccaaa

SEQ ID NO: 8334 - DNA, 35 bp, Artificial Sequence
  Synthetic oligonucleotide
attcatgccatcccttgccttctgttttgagcacg

SEQ ID NO: 8335 - DNA, 37 bp, Artificial Sequence
  Synthetic oligonucleotide
actgacccaagccattcgccgctcacccacatgttga

SEQ ID NO: 8336 - DNA, 35 bp, Artificial Sequence
  Synthetic oligonucleotide
tgaactcccgaccttgggcgtacgaactgtaccat

SEQ ID NO: 8337 - DNA, 37 bp, Artificial Sequence
  Synthetic oligonucleotide
gcacccctgcacttcaagccatacaggtcatttagga

SEQ ID NO: 8338 - DNA, 38 bp, Artificial Sequence
  Synthetic oligonucleotide
gtcacaccgttggtaaacgtccatccgcctctccttga

SEQ ID NO: 8339 - DNA, 35 bp, Artificial Sequence
  Synthetic oligonucleotide
tgccgatcactgtgtcctccttagtcacctcctgt

SEQ ID NO: 8340 - DNA, 37 bp, Artificial Sequence
  Synthetic oligonucleotide
acatccgaccagcaccgccccccgccagtcctggtga

SEQ ID NO: 8341 - DNA, 36 bp, Artificial Sequence
  Synthetic oligonucleotide
tacaccatgggggaggggggccgtgcggtggtggta

SEQ ID NO: 8342 - DNA, 35 bp, Artificial Sequence
  Synthetic oligonucleotide
gtcacattctcccgggcttaaagttcgtttttcac

SEQ ID NO: 8343 - DNA, 36 bp, Artificial Sequence
  Synthetic oligonucleotide
gacgggatgggaggtgtggtggggggatggaaccga

SEQ ID NO: 8344 - DNA, 36 bp, Artificial Sequence
  Synthetic oligonucleotide
gtgtaccctccgctccgaatttgcccccggttcata

SEQ ID NO: 8345 - DNA, 36 bp, Artificial Sequence
  Synthetic oligonucleotide
tgactcggcactatcgcccgctttgccttttgccac

SEQ ID NO: 8346 - DNA, 35 bp, Artificial Sequence
  Synthetic oligonucleotide
ttcctgtgcggcgctccttctcgctgtttccgcac

SEQ ID NO: 8347 - DNA, 38 bp, Artificial Sequence
  Synthetic oligonucleotide
tacacctgccactgagctagtttcttccccacttgtga

SEQ ID NO: 8348 - DNA, 35 bp, Artificial Sequence
  Synthetic oligonucleotide
acccgtagccacagggttttgtggcgttccctctc

SEQ ID NO: 8349 - DNA, 35 bp, Artificial Sequence
  Synthetic oligonucleotide
acaccccgagagctgccgcattacccatcgattct

SEQ ID NO: 8350 - DNA, 35 bp, Artificial Sequence
  Synthetic oligonucleotide
tagccatcattccaccgtcctctgattccactgta

SEQ ID NO: 8351 - DNA, 35 bp, Artificial Sequence
  Synthetic oligonucleotide
gatctgcacatgagggccttcccacttacccagcc

SEQ ID NO: 8352 - DNA, 35 bp, Artificial Sequence
  Synthetic oligonucleotide
aatcaccccgacccaggctccgtcgccccgcgacg

SEQ ID NO: 8353 - DNA, 34 bp, Artificial Sequence
  Synthetic oligonucleotide
gctacaccaccactagtgctcgctacttcttgtt

SEQ ID NO: 8354 - DNA, 36 bp, Artificial Sequence
  Synthetic oligonucleotide
gtggtgaccggctcagccctttgcaacatctctcta

SEQ ID NO: 8355 - DNA, 35 bp, Artificial Sequence
  Synthetic oligonucleotide
gttgccccccaatcccatgtgccttgtcatctggt

SEQ ID NO: 8356 - DNA, 35 bp, Artificial Sequence
  Synthetic oligonucleotide
tgagtggtggtgggagggtgtagggttcgttaaga

SEQ ID NO: 8357 - DNA, 35 bp, Artificial Sequence
  Synthetic oligonucleotide
ttagcccacctaatatgcgttatgtccgtctcatc

SEQ ID NO: 8358 - DNA, 35 bp, Artificial Sequence
  Synthetic oligonucleotide
gccacccgttcgacgttcacgcgctttcagcctag

SEQ ID NO: 8359 - DNA, 35 bp, Artificial Sequence
  Synthetic oligonucleotide
acagttggatggacggaaggggtcaaaaaggaagg

SEQ ID NO: 8360 - DNA, 34 bp, Artificial Sequence
  Synthetic oligonucleotide
gatgcgacgacccacccctacgcctggcatccct

SEQ ID NO: 8361 - DNA, 35 bp, Artificial Sequence
  Synthetic oligonucleotide
gacgccgcctcgtgccttactgcattcacccgtgc

SEQ ID NO: 8362 - DNA, 36 bp, Artificial Sequence
  Synthetic oligonucleotide
tcccacgtcgcacacgcatggtcactcgtcctccaa

SEQ ID NO: 8363 - DNA, 35 bp, Artificial Sequence
  Synthetic oligonucleotide
gccaggggggggccgggattgggtacgggtgggat

SEQ ID NO: 8364 - DNA, 35 bp, Artificial Sequence
  Synthetic oligonucleotide
atcccctgtgctcccgtcctttactggacgattct

SEQ ID NO: 8365 - DNA, 36 bp, Artificial Sequence
  Synthetic oligonucleotide
aactgccacggccgacgctccatccttcggtccata

SEQ ID NO: 8366 - DNA, 35 bp, Artificial Sequence
  Synthetic oligonucleotide
aacccgctgtaccgccaagacatatccccagcctc

SEQ ID NO: 8367 - DNA, 36 bp, Artificial Sequence
  Synthetic oligonucleotide
gcgggggaggataatggagattggagggatggtgca

SEQ ID NO: 8368 - DNA, 35 bp, Artificial Sequence
  Synthetic oligonucleotide
gacgcgctctttccatcagattcagcccatcgcct

SEQ ID NO: 8369 - DNA, 36 bp, Artificial Sequence
  Synthetic oligonucleotide
atgcacatgagtggagggaacgtgggtggtgctaaa

SEQ ID NO: 8370 - DNA, 35 bp, Artificial Sequence
  Synthetic oligonucleotide
acgttcccccgaccccgccttcaccagcaacctga

SEQ ID NO: 8371 - DNA, 35 bp, Artificial Sequence
  Synthetic oligonucleotide
gatgcccacgcctttgccggctctagtacctctct

SEQ ID NO: 8372 - DNA, 37 bp, Artificial Sequence
  Synthetic oligonucleotide
gccgggcggtgtggggggggaaaggtacacttccgga

SEQ ID NO: 8373 - DNA, 38 bp, Artificial Sequence
  Synthetic oligonucleotide
tcgtgagcgtagctttcgttccacctttctgtgcctga

SEQ ID NO: 8374 - DNA, 38 bp, Artificial Sequence
  Synthetic oligonucleotide
tgcccaccccgcctatctattgaccgtctcgcttctga

SEQ ID NO: 8375 - DNA, 35 bp, Artificial Sequence
  Synthetic oligonucleotide
acctcactgtctcatgaactttggctctcattccc

SEQ ID NO: 8376 - DNA, 35 bp, Artificial Sequence
  Synthetic oligonucleotide
gtcacccccacatcaacttgtcaccgacttccgca

SEQ ID NO: 8377 - DNA, 35 bp, Artificial Sequence
  Synthetic oligonucleotide
atcacacgccaccgaaacaccgtatggtcaaccac

SEQ ID NO: 8378 - DNA, 37 bp, Artificial Sequence
  Synthetic oligonucleotide
gattgcaccccgccacctcagcctctccataagtgga

SEQ ID NO: 8379 - DNA, 37 bp, Artificial Sequence
  Synthetic oligonucleotide
gccaccacctccgccgcctgagaatacccgacactga

SEQ ID NO: 8380 - DNA, 35 bp, Artificial Sequence
  Synthetic oligonucleotide
ggatcggtagacccgccgcccgactctcgcctttt

SEQ ID NO: 8381 - DNA, 36 bp, Artificial Sequence
  Synthetic oligonucleotide
accccgccccatctgcgactggcccatggtcaatca

SEQ ID NO: 8382 - DNA, 35 bp, Artificial Sequence
  Synthetic oligonucleotide
gacgcatcatcgctgctccttcgcgttcccttcgt

SEQ ID NO: 8383 - DNA, 36 bp, Artificial Sequence
  Synthetic oligonucleotide
tactgaacccggtcctgactacgtaatgcatttcta

SEQ ID NO: 8384 - DNA, 35 bp, Artificial Sequence
  Synthetic oligonucleotide
acaacagccttgtctggcccccgcatcacattacc

SEQ ID NO: 8385 - DNA, 35 bp, Artificial Sequence
  Synthetic oligonucleotide
gcacctacccccgccctgtaacatgaattctgggt

SEQ ID NO: 8386 - DNA, 35 bp, Artificial Sequence
  Synthetic oligonucleotide
gtgtcacggccacaacgcgaattacccgccccgcc

SEQ ID NO: 8387 - DNA, 35 bp, Artificial Sequence
  Synthetic oligonucleotide
aactacgttggccccttcacgcttggtccgccctt

SEQ ID NO: 8388 - DNA, 37 bp, Artificial Sequence
  Synthetic oligonucleotide
gaggatgtcggtggagggtaggggacgggaacgggga

SEQ ID NO: 8389 - DNA, 37 bp, Artificial Sequence
  Synthetic oligonucleotide
gatgccagccgtgtctgtatttcactcccatctgcga

SEQ ID NO: 8390 - DNA, 35 bp, Artificial Sequence
  Synthetic oligonucleotide
gccatgtcgcccggtgttcgctccgtcctgctcac

SEQ ID NO: 8391 - DNA, 36 bp, Artificial Sequence
  Synthetic oligonucleotide
actccgcttgccgttctgaactccggccccattcca

SEQ ID NO: 8392 - DNA, 38 bp, Artificial Sequence
  Synthetic oligonucleotide
gtgccctcatagcgtgtttgctccctcaccccacttga

SEQ ID NO: 8393 - DNA, 35 bp, Artificial Sequence
  Synthetic oligonucleotide
taccgatgcctgttgcctttagtcttgatcccatt

SEQ ID NO: 8394 - DNA, 37 bp, Artificial Sequence
  Synthetic oligonucleotide
acacgacgcacctcatggaatagcattaaccccccga

SEQ ID NO: 8395 - DNA, 35 bp, Artificial Sequence
  Synthetic oligonucleotide
acttttggcgcctcctgttccccgctccgtgatct

SEQ ID NO: 8396 - DNA, 35 bp, Artificial Sequence
  Synthetic oligonucleotide
actcgtagaccgtaacacacctggcttttcgaacc

SEQ ID NO: 8397 - DNA, 36 bp, Artificial Sequence
  Synthetic oligonucleotide
gacgccccctccattcggttttggcatttgacttga

SEQ ID NO: 8398 - DNA, 35 bp, Artificial Sequence
  Synthetic oligonucleotide
gtactccacgaccccgcctcccaacagtcacgtgt

SEQ ID NO: 8399 - DNA, 36 bp, Artificial Sequence
  Synthetic oligonucleotide
gtgagctcccgtcctgggcaactagcgctttttcca

SEQ ID NO: 8400 - DNA, 37 bp, Artificial Sequence
  Synthetic oligonucleotide
acccaccgctgtgccctccttgtgaaacccccagtga

SEQ ID NO: 8401 - DNA, 35 bp, Artificial Sequence
  Synthetic oligonucleotide
tcacccatgcccgtgccctatggactttacatcac

SEQ ID NO: 8402 - DNA, 35 bp, Artificial Sequence
  Synthetic oligonucleotide
tactcccgtcacttgctgatccgtgcgcccgtttc

SEQ ID NO: 8403 - DNA, 37 bp, Artificial Sequence
  Synthetic oligonucleotide
acactcacgaccccaaccccgcgactgcccacatgga

SEQ ID NO: 8404 - DNA, 35 bp, Artificial Sequence
  Synthetic oligonucleotide
gtacgcccgaactgtcccaatcgccatgcgctact

SEQ ID NO: 8405 - DNA, 36 bp, Artificial Sequence
  Synthetic oligonucleotide
tcccgcctctcgctcgcctggccttatgacatctaa

SEQ ID NO: 8406 - DNA, 36 bp, Artificial Sequence
  Synthetic oligonucleotide
ggtcgacccctgaaccaacagccactgtgctgccca

SEQ ID NO: 8407 - DNA, 37 bp, Artificial Sequence
  Synthetic oligonucleotide
tgtgccacactctagacgcgctttccatgttacgtta

SEQ ID NO: 8408 - DNA, 35 bp, Artificial Sequence
  Synthetic oligonucleotide
aagtccccagcgttgagttctctcgttccatcacc

SEQ ID NO: 8409 - DNA, 35 bp, Artificial Sequence
  Synthetic oligonucleotide
tgatccttacgaattgttatgtcgccactcctgcc

SEQ ID NO: 8410 - DNA, 38 bp, Artificial Sequence
  Synthetic oligonucleotide
gtccaccaccccgttatcctgctctgtcgtccgaggga

SEQ ID NO: 8411 - DNA, 35 bp, Artificial Sequence
  Synthetic oligonucleotide
gtgccaggacaggcgtctacctttccttatgcttt

SEQ ID NO: 8412 - DNA, 35 bp, Artificial Sequence
  Synthetic oligonucleotide
gttgctagcatgccgctcttacgtacacttcccca

SEQ ID NO: 8413 - DNA, 35 bp, Artificial Sequence
  Synthetic oligonucleotide
atccgttccccgtcacgctctcactcaacattccg

SEQ ID NO: 8414 - DNA, 35 bp, Artificial Sequence
  Synthetic oligonucleotide
acgccgaggcccccatgccactttatgtctaccct

SEQ ID NO: 8415 - DNA, 35 bp, Artificial Sequence
  Synthetic oligonucleotide
gtggttgcaatagcgcacatactgcccatctcgac

SEQ ID NO: 8416 - DNA, 35 bp, Artificial Sequence
  Synthetic oligonucleotide
atcatggggaaggggccaacggggagaggcttgtg

SEQ ID NO: 8417 - DNA, 35 bp, Artificial Sequence
  Synthetic oligonucleotide
tcactcccccggtacatcctgtgtccctcatggga

SEQ ID NO: 8418 - DNA, 35 bp, Artificial Sequence
  Synthetic oligonucleotide
tgcctatccctcatgtatagttctgccctgtaccc

SEQ ID NO: 8419 - DNA, 36 bp, Artificial Sequence
  Synthetic oligonucleotide
gacatccgccgttgcccaaacacacttttttagtca

SEQ ID NO: 8420 - DNA, 36 bp, Artificial Sequence
  Synthetic oligonucleotide
agctgaagctgccaccggccccacatacacactgca

SEQ ID NO: 8421 - DNA, 37 bp, Artificial Sequence
  Synthetic oligonucleotide
acccccagcaggccctgcttctatttacataccgtga

SEQ ID NO: 8422 - DNA, 35 bp, Artificial Sequence
  Synthetic oligonucleotide
gtgacgcactaaaacctgcccttccagaccgcacc

SEQ ID NO: 8423 - DNA, 35 bp, Artificial Sequence
  Synthetic oligonucleotide
tgtcccccaatcacaccagcggcactgactccatc

SEQ ID NO: 8424 - DNA, 36 bp, Artificial Sequence
  Synthetic oligonucleotide
acccgcaccgtccagccagcccaccgcaaccagaca

SEQ ID NO: 8425 - DNA, 37 bp, Artificial Sequence
  Synthetic oligonucleotide
gcacgcacccgaccagttgatttccctccgcgctgga

SEQ ID NO: 8426 - DNA, 35 bp, Artificial Sequence
  Synthetic oligonucleotide
actgccattgtatgcatcaagctctgccttatcct

SEQ ID NO: 8427 - DNA, 35 bp, Artificial Sequence
  Synthetic oligonucleotide
tagggggccgagatggggtggggagggggagcccc

SEQ ID NO: 8428 - DNA, 36 bp, Artificial Sequence
  Synthetic oligonucleotide
atcgaccctccctcccgatcccagacgacattacga

SEQ ID NO: 8429 - DNA, 36 bp, Artificial Sequence
  Synthetic oligonucleotide
aaagataggcgtggggaggggggagatagggccagg

SEQ ID NO: 8430 - DNA, 36 bp, Artificial Sequence
  Synthetic oligonucleotide
gtgacccatcaggccaccggtaccgaatcctcccga

SEQ ID NO: 8431 - DNA, 38 bp, Artificial Sequence
  Synthetic oligonucleotide
tcgcatccctcactccggtaggaacttgcctcacctga

SEQ ID NO: 8432 - DNA, 37 bp, Artificial Sequence
  Synthetic oligonucleotide
tctacccaccccgcagctcgacgcgtagcctgcttga

SEQ ID NO: 8433 - DNA, 35 bp, Artificial Sequence
  Synthetic oligonucleotide
atcatcccatacgtgacacggcctcatccacatag

SEQ ID NO: 8434 - DNA, 35 bp, Artificial Sequence
  Synthetic oligonucleotide
agcgtgacaccgacccccctccgtatgtgccccgt

SEQ ID NO: 8435 - DNA, 37 bp, Artificial Sequence
  Synthetic oligonucleotide
gcacgggacggggttactgaaagggcgggggactcga

SEQ ID NO: 8436 - DNA, 35 bp, Artificial Sequence
  Synthetic oligonucleotide
actgaccattcctcctacaagtgttttcagggttc

SEQ ID NO: 8437 - DNA, 37 bp, Artificial Sequence
  Synthetic oligonucleotide
gcactcacattcgtacgtaccatcactttatccgcga

SEQ ID NO: 8438 - DNA, 35 bp, Artificial Sequence
  Synthetic oligonucleotide
atctccacagttgtcgcatactccgcccgtttgcc

SEQ ID NO: 8439 - DNA, 35 bp, Artificial Sequence
  Synthetic oligonucleotide
agtgatgaaggggggaggagcggagtcagggggga

SEQ ID NO: 8440 - DNA, 35 bp, Artificial Sequence
  Synthetic oligonucleotide
atcccagcccccttgtacctgcgcttatctgattc

SEQ ID NO: 8441 - DNA, 35 bp, Artificial Sequence
  Synthetic oligonucleotide
gtctgtgcccgttccgtccgcctcacacgtccacg

SEQ ID NO: 8442 - DNA, 36 bp, Artificial Sequence
  Synthetic oligonucleotide
agagacccaggaaggggatgaaaatgccggggaaga

SEQ ID NO: 8443 - DNA, 36 bp, Artificial Sequence
  Synthetic oligonucleotide
tgccatccggtgtccctcccccgcctatcttattga

SEQ ID NO: 8444 - DNA, 34 bp, Artificial Sequence
  Synthetic oligonucleotide
gatgccccggccctcacatacctacacagctgaa

SEQ ID NO: 8445 - DNA, 35 bp, Artificial Sequence
  Synthetic oligonucleotide
tacgcgcactttaggtcttttctgtacattaccac

SEQ ID NO: 8446 - DNA, 35 bp, Artificial Sequence
  Synthetic oligonucleotide
tccatacaccttcccagaatttctatatgtgccat

SEQ ID NO: 8447 - DNA, 36 bp, Artificial Sequence
  Synthetic oligonucleotide
gccatcacatgtcctatctctgtactaacccatata

SEQ ID NO: 8448 - DNA, 35 bp, Artificial Sequence
  Synthetic oligonucleotide
gaacacccctgccgactcgtaaaacagctacatac

SEQ ID NO: 8449 - DNA, 35 bp, Artificial Sequence
  Synthetic oligonucleotide
gccaatctgtcgcgttactgtcttatttctccctg

SEQ ID NO: 8450 - DNA, 35 bp, Artificial Sequence
  Synthetic oligonucleotide
gacccacccgcaaaatcgaaatgcacgcaccctat

SEQ ID NO: 8451 - DNA, 36 bp, Artificial Sequence
  Synthetic oligonucleotide
gaccacgcatccccgtactcacgtcctctgggcaca

SEQ ID NO: 8452 - DNA, 38 bp, Artificial Sequence
  Synthetic oligonucleotide
atgcctgccctcaagccgatccctaactttcccgctga

SEQ ID NO: 8453 - DNA, 35 bp, Artificial Sequence
  Synthetic oligonucleotide
tcacagcgcctgtgactccttgtccgcctccgcct

SEQ ID NO: 8454 - DNA, 35 bp, Artificial Sequence
  Synthetic oligonucleotide
tttcgcctcatcctggctatcaacactttctggga

SEQ ID NO: 8455 - DNA, 35 bp, Artificial Sequence
  Synthetic oligonucleotide
ggtccatcctgcctggtagtaatatctcagccatt

SEQ ID NO: 8456 - DNA, 36 bp, Artificial Sequence
  Synthetic oligonucleotide
tgcacaaccttgaagccatagccgcttgccctgcca

SEQ ID NO: 8457 - DNA, 35 bp, Artificial Sequence
  Synthetic oligonucleotide
tgaccacgccattttaacgtcagcgcgaaccatca

SEQ ID NO: 8458 - DNA, 35 bp, Artificial Sequence
  Synthetic oligonucleotide
attgaccgccagtgttcgccgaatctccctggtcc

SEQ ID NO: 8459 - DNA, 35 bp, Artificial Sequence
  Synthetic oligonucleotide
tgacaaccccatattcgaccacagatccctggtac

SEQ ID NO: 8460 - DNA, 35 bp, Artificial Sequence
  Synthetic oligonucleotide
atagggccacctccactaacacagagctcttactc

SEQ ID NO: 8461 - DNA, 35 bp, Artificial Sequence
  Synthetic oligonucleotide
tcacacaccgagctgtccctctggatttttactat

SEQ ID NO: 8462 - DNA, 36 bp, Artificial Sequence
  Synthetic oligonucleotide
acagacgggtggacgggctataggggcaaggggtga

SEQ ID NO: 8463 - DNA, 35 bp, Artificial Sequence
  Synthetic oligonucleotide
ttacgcgcctcattctattctattggttctagttc

SEQ ID NO: 8464 - DNA, 38 bp, Artificial Sequence
  Synthetic oligonucleotide
tacactctggacctacctgcacactcagtactgactga

SEQ ID NO: 8465 - DNA, 35 bp, Artificial Sequence
  Synthetic oligonucleotide
gagtcacccccactatccgaatcactggactacct

SEQ ID NO: 8466 - DNA, 37 bp, Artificial Sequence
  Synthetic oligonucleotide
gcaccactctggcactttggaactcccttactacgga

SEQ ID NO: 8467 - DNA, 37 bp, Artificial Sequence
  Synthetic oligonucleotide
gatccgctccccgcaactctgccctgccactttcgga

SEQ ID NO: 8468 - DNA, 35 bp, Artificial Sequence
  Synthetic oligonucleotide
gtgagtgcgagaggggaatggggtgaaatgaaagg

SEQ ID NO: 8469 - DNA, 36 bp, Artificial Sequence
  Synthetic oligonucleotide
ggatcgactcagccgcccttcctcccgtccggccaa

SEQ ID NO: 8470 - DNA, 36 bp, Artificial Sequence
  Synthetic oligonucleotide
gtgctcacagccatctatatgccacttaatgtccta

SEQ ID NO: 8471 - DNA, 35 bp, Artificial Sequence
  Synthetic oligonucleotide
tccaccgttcccccccaaccgctagtgcatgtgcg

SEQ ID NO: 8472 - DNA, 36 bp, Artificial Sequence
  Synthetic oligonucleotide
gtctctacaccccatgccatccgacgctttaaacca

SEQ ID NO: 8473 - DNA, 35 bp, Artificial Sequence
  Synthetic oligonucleotide
gactaccactccggatacgtattcacccgtcccct

SEQ ID NO: 8474 - DNA, 36 bp, Artificial Sequence
  Synthetic oligonucleotide
aaccctcgcctctgtaaaaccatcacggaccgaata

SEQ ID NO: 8475 - DNA, 38 bp, Artificial Sequence
  Synthetic oligonucleotide
tactccctgcctcctaccgtgcacacccgcatacctga

SEQ ID NO: 8476 - DNA, 37 bp, Artificial Sequence
  Synthetic oligonucleotide
tgccaaacaccgcattgcctccgactaagacccccga

SEQ ID NO: 8477 - DNA, 35 bp, Artificial Sequence
  Synthetic oligonucleotide
accgccctccggccaattagtaacttgtcttctgc

SEQ ID NO: 8478 - DNA, 36 bp, Artificial Sequence
  Synthetic oligonucleotide
agtacgccatcggttcctcgcctgttacaactccca

SEQ ID NO: 8479 - DNA, 37 bp, Artificial Sequence
  Synthetic oligonucleotide
gccatggccacccgcctccacgcccacgctgccgtga

SEQ ID NO: 8480 - DNA, 38 bp, Artificial Sequence
  Synthetic oligonucleotide
tatgcccctccactgcgcccgcctacccacgttgttga

SEQ ID NO: 8481 - DNA, 38 bp, Artificial Sequence
  Synthetic oligonucleotide
gccatggctgtcctcaccatcgattcgagtacccctga

SEQ ID NO: 8482 - DNA, 35 bp, Artificial Sequence
  Synthetic oligonucleotide
tacgttccccgcaccaactgtttaacggtgaaacc

SEQ ID NO: 8483 - DNA, 35 bp, Artificial Sequence
  Synthetic oligonucleotide
tgccattccaccctgctgcgagacctgcatctgct

SEQ ID NO: 8484 - DNA, 37 bp, Artificial Sequence
  Synthetic oligonucleotide
atcaggcccattacctacatcgcgccctctatggaga

SEQ ID NO: 8485 - DNA, 35 bp, Artificial Sequence
  Synthetic oligonucleotide
atccatccaccgcaggccgctcatctgcatccgct

SEQ ID NO: 8486 - DNA, 36 bp, Artificial Sequence
  Synthetic oligonucleotide
gcaagaggagagagaggaaggtgatactatggggaa

SEQ ID NO: 8487 - DNA, 38 bp, Artificial Sequence
  Synthetic oligonucleotide
gggaggaaaggccggtgggagcacgagagagcgattga

SEQ ID NO: 8488 - DNA, 35 bp, Artificial Sequence
  Synthetic oligonucleotide
cccaccccactgtaggagtctcgctgccttcatcc

SEQ ID NO: 8489 - DNA, 37 bp, Artificial Sequence
  Synthetic oligonucleotide
gggtggggagattgtagtggggctggcactcagggga

SEQ ID NO: 8490 - DNA, 35 bp, Artificial Sequence
  Synthetic oligonucleotide
tacgacacctgccgccgagaatataacgaaacccg

SEQ ID NO: 8491 - DNA, 35 bp, Artificial Sequence
  Synthetic oligonucleotide
ccacaccccttcatggccaaggctctaccatcgtt

SEQ ID NO: 8492 - DNA, 37 bp, Artificial Sequence
  Synthetic oligonucleotide
tgcctgcgagcacgagcaccacacactggcccatcga

SEQ ID NO: 8493 - DNA, 37 bp, Artificial Sequence
  Synthetic oligonucleotide
tacaacgctccgatcctacgccaagcacattctgata

SEQ ID NO: 8494 - DNA, 35 bp, Artificial Sequence
  Synthetic oligonucleotide
acctcccgatcgcgagatcattcctttgtttgaaa

SEQ ID NO: 8495 - DNA, 36 bp, Artificial Sequence
  Synthetic oligonucleotide
gacacgggcatcatggagggggggttgggtcaagga

SEQ ID NO: 8496 - DNA, 38 bp, Artificial Sequence
  Synthetic oligonucleotide
atggagggtgggcgcagggaaggaggctcattaggtga

SEQ ID NO: 8497 - DNA, 35 bp, Artificial Sequence
  Synthetic oligonucleotide
agctaaccaagtccgccgtgctcgcccaccctgtc

SEQ ID NO: 8498 - DNA, 37 bp, Artificial Sequence
  Synthetic oligonucleotide
tttcccaccgcctgccagccacacctcccaatcgtga

SEQ ID NO: 8499 - DNA, 38 bp, Artificial Sequence
  Synthetic oligonucleotide
accccagcacacatcacagtaccacgcctgttccttga

SEQ ID NO: 8500 - DNA, 35 bp, Artificial Sequence
  Synthetic oligonucleotide
ttcccgacgcagacacttctccacacccctgagcc

SEQ ID NO: 8501 - DNA, 35 bp, Artificial Sequence
  Synthetic oligonucleotide
tccaccgcctgacgcttcttacggtacatctaaat

SEQ ID NO: 8502 - DNA, 35 bp, Artificial Sequence
  Synthetic oligonucleotide
tgaaccctccgtgttcctgtacctcgttcctccgt

SEQ ID NO: 8503 - DNA, 36 bp, Artificial Sequence
  Synthetic oligonucleotide
gcacggtgcagatcaaggcactcgtacttcctttca

SEQ ID NO: 8504 - DNA, 36 bp, Artificial Sequence
  Synthetic oligonucleotide
agcactccacatgcgccgttcctaccatcaccacca

SEQ ID NO: 8505 - DNA, 35 bp, Artificial Sequence
  Synthetic oligonucleotide
gccacttacccgaggttcccaccgtccatgcctgc

SEQ ID NO: 8506 - DNA, 34 bp, Artificial Sequence
  Synthetic oligonucleotide
agccagtgctgtttctcctatccagtcctttact

SEQ ID NO: 8507 - DNA, 35 bp, Artificial Sequence
  Synthetic oligonucleotide
tccccaagcgccgcaatccgttcactgccgccgac

SEQ ID NO: 8508 - DNA, 35 bp, Artificial Sequence
  Synthetic oligonucleotide
ggtgtgtcacagcgtacccactgccctttatctta

SEQ ID NO: 8509 - DNA, 36 bp, Artificial Sequence
  Synthetic oligonucleotide
accactgccagcccgttaccccaacaccagtcaccc

SEQ ID NO: 8510 - DNA, 38 bp, Artificial Sequence
  Synthetic oligonucleotide
acacctccaccacccggccagcaccccgctccagctga

SEQ ID NO: 8511 - DNA, 36 bp, Artificial Sequence
  Synthetic oligonucleotide
gcgatcgacctccgagcgtgccctccctgaccaata

SEQ ID NO: 8512 - DNA, 36 bp, Artificial Sequence
  Synthetic oligonucleotide
gcacgccgtccccatttggtctttatgttctgcgca

SEQ ID NO: 8513 - DNA, 37 bp, Artificial Sequence
  Synthetic oligonucleotide
gtgggaggtggaaagtggttggaaagtggatgcggga

SEQ ID NO: 8514 - DNA, 34 bp, Artificial Sequence
  Synthetic oligonucleotide
gctactcctccggcgccatgagctctccccccta

SEQ ID NO: 8515 - DNA, 35 bp, Artificial Sequence
  Synthetic oligonucleotide
taaaatggccacatggatcgtaactagcacccccc

SEQ ID NO: 8516 - DNA, 38 bp, Artificial Sequence
  Synthetic oligonucleotide
agctccccatccgacgcgaatcctggatccctctctga

SEQ ID NO: 8517 - DNA, 35 bp, Artificial Sequence
  Synthetic oligonucleotide
atccgccagtcctcatttaaccacgcgttcgaacc

SEQ ID NO: 8518 - DNA, 35 bp, Artificial Sequence
  Synthetic oligonucleotide
tgtagcatcgaatacccttaccctggacctgctgc

SEQ ID NO: 8519 - DNA, 37 bp, Artificial Sequence
  Synthetic oligonucleotide
tgtaccaccccgaactccgcttcagctttcgccccga

SEQ ID NO: 8520 - DNA, 35 bp, Artificial Sequence
  Synthetic oligonucleotide
gtacatccccaacaggactatttcaccgccttgcg

SEQ ID NO: 8521 - DNA, 35 bp, Artificial Sequence
  Synthetic oligonucleotide
gcccctcccttagcttgcgaagcccatcttcgccc

SEQ ID NO: 8522 - DNA, 35 bp, Artificial Sequence
  Synthetic oligonucleotide
gtcgccaccgaatagttttgccttggttgcctcct

SEQ ID NO: 8523 - DNA, 35 bp, Artificial Sequence
  Synthetic oligonucleotide
gttcgccacgtcaagcactccgccaccagttcacc

SEQ ID NO: 8524 - DNA, 35 bp, Artificial Sequence
  Synthetic oligonucleotide
gctctgcacgacgcaactcacctggttctctctcg

SEQ ID NO: 8525 - DNA, 35 bp, Artificial Sequence
  Synthetic oligonucleotide
gcattacacccttgccggcccgtgacatcctgccc

SEQ ID NO: 8526 - DNA, 35 bp, Artificial Sequence
  Synthetic oligonucleotide
gatgcttagccacccattgtacatatagccccaca

SEQ ID NO: 8527 - DNA, 35 bp, Artificial Sequence
  Synthetic oligonucleotide
tcctccgcctccactcgatataaaccagctgaatg

SEQ ID NO: 8528 - DNA, 35 bp, Artificial Sequence
  Synthetic oligonucleotide
gccggggaaaggggggcataaatgaggtagaactg

SEQ ID NO: 8529 - DNA, 35 bp, Artificial Sequence
  Synthetic oligonucleotide
tagtatctcaccccctgcccgactccacatggttt

SEQ ID NO: 8530 - DNA, 37 bp, Artificial Sequence
  Synthetic oligonucleotide
tcaggagcaggaggaagggtgacggatggcgcaggga

SEQ ID NO: 8531 - DNA, 35 bp, Artificial Sequence
  Synthetic oligonucleotide
actaactccgccgacccgaattcgtacgttacctt

SEQ ID NO: 8532 - DNA, 35 bp, Artificial Sequence
  Synthetic oligonucleotide
atccacatccattgcatatactgtcactggacatt

SEQ ID NO: 8533 - DNA, 35 bp, Artificial Sequence
  Synthetic oligonucleotide
ttcccgacccgccgcctatattcgcaggattcatt

SEQ ID NO: 8534 - DNA, 35 bp, Artificial Sequence
  Synthetic oligonucleotide
tgctgggagcagctgttgtttcctctctgctcatc

SEQ ID NO: 8535 - DNA, 38 bp, Artificial Sequence
  Synthetic oligonucleotide
tcaccagcccttatggtacatctgccctctgtccctga

SEQ ID NO: 8536 - DNA, 35 bp, Artificial Sequence
  Synthetic oligonucleotide
ggggaaggggaaatggtcggagaataggtgcggta

SEQ ID NO: 8537 - DNA, 35 bp, Artificial Sequence
  Synthetic oligonucleotide
tccacagggaaccttgtattagtcgctctttatta

SEQ ID NO: 8538 - DNA, 35 bp, Artificial Sequence
  Synthetic oligonucleotide
acatgcagtggccaggcctccttcttgttcctgtt

SEQ ID NO: 8539 - DNA, 35 bp, Artificial Sequence
  Synthetic oligonucleotide
gtgtcgcctccgccctctcagtatacccactacac

SEQ ID NO: 8540 - DNA, 35 bp, Artificial Sequence
  Synthetic oligonucleotide
ttattcgtcgccccaccccagtctggcgcctattc

SEQ ID NO: 8541 - DNA, 36 bp, Artificial Sequence
  Synthetic oligonucleotide
atcccattgccgttgttactcccgtgcgtgctagca

SEQ ID NO: 8542 - DNA, 35 bp, Artificial Sequence
  Synthetic oligonucleotide
ttacgtcaggtccccgttgcgctccccccatgcct

SEQ ID NO: 8543 - DNA, 37 bp, Artificial Sequence
  Synthetic oligonucleotide
accacttagcgtacaccttgccttttcgccctttaga

SEQ ID NO: 8544 - DNA, 35 bp, Artificial Sequence
  Synthetic oligonucleotide
acctcatgtacccagcctctgaaccctttattttg

SEQ ID NO: 8545 - DNA, 38 bp, Artificial Sequence
  Synthetic oligonucleotide
agcaacaccaatggtacaccgtttctcgtttttcttga

SEQ ID NO: 8546 - DNA, 35 bp, Artificial Sequence
  Synthetic oligonucleotide
tccatcacgcctacccctacacgatgttccaacgt

SEQ ID NO: 8547 - DNA, 36 bp, Artificial Sequence
  Synthetic oligonucleotide
tcacacgccgcccacctactccagagccatgctaaa

SEQ ID NO: 8548 - DNA, 37 bp, Artificial Sequence
  Synthetic oligonucleotide
tgcaaccttacgatcgcggctgtagcttctctctgga

SEQ ID NO: 8549 - DNA, 35 bp, Artificial Sequence
  Synthetic oligonucleotide
gaatccccgccaccagccacctatttatgctttag

SEQ ID NO: 8550 - DNA, 35 bp, Artificial Sequence
  Synthetic oligonucleotide
tacgccccgccaagtaacggagcctttgatcctct

SEQ ID NO: 8551 - DNA, 35 bp, Artificial Sequence
  Synthetic oligonucleotide
actgggtcggggaggcatggggttcgcgggtgtgg

SEQ ID NO: 8552 - DNA, 35 bp, Artificial Sequence
  Synthetic oligonucleotide
tagaccgtcaagacctggtaaacccatctctcatc

SEQ ID NO: 8553 - DNA, 36 bp, Artificial Sequence
  Synthetic oligonucleotide
accgccctggctcataccgacatatcgaccatacca

SEQ ID NO: 8554 - DNA, 36 bp, Artificial Sequence
  Synthetic oligonucleotide
acattgccatccgtgggctcttttatcatagttaca

SEQ ID NO: 8555 - DNA, 35 bp, Artificial Sequence
  Synthetic oligonucleotide
acacgcgcattccaggctaccgttaactccactct

SEQ ID NO: 8556 - DNA, 36 bp, Artificial Sequence
  Synthetic oligonucleotide
acagccactccttcatgcgcgctacttccgaattga

SEQ ID NO: 8557 - DNA, 35 bp, Artificial Sequence
  Synthetic oligonucleotide
gcttgctccagtctgccttccaactccagccaccc

SEQ ID NO: 8558 - DNA, 35 bp, Artificial Sequence
  Synthetic oligonucleotide
gcagagccaagcacactgtcaccgatttacccttt

SEQ ID NO: 8559 - DNA, 36 bp, Artificial Sequence
  Synthetic oligonucleotide
gccgaccttcgttttgtcatgtcatctctgccggaa

SEQ ID NO: 8560 - DNA, 36 bp, Artificial Sequence
  Synthetic oligonucleotide
accacctcgctgtagtacgtgacgcccgtctctcta

SEQ ID NO: 8561 - DNA, 35 bp, Artificial Sequence
  Synthetic oligonucleotide
aacccgcccaccacttcaccgctgtccacgccaaa

SEQ ID NO: 8562 - DNA, 35 bp, Artificial Sequence
  Synthetic oligonucleotide
gtcggtgcaatcgaatacgacctccactccttgcc

SEQ ID NO: 8563 - DNA, 35 bp, Artificial Sequence
  Synthetic oligonucleotide
taccggccatcccccccttcgaacgttctgcctat

SEQ ID NO: 8564 - DNA, 35 bp, Artificial Sequence
  Synthetic oligonucleotide
accgaaccccggatctctccacagaacatgcttgg

SEQ ID NO: 8565 - DNA, 35 bp, Artificial Sequence
  Synthetic oligonucleotide
ttgtgcatgctccctatgctctttacctctcactg

SEQ ID NO: 8566 - DNA, 36 bp, Artificial Sequence
  Synthetic oligonucleotide
atgccacccacgtagtctggacattctcaacccaca

SEQ ID NO: 8567 - DNA, 37 bp, Artificial Sequence
  Synthetic oligonucleotide
atgtgccaagcggtaagggaaaatgggagggtgagga

SEQ ID NO: 8568 - DNA, 36 bp, Artificial Sequence
  Synthetic oligonucleotide
gactcgccatcgggcttatgacaccctccgtctcca

SEQ ID NO: 8569 - DNA, 38 bp, Artificial Sequence
  Synthetic oligonucleotide
atcctgcaaccgcaacaccattatgcccaggtccttga

SEQ ID NO: 8570 - DNA, 37 bp, Artificial Sequence
  Synthetic oligonucleotide
gagggagtagggaaagaacgaggtaaaaaaggaacga

SEQ ID NO: 8571 - DNA, 37 bp, Artificial Sequence
  Synthetic oligonucleotide
gccgcccttctcgcgtactacgacctatctaccctga

SEQ ID NO: 8572 - DNA, 35 bp, Artificial Sequence
  Synthetic oligonucleotide
tgataccaccgtccggtctaactcttctggtcttc

SEQ ID NO: 8573 - DNA, 35 bp, Artificial Sequence
  Synthetic oligonucleotide
gcacagttcaacgattcgccacctccgccactgcg

SEQ ID NO: 8574 - DNA, 35 bp, Artificial Sequence
  Synthetic oligonucleotide
gcaccaagtccaaccgcattgacgctcgtactcct

SEQ ID NO: 8575 - DNA, 35 bp, Artificial Sequence
  Synthetic oligonucleotide
ttcctcacgcctctcaactgctcgtaggatctcac

SEQ ID NO: 8576 - DNA, 35 bp, Artificial Sequence
  Synthetic oligonucleotide
tgtcacccagcacttttcttatagcccgttattcc

SEQ ID NO: 8577 - DNA, 36 bp, Artificial Sequence
  Synthetic oligonucleotide
actacgtcgcacgaggccctccagttccccatctca

SEQ ID NO: 8578 - DNA, 38 bp, Artificial Sequence
  Synthetic oligonucleotide
caccacctctgtgcagagactttaggcgcaccccctga

SEQ ID NO: 8579 - DNA, 38 bp, Artificial Sequence
  Synthetic oligonucleotide
aaccaccaccttcgtgacgctatgggaactctccgtga

SEQ ID NO: 8580 - DNA, 36 bp, Artificial Sequence
  Synthetic oligonucleotide
gcctacgctccatccggttcatgatcgcgtccccca

SEQ ID NO: 8581 - DNA, 37 bp, Artificial Sequence
  Synthetic oligonucleotide
tccccatgtccatcttcctcacgcccagtcggtatga

SEQ ID NO: 8582 - DNA, 38 bp, Artificial Sequence
  Synthetic oligonucleotide
acgactcccgacgcatgccctctaaccccaccacgtga

SEQ ID NO: 8583 - DNA, 35 bp, Artificial Sequence
  Synthetic oligonucleotide
atttcctgccttcccagcctcctgtcacgaacacc

SEQ ID NO: 8584 - DNA, 35 bp, Artificial Sequence
  Synthetic oligonucleotide
tacccgccttgtggtgcccaccctgttcccgcccg

SEQ ID NO: 8585 - DNA, 35 bp, Artificial Sequence
  Synthetic oligonucleotide
acagtgccgcccgacgcttcatatccttgttactt

SEQ ID NO: 8586 - DNA, 38 bp, Artificial Sequence
  Synthetic oligonucleotide
tcgaggtggggagtgggtggcatgcaagtacggggtga

SEQ ID NO: 8587 - DNA, 35 bp, Artificial Sequence
  Synthetic oligonucleotide
attgacggactgccctggtaagccatccccgcctt

SEQ ID NO: 8588 - DNA, 38 bp, Artificial Sequence
  Synthetic oligonucleotide
ttcagcctagccctcactctgcctgctcgaatccgtga

SEQ ID NO: 8589 - DNA, 35 bp, Artificial Sequence
  Synthetic oligonucleotide
tcgatccaccgtggctacatcccgcttaactcgtt

SEQ ID NO: 8590 - DNA, 35 bp, Artificial Sequence
  Synthetic oligonucleotide
tcatcacgacctcgtacatcagtccaccaaattat

SEQ ID NO: 8591 - DNA, 37 bp, Artificial Sequence
  Synthetic oligonucleotide
ttagccctgctcctgctcccatttgcagtcctattga

SEQ ID NO: 8592 - DNA, 37 bp, Artificial Sequence
  Synthetic oligonucleotide
tccacctagcatccgctgccgcatatacattttttga

SEQ ID NO: 8593 - DNA, 35 bp, Artificial Sequence
  Synthetic oligonucleotide
actttaacccgcgcacttgcgtatcccccgcccac

SEQ ID NO: 8594 - DNA, 36 bp, Artificial Sequence
  Synthetic oligonucleotide
tacgacctcatcacgcattctcatgagttaccatga

SEQ ID NO: 8595 - DNA, 35 bp, Artificial Sequence
  Synthetic oligonucleotide
agaccccgtaactctgccggtttccccttgttcaa

SEQ ID NO: 8596 - DNA, 38 bp, Artificial Sequence
  Synthetic oligonucleotide
tgtacgacaccggcaccccacccgaccacaagtcatga

SEQ ID NO: 8597 - DNA, 35 bp, Artificial Sequence
  Synthetic oligonucleotide
gccctcctgcctccgaggcgtgccacgtacacgcc

SEQ ID NO: 8598 - DNA, 35 bp, Artificial Sequence
  Synthetic oligonucleotide
tccgtcagactccattccgccgtgagttcctggtt

SEQ ID NO: 8599 - DNA, 36 bp, Artificial Sequence
  Synthetic oligonucleotide
tatgccacctgtgcgcctctgaactgccaatttcga

SEQ ID NO: 8600 - DNA, 36 bp, Artificial Sequence
  Synthetic oligonucleotide
gacgtgttccgtcgggcttctaatctgctctcttca

SEQ ID NO: 8601 - DNA, 37 bp, Artificial Sequence
  Synthetic oligonucleotide
gaacgccacgcagtcaactttgcatctctcatttgga

SEQ ID NO: 8602 - DNA, 35 bp, Artificial Sequence
  Synthetic oligonucleotide
gttccccacttacctttgtctttaccaggcattgc

SEQ ID NO: 8603 - DNA, 36 bp, Artificial Sequence
  Synthetic oligonucleotide
gccccaccccctccgtatgacccgctgcccagttaa

SEQ ID NO: 8604 - DNA, 37 bp, Artificial Sequence
  Synthetic oligonucleotide
atgcttcgagggtgggaaggggcataggggtggttga

SEQ ID NO: 8605 - DNA, 36 bp, Artificial Sequence
  Synthetic oligonucleotide
tgcccttgcctaccagttcctagtcgcctaccttca

SEQ ID NO: 8606 - DNA, 38 bp, Artificial Sequence
  Synthetic oligonucleotide
gcgatgggtgggggggactaggacgatgggcacgctga

SEQ ID NO: 8607 - DNA, 35 bp, Artificial Sequence
  Synthetic oligonucleotide
tcccactccgactcccgatcgggttttctggttta

SEQ ID NO: 8608 - DNA, 35 bp, Artificial Sequence
  Synthetic oligonucleotide
tacgcactctcgttctggccattcactgacgttac

SEQ ID NO: 8609 - DNA, 38 bp, Artificial Sequence
  Synthetic oligonucleotide
tcagcccccaatcgttttctgtccgtctcgtcgtttga

SEQ ID NO: 8610 - DNA, 36 bp, Artificial Sequence
  Synthetic oligonucleotide
gtccaagaagggggtaaggaggaattggtagggaca

SEQ ID NO: 8611 - DNA, 35 bp, Artificial Sequence
  Synthetic oligonucleotide
atccccgctacccgtccgccttcttaatataccag

SEQ ID NO: 8612 - DNA, 35 bp, Artificial Sequence
  Synthetic oligonucleotide
atcctcgcaaagtgtcccctctagatgttctacca

SEQ ID NO: 8613 - DNA, 36 bp, Artificial Sequence
  Synthetic oligonucleotide
gtggtggcatctgccttgtccacccatgttcttgta

SEQ ID NO: 8614 - DNA, 35 bp, Artificial Sequence
  Synthetic oligonucleotide
tccaacaacgtgcactggcctccttttcgttctgt

SEQ ID NO: 8615 - DNA, 36 bp, Artificial Sequence
  Synthetic oligonucleotide
gccgaatcgcgggtaggagagggtgggcggtaaaga

SEQ ID NO: 8616 - DNA, 35 bp, Artificial Sequence
  Synthetic oligonucleotide
tactcctatcatccgtgccacccgccctccaagat

SEQ ID NO: 8617 - DNA, 35 bp, Artificial Sequence
  Synthetic oligonucleotide
tgtccaccatccgccaggtactcataactcctatc

SEQ ID NO: 8618 - DNA, 35 bp, Artificial Sequence
  Synthetic oligonucleotide
tcttaccgccgcagagacaattacctccgcccgcg

SEQ ID NO: 8619 - DNA, 35 bp, Artificial Sequence
  Synthetic oligonucleotide
tcctgctagcacagctcctatggtcccacctcttt

SEQ ID NO: 8620 - DNA, 37 bp, Artificial Sequence
  Synthetic oligonucleotide
tgccaacccaacatgtcgctttctcaattccgacgga

SEQ ID NO: 8621 - DNA, 35 bp, Artificial Sequence
  Synthetic oligonucleotide
accgcacccccgccaaaggactcgtttgttccacg

SEQ ID NO: 8622 - DNA, 35 bp, Artificial Sequence
  Synthetic oligonucleotide
gactaccgcttggccttctgtaacgttgctgcccg

SEQ ID NO: 8623 - DNA, 36 bp, Artificial Sequence
  Synthetic oligonucleotide
gcaccactgctcagcccctatccgccgacgccctga

SEQ ID NO: 8624 - DNA, 36 bp, Artificial Sequence
  Synthetic oligonucleotide
tcgcacattcatcatctggtcctgctgcctccacca

SEQ ID NO: 8625 - DNA, 35 bp, Artificial Sequence
  Synthetic oligonucleotide
atgtgtacgccacacccttttcgttacatgacaca

SEQ ID NO: 8626 - DNA, 35 bp, Artificial Sequence
  Synthetic oligonucleotide
tcgtgagacggccggcttcttaccacacacttcat

SEQ ID NO: 8627 - DNA, 35 bp, Artificial Sequence
  Synthetic oligonucleotide
gatgtacatccatccgtgtcccctgctactctgtc

SEQ ID NO: 8628 - DNA, 36 bp, Artificial Sequence
  Synthetic oligonucleotide
tgcttaacaccctcggaagtttctcagcccccctca

SEQ ID NO: 8629 - DNA, 35 bp, Artificial Sequence
  Synthetic oligonucleotide
atcccccccactgtgtggtacttggtctttgacga

SEQ ID NO: 8630 - DNA, 38 bp, Artificial Sequence
  Synthetic oligonucleotide
gcccttccgccaagatctgacccgaactcgcaccctga

SEQ ID NO: 8631 - DNA, 35 bp, Artificial Sequence
  Synthetic oligonucleotide
tcccagcctcgctgctaattctctgtggttctggc

SEQ ID NO: 8632 - DNA, 37 bp, Artificial Sequence
  Synthetic oligonucleotide
acactcacctccacgcttgatcatgacagtttaagga

SEQ ID NO: 8633 - DNA, 35 bp, Artificial Sequence
  Synthetic oligonucleotide
acagttcaccgtgctttttgcgctcatcttacgaa

SEQ ID NO: 8634 - DNA, 36 bp, Artificial Sequence
  Synthetic oligonucleotide
agtgtggggggatgaacgtggaagcggagaatgaga

SEQ ID NO: 8635 - DNA, 36 bp, Artificial Sequence
  Synthetic oligonucleotide
gaagcggagcttcgcaccatgtcccgtaacccccta

SEQ ID NO: 8636 - DNA, 35 bp, Artificial Sequence
  Synthetic oligonucleotide
ttggcatatgccattgcctcgatctccccagccac

SEQ ID NO: 8637 - DNA, 37 bp, Artificial Sequence
  Synthetic oligonucleotide
gcttcaccacgccctcttgttcttgtcaccaccgaga

SEQ ID NO: 8638 - DNA, 35 bp, Artificial Sequence
  Synthetic oligonucleotide
tgcaccccaatatgcgtgcgttacactcaactcca

SEQ ID NO: 8639 - DNA, 35 bp, Artificial Sequence
  Synthetic oligonucleotide
gccggtaccaccaatgcacgttcccgtcctcgcta

SEQ ID NO: 8640 - DNA, 35 bp, Artificial Sequence
  Synthetic oligonucleotide
tacatgccttcatcgttacagacccagttgtcctc

SEQ ID NO: 8641 - DNA, 35 bp, Artificial Sequence
  Synthetic oligonucleotide
acatcgcaagcctccactcgcgttccggtcttatt

SEQ ID NO: 8642 - DNA, 35 bp, Artificial Sequence
  Synthetic oligonucleotide
gatgcttcccatcgcctccattccgtagtgctgct

SEQ ID NO: 8643 - DNA, 37 bp, Artificial Sequence
  Synthetic oligonucleotide
gtaccacctcctctgctatccaaaggatctgccccga

SEQ ID NO: 8644 - DNA, 36 bp, Artificial Sequence
  Synthetic oligonucleotide
gcactgtcaccggacgccctgtttcatctcccacca

SEQ ID NO: 8645 - DNA, 35 bp, Artificial Sequence
  Synthetic oligonucleotide
acctgactgtccccatgaggttcgcatattcaatc

SEQ ID NO: 8646 - DNA, 37 bp, Artificial Sequence
  Synthetic oligonucleotide
acacgcacgttaggggaaggagggtggggatagagga

SEQ ID NO: 8647 - DNA, 38 bp, Artificial Sequence
  Synthetic oligonucleotide
gcgtagcaccccctacctgccccagtgcactcatgtga

SEQ ID NO: 8648 - DNA, 36 bp, Artificial Sequence
  Synthetic oligonucleotide
gtgacgacgacatgagggaggaggaagggaagggga

SEQ ID NO: 8649 - DNA, 35 bp, Artificial Sequence
  Synthetic oligonucleotide
tgtgaccagggggggatacgggcggggacttggca

SEQ ID NO: 8650 - DNA, 35 bp, Artificial Sequence
  Synthetic oligonucleotide
ttcgccaattggccatgtttccctcctcgtggtga

SEQ ID NO: 8651 - DNA, 35 bp, Artificial Sequence
  Synthetic oligonucleotide
tagagacccgacctatccgtttgtcacagtccacc

SEQ ID NO: 8652 - DNA, 35 bp, Artificial Sequence
  Synthetic oligonucleotide
tcacttgctacacgagttcggggccccgctttttc

SEQ ID NO: 8653 - DNA, 36 bp, Artificial Sequence
  Synthetic oligonucleotide
gcccccagcctcatacatctggctgtacattttcca

SEQ ID NO: 8654 - DNA, 34 bp, Artificial Sequence
  Synthetic oligonucleotide
tctgtcgccggaccttcggtacctactgctttac

SEQ ID NO: 8655 - DNA, 35 bp, Artificial Sequence
  Synthetic oligonucleotide
tcgatgcccactgctggtttccactacttaatttt

SEQ ID NO: 8656 - DNA, 35 bp, Artificial Sequence
  Synthetic oligonucleotide
gcgcacactgccctacgccgaccccaaggccgagc

SEQ ID NO: 8657 - DNA, 35 bp, Artificial Sequence
  Synthetic oligonucleotide
ggtcgatgcggtggggggaaaaggggaaactaggt

SEQ ID NO: 8658 - DNA, 35 bp, Artificial Sequence
  Synthetic oligonucleotide
gctggaggagttgaatgaatgtgggtgttgtgggg

SEQ ID NO: 8659 - DNA, 38 bp, Artificial Sequence
  Synthetic oligonucleotide
ttgcccccctctgcccgtcttttccaggctgcctttga

SEQ ID NO: 8660 - DNA, 36 bp, Artificial Sequence
  Synthetic oligonucleotide
ggattacgcagggctgggtgggctgggggagggaaa

SEQ ID NO: 8661 - DNA, 37 bp, Artificial Sequence
  Synthetic oligonucleotide
tacgcaacactgcttattgagttacccatccccccga

SEQ ID NO: 8662 - DNA, 35 bp, Artificial Sequence
  Synthetic oligonucleotide
tctacgccccacttccgaatagactccatgctcat

SEQ ID NO: 8663 - DNA, 36 bp, Artificial Sequence
  Synthetic oligonucleotide
tgacacggccccgattgtaccgtgcaaccaatacta

SEQ ID NO: 8664 - DNA, 33 bp, Artificial Sequence
  Synthetic oligonucleotide
agtgcacagctgctgcatcctcatcgccctcca

SEQ ID NO: 8665 - DNA, 38 bp, Artificial Sequence
  Synthetic oligonucleotide
acgctgggtggggttgaaaggctaagggtggaggatga

SEQ ID NO: 8666 - DNA, 36 bp, Artificial Sequence
  Synthetic oligonucleotide
gtgacatctacactcacttaatgcctgtccacccca

SEQ ID NO: 8667 - DNA, 35 bp, Artificial Sequence
  Synthetic oligonucleotide
atcagtccgcctgtgcaatttcgtggccttcctca

SEQ ID NO: 8668 - DNA, 36 bp, Artificial Sequence
  Synthetic oligonucleotide
acaacgcgcggtcttctttgctcacctgtttgtcaa

SEQ ID NO: 8669 - DNA, 38 bp, Artificial Sequence
  Synthetic oligonucleotide
taccaccccatatatgtagccccttcagttcgacgtga

SEQ ID NO: 8670 - DNA, 37 bp, Artificial Sequence
  Synthetic oligonucleotide
tcagccccgctgctacataatcccgctcctcttggga

SEQ ID NO: 8671 - DNA, 37 bp, Artificial Sequence
  Synthetic oligonucleotide
gaacaaagaatgaggggatggagcggggtactggtga

SEQ ID NO: 8672 - DNA, 35 bp, Artificial Sequence
  Synthetic oligonucleotide
gtcgatgtccactgttcacttctttacgccctgca

SEQ ID NO: 8673 - DNA, 35 bp, Artificial Sequence
  Synthetic oligonucleotide
tctagcacctcgcagccatctccacgtcgtaaccc

SEQ ID NO: 8674 - DNA, 36 bp, Artificial Sequence
  Synthetic oligonucleotide
ggacaccaacagctctgctatgtcctacacttcgta

SEQ ID NO: 8675 - DNA, 36 bp, Artificial Sequence
  Synthetic oligonucleotide
acgccccatacatcctggcacagaaagaccttacaa

SEQ ID NO: 8676 - DNA, 35 bp, Artificial Sequence
  Synthetic oligonucleotide
gccacgacaaaaccctgttatcattgccgacctgc

SEQ ID NO: 8677 - DNA, 35 bp, Artificial Sequence
  Synthetic oligonucleotide
tgcccatgtacctgcttcttgtactctgttctgcc

SEQ ID NO: 8678 - DNA, 37 bp, Artificial Sequence
  Synthetic oligonucleotide
tcaagcggacgatgattaaccccgcccgttaccccta

SEQ ID NO: 8679 - DNA, 35 bp, Artificial Sequence
  Synthetic oligonucleotide
gccaccccctgcttttcaatgtctacgtcctcttg

SEQ ID NO: 8680 - DNA, 35 bp, Artificial Sequence
  Synthetic oligonucleotide
ttgcgcaccgctatgggcccttcgtctcagctccc

SEQ ID NO: 8681 - DNA, 35 bp, Artificial Sequence
  Synthetic oligonucleotide
tcaaccccgatactgccactttcccgatgctcatg

SEQ ID NO: 8682 - DNA, 35 bp, Artificial Sequence
  Synthetic oligonucleotide
tgcgacactcaccttgcttctcctgcgttaactgg

SEQ ID NO: 8683 - DNA, 37 bp, Artificial Sequence
  Synthetic oligonucleotide
gactgacgcgtggcgggaaaggggggttgggttgaga

SEQ ID NO: 8684 - DNA, 36 bp, Artificial Sequence
  Synthetic oligonucleotide
tgacccactgcgctttctgacatatgcccctcccga

SEQ ID NO: 8685 - DNA, 35 bp, Artificial Sequence
  Synthetic oligonucleotide
acgaagagccgggtgggagggacgcgtcgtgggat

SEQ ID NO: 8686 - DNA, 35 bp, Artificial Sequence
  Synthetic oligonucleotide
gccacagtcaaccactccatccgacacctgtgcga

SEQ ID NO: 8687 - DNA, 36 bp, Artificial Sequence
  Synthetic oligonucleotide
ttgagcgctggctcgtttctctccgccgaacaacta

SEQ ID NO: 8688 - DNA, 38 bp, Artificial Sequence
  Synthetic oligonucleotide
gcccaccacccgtacgaagcccaatctatcagccttga

SEQ ID NO: 8689 - DNA, 35 bp, Artificial Sequence
  Synthetic oligonucleotide
attcgcctcggtcctccaattgtaatcgcctctgc

SEQ ID NO: 8690 - DNA, 35 bp, Artificial Sequence
  Synthetic oligonucleotide
tcacgcatcgagtaccacgcaccccctgcccaatt

SEQ ID NO: 8691 - DNA, 35 bp, Artificial Sequence
  Synthetic oligonucleotide
tcccactcgtgccggagttgcttatttcgccccca

SEQ ID NO: 8692 - DNA, 35 bp, Artificial Sequence
  Synthetic oligonucleotide
gtccactcctctgtcatgtccgacagatcgctcac

SEQ ID NO: 8693 - DNA, 35 bp, Artificial Sequence
  Synthetic oligonucleotide
aacccccgttgtgtcatcacactacctgcacaacc

SEQ ID NO: 8694 - DNA, 36 bp, Artificial Sequence
  Synthetic oligonucleotide
actgactcggtccatcagtaatcatgcccagccaca

SEQ ID NO: 8695 - DNA, 35 bp, Artificial Sequence
  Synthetic oligonucleotide
attctacgccctcccatcgcacaaaagtcgtttcc

SEQ ID NO: 8696 - DNA, 37 bp, Artificial Sequence
  Synthetic oligonucleotide
gtgacgcctccggttatctatcatctgtccatttaga

SEQ ID NO: 8697 - DNA, 37 bp, Artificial Sequence
  Synthetic oligonucleotide
tgcatcaccccacctctaataattgcactcctgtgga

SEQ ID NO: 8698 - DNA, 38 bp, Artificial Sequence
  Synthetic oligonucleotide
actaccacgcagacgggacctactacacctcgccctga

SEQ ID NO: 8699 - DNA, 36 bp, Artificial Sequence
  Synthetic oligonucleotide
tgccaagtcgccccactgccttcacacaaacgctta

SEQ ID NO: 8700 - DNA, 36 bp, Artificial Sequence
  Synthetic oligonucleotide
tacaatctgccaccctgcgccgtcgcctccgttaca

SEQ ID NO: 8701 - DNA, 37 bp, Artificial Sequence
  Synthetic oligonucleotide
tgcgccaccgtaggtctttctccttccctctactgga

SEQ ID NO: 8702 - DNA, 36 bp, Artificial Sequence
  Synthetic oligonucleotide
gtgcgcgggtggggaggcgaggggaggtcagggtaa

SEQ ID NO: 8703 - DNA, 36 bp, Artificial Sequence
  Synthetic oligonucleotide
ttcacaccatcttagttcccaggcgacagccaatga

SEQ ID NO: 8704 - DNA, 35 bp, Artificial Sequence
  Synthetic oligonucleotide
gcacgcgctgtctgtcacttccttagcactctgac

SEQ ID NO: 8705 - DNA, 37 bp, Artificial Sequence
  Synthetic oligonucleotide
gacactgcctttttctactacagtcgtcgctccccga

SEQ ID NO: 8706 - DNA, 35 bp, Artificial Sequence
  Synthetic oligonucleotide
gactctccaacgcgatgacgttcgggctcactttc

SEQ ID NO: 8707 - DNA, 37 bp, Artificial Sequence
  Synthetic oligonucleotide
gacgcctcgcgcttcaactctgttctttgtctgttga

SEQ ID NO: 8708 - DNA, 35 bp, Artificial Sequence
  Synthetic oligonucleotide
gaacgtagcgccatatcacaccccttactccacgg

SEQ ID NO: 8709 - DNA, 36 bp, Artificial Sequence
  Synthetic oligonucleotide
gattaaccaccactgtatggccagaccctgctacaa

SEQ ID NO: 8710 - DNA, 35 bp, Artificial Sequence
  Synthetic oligonucleotide
agacgctcaccgttcacttcgtcgttcctagtttt

SEQ ID NO: 8711 - DNA, 35 bp, Artificial Sequence
  Synthetic oligonucleotide
atagcccccgctgtttactctaccctcttgctttg

SEQ ID NO: 8712 - DNA, 35 bp, Artificial Sequence
  Synthetic oligonucleotide
agccacctccacgttccacccacctagcatcttgt

SEQ ID NO: 8713 - DNA, 36 bp, Artificial Sequence
  Synthetic oligonucleotide
gggtgcaagcccacactgtttttaacaccactcaca

SEQ ID NO: 8714 - DNA, 37 bp, Artificial Sequence
  Synthetic oligonucleotide
gctgaggcgggacggggagggagagggaacggcggga

SEQ ID NO: 8715 - DNA, 37 bp, Artificial Sequence
  Synthetic oligonucleotide
gaacaggggggggtgattaggtggtgaactacagtga

SEQ ID NO: 8716 - DNA, 35 bp, Artificial Sequence
  Synthetic oligonucleotide
tgcgctcctgtgcttttgttgttcctgccgtttgc

SEQ ID NO: 8717 - DNA, 35 bp, Artificial Sequence
  Synthetic oligonucleotide
tgtacgcccctcccgcctccggaatacgctttcat

SEQ ID NO: 8718 - DNA, 35 bp, Artificial Sequence
  Synthetic oligonucleotide
tgcgacctcacacacatgtcttctcactaggaccc

SEQ ID NO: 8719 - DNA, 35 bp, Artificial Sequence
  Synthetic oligonucleotide
gaagcgcactggttaggctctgcccactttttcgc

SEQ ID NO: 8720 - DNA, 35 bp, Artificial Sequence
  Synthetic oligonucleotide
agacccgcacgaaaaccctgacgcgcccttgttac

SEQ ID NO: 8721 - DNA, 35 bp, Artificial Sequence
  Synthetic oligonucleotide
taccccgacccggacccttgtgactcagcctcctt

SEQ ID NO: 8722 - DNA, 35 bp, Artificial Sequence
  Synthetic oligonucleotide
tttacccctccgcctagagccatgcctgctgatcc

SEQ ID NO: 8723 - DNA, 36 bp, Artificial Sequence
  Synthetic oligonucleotide
tcaggtccgctgccaatttgctccttttaacgccta

SEQ ID NO: 8724 - DNA, 35 bp, Artificial Sequence
  Synthetic oligonucleotide
acacccaccgtctcataggcggcttacctctggac

SEQ ID NO: 8725 - DNA, 35 bp, Artificial Sequence
  Synthetic oligonucleotide
actcccgccatttcgaacaacaccccacgcacagc

SEQ ID NO: 8726 - DNA, 35 bp, Artificial Sequence
  Synthetic oligonucleotide
gacaactgagggcggtgggggacgggaaggaaata

SEQ ID NO: 8727 - DNA, 38 bp, Artificial Sequence
  Synthetic oligonucleotide
tcgagccctccgcggttaattggctctcacacccttga

SEQ ID NO: 8728 - DNA, 35 bp, Artificial Sequence
  Synthetic oligonucleotide
gatcaaccattcgttccttgcccacgcttactggc

SEQ ID NO: 8729 - DNA, 35 bp, Artificial Sequence
  Synthetic oligonucleotide
tacaccgggtcatcatactgctttttggtgcaatc

SEQ ID NO: 8730 - DNA, 35 bp, Artificial Sequence
  Synthetic oligonucleotide
gatgctccgtacatgccatctttaagcactccttt

SEQ ID NO: 8731 - DNA, 35 bp, Artificial Sequence
  Synthetic oligonucleotide
gagcaggctcacatgcccatcccaccgttagccga

SEQ ID NO: 8732 - DNA, 38 bp, Artificial Sequence
  Synthetic oligonucleotide
tccccgccgaattggccttcatacacctgtagacatga

SEQ ID NO: 8733 - DNA, 35 bp, Artificial Sequence
  Synthetic oligonucleotide
atacacccaaaccaccgtaagcgacgttcgaggag

SEQ ID NO: 8734 - DNA, 36 bp, Artificial Sequence
  Synthetic oligonucleotide
tgatatgccccttatgaacgccctgacccagtctca

SEQ ID NO: 8735 - DNA, 35 bp, Artificial Sequence
  Synthetic oligonucleotide
accgctagcagacaaccccacgctgagcctcgaac

SEQ ID NO: 8736 - DNA, 35 bp, Artificial Sequence
  Synthetic oligonucleotide
aaccgcacccagcgtacacctgtttaaaccaatcc

SEQ ID NO: 8737 - DNA, 36 bp, Artificial Sequence
  Synthetic oligonucleotide
tacgtgacgccgccttgtctctccgagctgaaagca

SEQ ID NO: 8738 - DNA, 35 bp, Artificial Sequence
  Synthetic oligonucleotide
gattaccgccgtaggtttctggcgcccatcgtacc

SEQ ID NO: 8739 - DNA, 35 bp, Artificial Sequence
  Synthetic oligonucleotide
gtatcccccatgcctcgttcctgaatcaacgtacg

SEQ ID NO: 8740 - DNA, 35 bp, Artificial Sequence
  Synthetic oligonucleotide
atgctcctgtatcgtccgctccctctccggtgcgt

SEQ ID NO: 8741 - DNA, 35 bp, Artificial Sequence
  Synthetic oligonucleotide
gtcgcctcctacgctatctatctctgtacccagtc

SEQ ID NO: 8742 - DNA, 37 bp, Artificial Sequence
  Synthetic oligonucleotide
ggggcgatttcggggtgagctactttaggggcgggga

SEQ ID NO: 8743 - DNA, 35 bp, Artificial Sequence
  Synthetic oligonucleotide
tttgcacccatcttgacatcagacttcctccgcct

SEQ ID NO: 8744 - DNA, 35 bp, Artificial Sequence
  Synthetic oligonucleotide
tctggccgccgccctccgtcccacccccgtccgaa

SEQ ID NO: 8745 - DNA, 35 bp, Artificial Sequence
  Synthetic oligonucleotide
tccatcacagcgccccgcccgtgcttgcctaacca

SEQ ID NO: 8746 - DNA, 35 bp, Artificial Sequence
  Synthetic oligonucleotide
gtccatctccactgcttttcgatattatgtcttct

SEQ ID NO: 8747 - DNA, 35 bp, Artificial Sequence
  Synthetic oligonucleotide
tgcttcagccgtcactatgcttttctacttcctgt

SEQ ID NO: 8748 - DNA, 35 bp, Artificial Sequence
  Synthetic oligonucleotide
tcattgccactgtctttctgctcatacggtttatc

SEQ ID NO: 8749 - DNA, 35 bp, Artificial Sequence
  Synthetic oligonucleotide
gcctaactgcgagttattaaaccccatgccctacg

SEQ ID NO: 8750 - DNA, 35 bp, Artificial Sequence
  Synthetic oligonucleotide
tgccatagacacatgccctgtcagccttccgttac

SEQ ID NO: 8751 - DNA, 35 bp, Artificial Sequence
  Synthetic oligonucleotide
gggagaaggagggggaagttaacggtacaggacgt

SEQ ID NO: 8752 - DNA, 35 bp, Artificial Sequence
  Synthetic oligonucleotide
accacgaacgtctcctccaggccccgctctcttcg

SEQ ID NO: 8753 - DNA, 35 bp, Artificial Sequence
  Synthetic oligonucleotide
atatgcgtggtcccccccgttgtcgtttgtcccat

SEQ ID NO: 8754 - DNA, 35 bp, Artificial Sequence
  Synthetic oligonucleotide
gtcaacccggatccattaacccggacctttttcac

SEQ ID NO: 8755 - DNA, 35 bp, Artificial Sequence
  Synthetic oligonucleotide
atgctgcagagcaacatctgccacttccctgtcgc

SEQ ID NO: 8756 - DNA, 35 bp, Artificial Sequence
  Synthetic oligonucleotide
tcgctaccccgaatagcgcctcatgccatcccctc

SEQ ID NO: 8757 - DNA, 37 bp, Artificial Sequence
  Synthetic oligonucleotide
gtgatgcccgttggctttttttctctgtgaccttcga

SEQ ID NO: 8758 - DNA, 37 bp, Artificial Sequence
  Synthetic oligonucleotide
gggagggggagctggggggtcgcgttcccaatgggga

SEQ ID NO: 8759 - DNA, 35 bp, Artificial Sequence
  Synthetic oligonucleotide
acgttgaagccctgcacgtcacttagcacaccttc

SEQ ID NO: 8760 - DNA, 34 bp, Artificial Sequence
  Synthetic oligonucleotide
tctgccctcacatatatctgcgtatttacccggt

SEQ ID NO: 8761 - DNA, 35 bp, Artificial Sequence
  Synthetic oligonucleotide
ttcgccgcgcaccacacgttctttccctactgctt

SEQ ID NO: 8762 - DNA, 35 bp, Artificial Sequence
  Synthetic oligonucleotide
tgcccgccgcccaccaccattagcttctttggcat

SEQ ID NO: 8763 - DNA, 35 bp, Artificial Sequence
  Synthetic oligonucleotide
aaatgacccctccgatccgccactcttgcgcctcg

SEQ ID NO: 8764 - DNA, 37 bp, Artificial Sequence
  Synthetic oligonucleotide
gtgcacctcccgcctgctttctgtgctaacccactga

SEQ ID NO: 8765 - DNA, 36 bp, Artificial Sequence
  Synthetic oligonucleotide
tctcgaggagcgaattgggggcaaagggggagaaga

SEQ ID NO: 8766 - DNA, 35 bp, Artificial Sequence
  Synthetic oligonucleotide
gacccgtggtgcccgactttaacgcccttactact

SEQ ID NO: 8767 - DNA, 35 bp, Artificial Sequence
  Synthetic oligonucleotide
ttacagcacggctcctttcgcgctaaccctgttct

SEQ ID NO: 8768 - DNA, 36 bp, Artificial Sequence
  Synthetic oligonucleotide
gcatcctcatggctcccctcccgccgcccacgaaca

SEQ ID NO: 8769 - DNA, 35 bp, Artificial Sequence
  Synthetic oligonucleotide
acgattaccaccccccgccttgccacgatgtttgg

SEQ ID NO: 8770 - DNA, 36 bp, Artificial Sequence
  Synthetic oligonucleotide
gaccctccgacctgtctctcccagtacatcttccaa

SEQ ID NO: 8771 - DNA, 38 bp, Artificial Sequence
  Synthetic oligonucleotide
gcacagacctccccgaactgcacagcatcttacgttga

SEQ ID NO: 8772 - DNA, 35 bp, Artificial Sequence
  Synthetic oligonucleotide
tacaacgtgaacgcctgctaccgagccccttgtac

SEQ ID NO: 8773 - DNA, 35 bp, Artificial Sequence
  Synthetic oligonucleotide
gaacacctcaatctcgcctcaaatgcggaccatgc

SEQ ID NO: 8774 - DNA, 36 bp, Artificial Sequence
  Synthetic oligonucleotide
atgacgggtgggatgaacggagggggttgggatatg

SEQ ID NO: 8775 - DNA, 35 bp, Artificial Sequence
  Synthetic oligonucleotide
ttctgtgaaccatgggccatacgcttacccctgac

SEQ ID NO: 8776 - DNA, 35 bp, Artificial Sequence
  Synthetic oligonucleotide
gtccaccattctgcgatccaacacactcagtcatc

SEQ ID NO: 8777 - DNA, 33 bp, Artificial Sequence
  Synthetic oligonucleotide
tttaccgctgtaacccttagcccgtaccttgtc

SEQ ID NO: 8778 - DNA, 38 bp, Artificial Sequence
  Synthetic oligonucleotide
acccccgttctatatgcactgcccctcgctcaacatga

SEQ ID NO: 8779 - DNA, 35 bp, Artificial Sequence
  Synthetic oligonucleotide
atacacgcgcatcttttctaatttctcgctgctgc

SEQ ID NO: 8780 - DNA, 35 bp, Artificial Sequence
  Synthetic oligonucleotide
ttgtacccatggtattctacccactgcccatgcct

SEQ ID NO: 8781 - DNA, 34 bp, Artificial Sequence
  Synthetic oligonucleotide
acacacttccctgctcgaaacactcgctgccgta

SEQ ID NO: 8782 - DNA, 38 bp, Artificial Sequence
  Synthetic oligonucleotide
gagtgccggtgggagaagggggggcatagagcaactga

SEQ ID NO: 8783 - DNA, 36 bp, Artificial Sequence
  Synthetic oligonucleotide
gacaacatgccaattctgatcgacaacacgctgaca

SEQ ID NO: 8784 - DNA, 36 bp, Artificial Sequence
  Synthetic oligonucleotide
tcacccctctcgttatgtaacactacgggttgttta

SEQ ID NO: 8785 - DNA, 34 bp, Artificial Sequence
  Synthetic oligonucleotide
ttggtcactcgcaccatcgcgggatagccttttt

SEQ ID NO: 8786 - DNA, 35 bp, Artificial Sequence
  Synthetic oligonucleotide
gttgggccccgctgctttctgttagctccatcctc

SEQ ID NO: 8787 - DNA, 37 bp, Artificial Sequence
  Synthetic oligonucleotide
tgaccactccccctgtttatccttactcactgtttga

SEQ ID NO: 8788 - DNA, 35 bp, Artificial Sequence
  Synthetic oligonucleotide
tgcccctccctgtacttggccacgtgctcccctgc

SEQ ID NO: 8789 - DNA, 36 bp, Artificial Sequence
  Synthetic oligonucleotide
gtgggggggagggttggggacttaagtcagggccga

SEQ ID NO: 8790 - DNA, 35 bp, Artificial Sequence
  Synthetic oligonucleotide
gacacttgcggcgctcatttttccgtttcgctact

SEQ ID NO: 8791 - DNA, 35 bp, Artificial Sequence
  Synthetic oligonucleotide
tctgacgccaccgaccccggcctgtgcccttccat

SEQ ID NO: 8792 - DNA, 35 bp, Artificial Sequence
  Synthetic oligonucleotide
gtacagcacggacagcctatcactcgcctttgaaa

SEQ ID NO: 8793 - DNA, 38 bp, Artificial Sequence
  Synthetic oligonucleotide
gatgcagtccgacaacattgctcgacacctcctactga

SEQ ID NO: 8794 - DNA, 35 bp, Artificial Sequence
  Synthetic oligonucleotide
gtccatgcgctccagctagctgcctggcaccacct

SEQ ID NO: 8795 - DNA, 36 bp, Artificial Sequence
  Synthetic oligonucleotide
gagagccccaccgtacatccggccctcctcacagaa

SEQ ID NO: 8796 - DNA, 35 bp, Artificial Sequence
  Synthetic oligonucleotide
actggaccccgaccatgaactcatagccccctact

SEQ ID NO: 8797 - DNA, 35 bp, Artificial Sequence
  Synthetic oligonucleotide
taagcatgccaaacggccctactcgtcccgctaat

SEQ ID NO: 8798 - DNA, 35 bp, Artificial Sequence
  Synthetic oligonucleotide
gatcgcagatgtctcgtatcccctgtccctgcatt

SEQ ID NO: 8799 - DNA, 35 bp, Artificial Sequence
  Synthetic oligonucleotide
atgctggcgccccccccacacaacacgcaatcgga

SEQ ID NO: 8800 - DNA, 36 bp, Artificial Sequence
  Synthetic oligonucleotide
acactcgcggtccctgctcattataattgtacactg

SEQ ID NO: 8801 - DNA, 36 bp, Artificial Sequence
  Synthetic oligonucleotide
acacgtgcaggccacatgggcaccccgcatcctcga

SEQ ID NO: 8802 - DNA, 35 bp, Artificial Sequence
  Synthetic oligonucleotide
aacccgcgtaagccgaggactcaccgcaactaccc

SEQ ID NO: 8803 - DNA, 37 bp, Artificial Sequence
  Synthetic oligonucleotide
gtgtgtatcaggtgggaatcatgggagatgggaggga

SEQ ID NO: 8804 - DNA, 35 bp, Artificial Sequence
  Synthetic oligonucleotide
gatgctccgtccccctcgtcatcagcctaccggtc

SEQ ID NO: 8805 - DNA, 36 bp, Artificial Sequence
  Synthetic oligonucleotide
gctgcacgtaatgcctatggttaccgcttgtctttc

SEQ ID NO: 8806 - DNA, 36 bp, Artificial Sequence
  Synthetic oligonucleotide
ggagccagatcctacctcaccctgcccagaactcga

SEQ ID NO: 8807 - DNA, 36 bp, Artificial Sequence
  Synthetic oligonucleotide
atgtaggggggtggaagggctagtggaaatagggga

SEQ ID NO: 8808 - DNA, 35 bp, Artificial Sequence
  Synthetic oligonucleotide
taacgcaggccgctgaggcttactacttcctcctc

SEQ ID NO: 8809 - DNA, 35 bp, Artificial Sequence
  Synthetic oligonucleotide
accccgttcccggatcgctaccccatcagctctcg

SEQ ID NO: 8810 - DNA, 35 bp, Artificial Sequence
  Synthetic oligonucleotide
gcacgcagaacattgccgccgtctgcccgccactg

SEQ ID NO: 8811 - DNA, 35 bp, Artificial Sequence
  Synthetic oligonucleotide
accccatacccagctgttgggtatggttccaacct

SEQ ID NO: 8812 - DNA, 35 bp, Artificial Sequence
  Synthetic oligonucleotide
aacatccgacactcccatccacatcccacgctctg

SEQ ID NO: 8813 - DNA, 35 bp, Artificial Sequence
  Synthetic oligonucleotide
tacctatcaccgtgactatgacgtctccgaactac

SEQ ID NO: 8814 - DNA, 35 bp, Artificial Sequence
  Synthetic oligonucleotide
gcgatggccgtccacgtcgccaactttcctacctt

SEQ ID NO: 8815 - DNA, 36 bp, Artificial Sequence
  Synthetic oligonucleotide
ggacggagggaagacagagggaggggattgacagaa

SEQ ID NO: 8816 - DNA, 38 bp, Artificial Sequence
  Synthetic oligonucleotide
acgtacccccgtccctgtttctactcgttcatgtttga

SEQ ID NO: 8817 - DNA, 35 bp, Artificial Sequence
  Synthetic oligonucleotide
taccgcgccgcctcagtaggccatcccaatctctg

SEQ ID NO: 8818 - DNA, 36 bp, Artificial Sequence
  Synthetic oligonucleotide
tccaccgtacgactcaaaccttcagcctcgtgccga

SEQ ID NO: 8819 - DNA, 35 bp, Artificial Sequence
  Synthetic oligonucleotide
gggaccgccacctatacaaagcaccaccgaccagc

SEQ ID NO: 8820 - DNA, 35 bp, Artificial Sequence
  Synthetic oligonucleotide
tagcctcccatggaatcggacccataatcctttct

SEQ ID NO: 8821 - DNA, 35 bp, Artificial Sequence
  Synthetic oligonucleotide
ggactccgcatccatgctactgttttttatcacac

SEQ ID NO: 8822 - DNA, 36 bp, Artificial Sequence
  Synthetic oligonucleotide
ttaccgtcggccattccacttgagcgccccacccta

SEQ ID NO: 8823 - DNA, 37 bp, Artificial Sequence
  Synthetic oligonucleotide
gaaggggaagatctggagggaggcgaaggcgagggga

SEQ ID NO: 8824 - DNA, 36 bp, Artificial Sequence
  Synthetic oligonucleotide
tcacattgtcctgcccatattgccctacgttgctta

SEQ ID NO: 8825 - DNA, 35 bp, Artificial Sequence
  Synthetic oligonucleotide
gcccctctcctgtacatcaaggcctggccaatcct

SEQ ID NO: 8826 - DNA, 36 bp, Artificial Sequence
  Synthetic oligonucleotide
gcccatgcccaccctttcgtaccacctgcaaggaca

SEQ ID NO: 8827 - DNA, 35 bp, Artificial Sequence
  Synthetic oligonucleotide
atacggccctgaacacatctggttttgatcgccct

SEQ ID NO: 8828 - DNA, 38 bp, Artificial Sequence
  Synthetic oligonucleotide
gcatgcacttacacctctttgggagcccatcatcctga

SEQ ID NO: 8829 - DNA, 36 bp, Artificial Sequence
  Synthetic oligonucleotide
acgttgcctccaatcagttccttccagccgggctta

SEQ ID NO: 8830 - DNA, 35 bp, Artificial Sequence
  Synthetic oligonucleotide
tccacgccacgccgcacaaaacaagcacatgggcc

SEQ ID NO: 8831 - DNA, 36 bp, Artificial Sequence
  Synthetic oligonucleotide
atgccctccacaccgcacctcgaagttcgaatagga

SEQ ID NO: 8832 - DNA, 35 bp, Artificial Sequence
  Synthetic oligonucleotide
ttcccgacaccctctaggacacactgcctgaactg

SEQ ID NO: 8833 - DNA, 35 bp, Artificial Sequence
  Synthetic oligonucleotide
atcaccacattccaggtctgccgatcttacacgct

SEQ ID NO: 8834 - DNA, 33 bp, Artificial Sequence
  Synthetic oligonucleotide
tgcaaagccgctattctgcccttaccgccccga

SEQ ID NO: 8835 - DNA, 35 bp, Artificial Sequence
  Synthetic oligonucleotide
aactgctacgtacaggcccttctccccgcccaata

SEQ ID NO: 8836 - DNA, 35 bp, Artificial Sequence
  Synthetic oligonucleotide
gctgggatgacaaggggtttctgaattgggatggg

SEQ ID NO: 8837 - DNA, 35 bp, Artificial Sequence
  Synthetic oligonucleotide
gtgtgcgccacctcttgtacacccttcccgaagca

SEQ ID NO: 8838 - DNA, 36 bp, Artificial Sequence
  Synthetic oligonucleotide
tcagccgttctccatcacggcctttctgcaccccta

SEQ ID NO: 8839 - DNA, 36 bp, Artificial Sequence
  Synthetic oligonucleotide
acacctgcccctgtgcgaatcattcattagtcttta

SEQ ID NO: 8840 - DNA, 35 bp, Artificial Sequence
  Synthetic oligonucleotide
gttcccctgccacatacacccgagctctccgggac

SEQ ID NO: 8841 - DNA, 35 bp, Artificial Sequence
  Synthetic oligonucleotide
ttgacttgcctctcttatatgccattatccctgtg

SEQ ID NO: 8842 - DNA, 36 bp, Artificial Sequence
  Synthetic oligonucleotide
tgcacccatcttgctatttcccgcgccttccttgaa

SEQ ID NO: 8843 - DNA, 36 bp, Artificial Sequence
  Synthetic oligonucleotide
acgctccatgccccaaatgcaatcatactcctcgta

SEQ ID NO: 8844 - DNA, 35 bp, Artificial Sequence
  Synthetic oligonucleotide
tcaccctcgtttatccggtacacctgtcatgcctc

SEQ ID NO: 8845 - DNA, 35 bp, Artificial Sequence
  Synthetic oligonucleotide
ggactgcacccgctctttattgcgcacattatcac

SEQ ID NO: 8846 - DNA, 35 bp, Artificial Sequence
  Synthetic oligonucleotide
tgacattctcccgctgccctgattccgccctcgcg

SEQ ID NO: 8847 - DNA, 35 bp, Artificial Sequence
  Synthetic oligonucleotide
gtctgcactcgtcgcccaacgagctactttttttt

SEQ ID NO: 8848 - DNA, 35 bp, Artificial Sequence
  Synthetic oligonucleotide
gcattgcgccgtccaatcctaccctccccacttcc

SEQ ID NO: 8849 - DNA, 38 bp, Artificial Sequence
  Synthetic oligonucleotide
tcactccacctcactgaccgtaagattgcctaccgtga

SEQ ID NO: 8850 - DNA, 35 bp, Artificial Sequence
  Synthetic oligonucleotide
tgtgtgctgacatcgttccgaccctaatgccttcc

SEQ ID NO: 8851 - DNA, 35 bp, Artificial Sequence
  Synthetic oligonucleotide
tgatgcccgcctcgatttattgcgtttaccctctg

SEQ ID NO: 8852 - DNA, 35 bp, Artificial Sequence
  Synthetic oligonucleotide
accgattgccgtttcccctgccacattcgccattg

SEQ ID NO: 8853 - DNA, 37 bp, Artificial Sequence
  Synthetic oligonucleotide
acatagagtacggacggatagggggggcacgggagga

SEQ ID NO: 8854 - DNA, 35 bp, Artificial Sequence
  Synthetic oligonucleotide
taccccgcaaccctatgtttcttttaggcccctat

SEQ ID NO: 8855 - DNA, 35 bp, Artificial Sequence
  Synthetic oligonucleotide
gcagacaagactcgtcccgttaaattttggtggtt

SEQ ID NO: 8856 - DNA, 36 bp, Artificial Sequence
  Synthetic oligonucleotide
tgactaccagccttcacgacgcctgcacacaattta

SEQ ID NO: 8857 - DNA, 35 bp, Artificial Sequence
  Synthetic oligonucleotide
gcctaccgccgtgataccgtcctctccttggcgtt

SEQ ID NO: 8858 - DNA, 37 bp, Artificial Sequence
  Synthetic oligonucleotide
gtggggagggaattcgatggggccgggggagtgtaga

SEQ ID NO: 8859 - DNA, 35 bp, Artificial Sequence
  Synthetic oligonucleotide
gtactgctgtcctcattttacgcgtccttaggccc

SEQ ID NO: 8860 - DNA, 35 bp, Artificial Sequence
  Synthetic oligonucleotide
tgaccggagtttaagtggggaggagcggggggtgt

SEQ ID NO: 8861 - DNA, 37 bp, Artificial Sequence
  Synthetic oligonucleotide
actacagcgcaaccgacccgcgatgcatcccccccga

SEQ ID NO: 8862 - DNA, 36 bp, Artificial Sequence
  Synthetic oligonucleotide
gaccacccccacggtaagagctccgcacgaaggcca

SEQ ID NO: 8863 - DNA, 35 bp, Artificial Sequence
  Synthetic oligonucleotide
gtgccgcctaatagcaccacgaacctgttttttca

SEQ ID NO: 8864 - DNA, 37 bp, Artificial Sequence
  Synthetic oligonucleotide
tgttcgctcgccgccacctgatacccttgtactttga

SEQ ID NO: 8865 - DNA, 37 bp, Artificial Sequence
  Synthetic oligonucleotide
gagagacggaggggggtgagaacgggcaaaaagtaga

SEQ ID NO: 8866 - DNA, 36 bp, Artificial Sequence
  Synthetic oligonucleotide
gtcgcgtacttattccatcgtcgcccgccccctgta

SEQ ID NO: 8867 - DNA, 35 bp, Artificial Sequence
  Synthetic oligonucleotide
tcgatcctctacgcctgggataccatggtcccctc

SEQ ID NO: 8868 - DNA, 38 bp, Artificial Sequence
  Synthetic oligonucleotide
gttgaggccatgcatttaaagcccccctgttttcctga

SEQ ID NO: 8869 - DNA, 35 bp, Artificial Sequence
  Synthetic oligonucleotide
tcacgcccactctccggccactgcgtaacgaaccg

SEQ ID NO: 8870 - DNA, 35 bp, Artificial Sequence
  Synthetic oligonucleotide
taaccgactgtccttcggcaccttccccggtccct

SEQ ID NO: 8871 - DNA, 38 bp, Artificial Sequence
  Synthetic oligonucleotide
tgcgaacgagggaccggggggtggacgcagggaaatga

SEQ ID NO: 8872 - DNA, 35 bp, Artificial Sequence
  Synthetic oligonucleotide
acccagcagccctctcggaaccgttgaatgcccct

SEQ ID NO: 8873 - DNA, 35 bp, Artificial Sequence
  Synthetic oligonucleotide
tccgaccctttcgactgcttatcgtggccgaccca

SEQ ID NO: 8874 - DNA, 35 bp, Artificial Sequence
  Synthetic oligonucleotide
ttcccatccccccggtttgtgtactcattagtccc

SEQ ID NO: 8875 - DNA, 37 bp, Artificial Sequence
  Synthetic oligonucleotide
gtgtcgacctccgccccgatttatacgacccttccga

SEQ ID NO: 8876 - DNA, 38 bp, Artificial Sequence
  Synthetic oligonucleotide
tactcccctgctacccgttccgtgacctctgtctttga

SEQ ID NO: 8877 - DNA, 35 bp, Artificial Sequence
  Synthetic oligonucleotide
gtttcgccaaaggcacatgcctctatttatccatc

SEQ ID NO: 8878 - DNA, 36 bp, Artificial Sequence
  Synthetic oligonucleotide
tgcacaccttccaccatataccacagccccggcgta

SEQ ID NO: 8879 - DNA, 38 bp, Artificial Sequence
  Synthetic oligonucleotide
gtgtcgccgcaccgctgcatacgcttaacaacctttga

SEQ ID NO: 8880 - DNA, 35 bp, Artificial Sequence
  Synthetic oligonucleotide
acccatgatctgtaccaccgtatacttcctaccgc

SEQ ID NO: 8881 - DNA, 36 bp, Artificial Sequence
  Synthetic oligonucleotide
actgaactacaaactgcatgaccctgtggcttctaa

SEQ ID NO: 8882 - DNA, 36 bp, Artificial Sequence
  Synthetic oligonucleotide
tcatcaccccactccgcggtcccgaagcagtaacaa

SEQ ID NO: 8883 - DNA, 35 bp, Artificial Sequence
  Synthetic oligonucleotide
gccatcttccgtcgacttcccccggcacccttgcg

SEQ ID NO: 8884 - DNA, 36 bp, Artificial Sequence
  Synthetic oligonucleotide
ttctgaggcccacccatgtcttctcccctccgtgga

SEQ ID NO: 8885 - DNA, 36 bp, Artificial Sequence
  Synthetic oligonucleotide
gcaccctgccgcggtatcttctctcttgtcttgcaa

SEQ ID NO: 8886 - DNA, 36 bp, Artificial Sequence
  Synthetic oligonucleotide
atatcgaacgccgaaactacatgaacctatgctaca

SEQ ID NO: 8887 - DNA, 35 bp, Artificial Sequence
  Synthetic oligonucleotide
gttcccagcccccactctgcggtcttgatctcatc

SEQ ID NO: 8888 - DNA, 35 bp, Artificial Sequence
  Synthetic oligonucleotide
tccgagcgaggtagggcaaagggatgatggggtta

SEQ ID NO: 8889 - DNA, 34 bp, Artificial Sequence
  Synthetic oligonucleotide
acatagcatcagccgcacatcatccacgcccaaa

SEQ ID NO: 8890 - DNA, 35 bp, Artificial Sequence
  Synthetic oligonucleotide
gacactcctcccccggatcatacattgctccacat

SEQ ID NO: 8891 - DNA, 35 bp, Artificial Sequence
  Synthetic oligonucleotide
tagccgcccctgactcccgtgttttcccgtttaag

SEQ ID NO: 8892 - DNA, 35 bp, Artificial Sequence
  Synthetic oligonucleotide
acgcactgcctataactggcctggctctaatccat

SEQ ID NO: 8893 - DNA, 38 bp, Artificial Sequence
  Synthetic oligonucleotide
aatgcacccatacggagttccgagcccaccacctttga

SEQ ID NO: 8894 - DNA, 37 bp, Artificial Sequence
  Synthetic oligonucleotide
ttgacaccggttccaagcccatgcactctatcctaga

SEQ ID NO: 8895 - DNA, 35 bp, Artificial Sequence
  Synthetic oligonucleotide
tcccaggtcacatagcacttccaaacggttactat

SEQ ID NO: 8896 - DNA, 35 bp, Artificial Sequence
  Synthetic oligonucleotide
tccacaatgctggtatcggcggtcccctctcactc

SEQ ID NO: 8897 - DNA, 36 bp, Artificial Sequence
  Synthetic oligonucleotide
acgcgcctgacgtccctgttctcctacaccgcgcca

SEQ ID NO: 8898 - DNA, 36 bp, Artificial Sequence
  Synthetic oligonucleotide
tcccggccccctgtgacctcgttgccgtgcccttga

SEQ ID NO: 8899 - DNA, 38 bp, Artificial Sequence
  Synthetic oligonucleotide
acacgtcactggcacttgtcttacgctcccttacctga

SEQ ID NO: 8900 - DNA, 35 bp, Artificial Sequence
  Synthetic oligonucleotide
agggaaggtgaacggtatggggggtagggatctga

SEQ ID NO: 8901 - DNA, 35 bp, Artificial Sequence
  Synthetic oligonucleotide
actggtaggccgacgacgcctcaatgcaccacccg

SEQ ID NO: 8902 - DNA, 35 bp, Artificial Sequence
  Synthetic oligonucleotide
accctcccactgctgtcttagcagtcctgctaaac

SEQ ID NO: 8903 - DNA, 36 bp, Artificial Sequence
  Synthetic oligonucleotide
ccagacgcgacactgtccaacgcaccgccgaccgaa

SEQ ID NO: 8904 - DNA, 35 bp, Artificial Sequence
  Synthetic oligonucleotide
gcaacagcttaccagcgtagtgcacgtacacactc

SEQ ID NO: 8905 - DNA, 35 bp, Artificial Sequence
  Synthetic oligonucleotide
tagtcctcaacgggctcgttattcgcacttcctcg

SEQ ID NO: 8906 - DNA, 37 bp, Artificial Sequence
  Synthetic oligonucleotide
atgagaggggatggaatgccaggggggtgttcgggga

SEQ ID NO: 8907 - DNA, 35 bp, Artificial Sequence
  Synthetic oligonucleotide
gccgacctctcgggatgatgctaccatccgcctcc

SEQ ID NO: 8908 - DNA, 35 bp, Artificial Sequence
  Synthetic oligonucleotide
tcccgcgtgggccctcttgtaacttcggtttccct

SEQ ID NO: 8909 - DNA, 37 bp, Artificial Sequence
  Synthetic oligonucleotide
gtagctcagccctcactgattgcccatcgccctcgga

SEQ ID NO: 8910 - DNA, 36 bp, Artificial Sequence
  Synthetic oligonucleotide
gagccgaagcgcaactatccaccacagcctgactta

SEQ ID NO: 8911 - DNA, 37 bp, Artificial Sequence
  Synthetic oligonucleotide
tcacccactacgctccactatggttcttggacaccga

SEQ ID NO: 8912 - DNA, 35 bp, Artificial Sequence
  Synthetic oligonucleotide
tgaccgcctctcctttctatgtagcacccgaatcg

SEQ ID NO: 8913 - DNA, 38 bp, Artificial Sequence
  Synthetic oligonucleotide
atccccaatgtgccatcaaatgcactccttgtccctga

SEQ ID NO: 8914 - DNA, 38 bp, Artificial Sequence
  Synthetic oligonucleotide
tacacctcctgcgatagcccgaccccccctacgtgtga

SEQ ID NO: 8915 - DNA, 35 bp, Artificial Sequence
  Synthetic oligonucleotide
ttttggagccaccactcgtcaatgactgctttctc

SEQ ID NO: 8916 - DNA, 35 bp, Artificial Sequence
  Synthetic oligonucleotide
tccacgttgccacttcgccgattcaccaccccgaa

SEQ ID NO: 8917 - DNA, 35 bp, Artificial Sequence
  Synthetic oligonucleotide
acctcaacatcgcgccgccattcagtcacactcct

SEQ ID NO: 8918 - DNA, 35 bp, Artificial Sequence
  Synthetic oligonucleotide
actcaagcccctcgcatgctgctcatgtcacacaa

SEQ ID NO: 8919 - DNA, 35 bp, Artificial Sequence
  Synthetic oligonucleotide
tgacccaccaacgctcacttgtcttgaaatccagg

SEQ ID NO: 8920 - DNA, 35 bp, Artificial Sequence
  Synthetic oligonucleotide
acgtcgcacagccacgcgacggttatctcccacct

SEQ ID NO: 8921 - DNA, 36 bp, Artificial Sequence
  Synthetic oligonucleotide
tccgagcctctcaagtgttcatcaccacctactcta

SEQ ID NO: 8922 - DNA, 35 bp, Artificial Sequence
  Synthetic oligonucleotide
gctaaccagcaccttatccgtcctcgattcaaccg

SEQ ID NO: 8923 - DNA, 36 bp, Artificial Sequence
  Synthetic oligonucleotide
tgttccctccatattgtttgctctggcgtgcacccc

SEQ ID NO: 8924 - DNA, 37 bp, Artificial Sequence
  Synthetic oligonucleotide
ttccctcgaccgacgcgcatcctccacttcctaagga

SEQ ID NO: 8925 - DNA, 35 bp, Artificial Sequence
  Synthetic oligonucleotide
tccaccaccctaggacttgcgtaacgtggtcctta

SEQ ID NO: 8926 - DNA, 36 bp, Artificial Sequence
  Synthetic oligonucleotide
tgcgaactccgccccctgcatttcccgtcccggtca

SEQ ID NO: 8927 - DNA, 38 bp, Artificial Sequence
  Synthetic oligonucleotide
gggaggtgcaggagaggaaggaaggtggggtaggatga

SEQ ID NO: 8928 - DNA, 36 bp, Artificial Sequence
  Synthetic oligonucleotide
aacccactcggtcaccttctgccactacgtatcgca

SEQ ID NO: 8929 - DNA, 35 bp, Artificial Sequence
  Synthetic oligonucleotide
tcttgggccgttggaccgtcttcccacccctcgac

SEQ ID NO: 8930 - DNA, 37 bp, Artificial Sequence
  Synthetic oligonucleotide
acccgccgccctgtcccacttctgtcaagttcaatga

SEQ ID NO: 8931 - DNA, 35 bp, Artificial Sequence
  Synthetic oligonucleotide
gagacgcgactcgccatcacgcccgatgccttccc

SEQ ID NO: 8932 - DNA, 35 bp, Artificial Sequence
  Synthetic oligonucleotide
tatgcctccgctgcagccgacattctttctctccg

SEQ ID NO: 8933 - DNA, 37 bp, Artificial Sequence
  Synthetic oligonucleotide
acacgaggagtacaggggagaagattggggaggaaga

SEQ ID NO: 8934 - DNA, 35 bp, Artificial Sequence
  Synthetic oligonucleotide
gacccccccctgtttggctatccaaagccttcgac

SEQ ID NO: 8935 - DNA, 35 bp, Artificial Sequence
  Synthetic oligonucleotide
gtcagaaaacgcgcctgcatgccttcggtccttct

SEQ ID NO: 8936 - DNA, 35 bp, Artificial Sequence
  Synthetic oligonucleotide
ctcacgcatctcaatatacgcctgttctatcgttc

SEQ ID NO: 8937 - DNA, 35 bp, Artificial Sequence
  Synthetic oligonucleotide
tcaggacatggcccaactgcacttctccacttgat

SEQ ID NO: 8938 - DNA, 35 bp, Artificial Sequence
  Synthetic oligonucleotide
accaccgcctcgcactggaccgtacgcaattgcct

SEQ ID NO: 8939 - DNA, 35 bp, Artificial Sequence
  Synthetic oligonucleotide
gaccacatcatctaactcagaaccgtctgcctgca

SEQ ID NO: 8940 - DNA, 35 bp, Artificial Sequence
  Synthetic oligonucleotide
gactcaaacgacacaatcttctatagccgaacatc

SEQ ID NO: 8941 - DNA, 35 bp, Artificial Sequence
  Synthetic oligonucleotide
tcccgaaggtgagcgggagggagggagggggtgtt

SEQ ID NO: 8942 - DNA, 36 bp, Artificial Sequence
  Synthetic oligonucleotide
gccgtccgtccacacaccgtagttcgctcaccacaa

SEQ ID NO: 8943 - DNA, 37 bp, Artificial Sequence
  Synthetic oligonucleotide
aatcacccaggctacgtcccatcgccctccctcgcga

SEQ ID NO: 8944 - DNA, 37 bp, Artificial Sequence
  Synthetic oligonucleotide
tacgcccccgatttcaccccaccgctccccagtggga

SEQ ID NO: 8945 - DNA, 37 bp, Artificial Sequence
  Synthetic oligonucleotide
tccatcgggcccaccttcgccaccactcctactgtga

SEQ ID NO: 8946 - DNA, 35 bp, Artificial Sequence
  Synthetic oligonucleotide
gtgcactctaacagccgccccgacccgccgtttta

SEQ ID NO: 8947 - DNA, 35 bp, Artificial Sequence
  Synthetic oligonucleotide
gatcgcaggccccttctatcttgttactttacctt

SEQ ID NO: 8948 - DNA, 36 bp, Artificial Sequence
  Synthetic oligonucleotide
aaagccgtcgtcccgaattgctcacccctcccctga

SEQ ID NO: 8949 - DNA, 37 bp, Artificial Sequence
  Synthetic oligonucleotide
aactggagtggaggaggggggacgtatgccaaaagga

SEQ ID NO: 8950 - DNA, 37 bp, Artificial Sequence
  Synthetic oligonucleotide
gtgtgccgagagggggtatcaacaaagggaggtggga

SEQ ID NO: 8951 - DNA, 35 bp, Artificial Sequence
  Synthetic oligonucleotide
tgttctgtccacgaggccagcctcccccatcctgc

SEQ ID NO: 8952 - DNA, 35 bp, Artificial Sequence
  Synthetic oligonucleotide
aacgagcgtcaatgcaacttctgccctgtcctctc

SEQ ID NO: 8953 - DNA, 35 bp, Artificial Sequence
  Synthetic oligonucleotide
gcccgcgaccaataaaacgcaacacccacgccctg

SEQ ID NO: 8954 - DNA, 35 bp, Artificial Sequence
  Synthetic oligonucleotide
agggagggaaggtggaagcaagtggaaggctgtat

SEQ ID NO: 8955 - DNA, 35 bp, Artificial Sequence
  Synthetic oligonucleotide
tgtatggcgactggcatctgcttacctgttctctc

SEQ ID NO: 8956 - DNA, 35 bp, Artificial Sequence
  Synthetic oligonucleotide
gttactcgcctcccaacccagagccctcattctgt

SEQ ID NO: 8957 - DNA, 35 bp, Artificial Sequence
  Synthetic oligonucleotide
gcacgatcgatgtcacatatacctcccgttcctac

SEQ ID NO: 8958 - DNA, 35 bp, Artificial Sequence
  Synthetic oligonucleotide
gtgtgccgcattcatactatctgtttcgccctcgc

SEQ ID NO: 8959 - DNA, 35 bp, Artificial Sequence
  Synthetic oligonucleotide
gtgccatgggtgctacaaaacatcgacgcttattc

SEQ ID NO: 8960 - DNA, 35 bp, Artificial Sequence
  Synthetic oligonucleotide
acgttcccacactcctcatctctacacacagtaca

SEQ ID NO: 8961 - DNA, 35 bp, Artificial Sequence
  Synthetic oligonucleotide
agtacacccctcctaattgctcacgggcatctttc

SEQ ID NO: 8962 - DNA, 35 bp, Artificial Sequence
  Synthetic oligonucleotide
gaccgtcgccggcatccccgttttccagtggttcc

SEQ ID NO: 8963 - DNA, 38 bp, Artificial Sequence
  Synthetic oligonucleotide
ggataagcgggtggtagggtgggcgtgggcggacgtga

SEQ ID NO: 8964 - DNA, 37 bp, Artificial Sequence
  Synthetic oligonucleotide
gtcccgctccccgtagccatgttcgatttccttatga

SEQ ID NO: 8965 - DNA, 35 bp, Artificial Sequence
  Synthetic oligonucleotide
accccgtcctcaccacgcgtggccggtccgcccct

SEQ ID NO: 8966 - DNA, 36 bp, Artificial Sequence
  Synthetic oligonucleotide
tagcaggcccccgagcccctcatatccgacctgaaa

SEQ ID NO: 8967 - DNA, 35 bp, Artificial Sequence
  Synthetic oligonucleotide
gccactcgctcccaatccacgcattctatccagga

SEQ ID NO: 8968 - DNA, 35 bp, Artificial Sequence
  Synthetic oligonucleotide
aaccccgatcgtgcgcatcttggcattgcgccctc

SEQ ID NO: 8969 - DNA, 37 bp, Artificial Sequence
  Synthetic oligonucleotide
tccctgcgcaagaactacctgtacccgccttccctga

SEQ ID NO: 8970 - DNA, 35 bp, Artificial Sequence
  Synthetic oligonucleotide
agcaaatcgcagctctcgttctagcgcccccatac

SEQ ID NO: 8971 - DNA, 35 bp, Artificial Sequence
  Synthetic oligonucleotide
gccaaaatccagttcgtcatttaacatcgcctttc

SEQ ID NO: 8972 - DNA, 36 bp, Artificial Sequence
  Synthetic oligonucleotide
tagacttgcagccacccccgggctcctatacatcta

SEQ ID NO: 8973 - DNA, 35 bp, Artificial Sequence
  Synthetic oligonucleotide
accacgcatgcctcttatggcttttctcttacctt

SEQ ID NO: 8974 - DNA, 37 bp, Artificial Sequence
  Synthetic oligonucleotide
gggaccggaggggctcgaactagaaaggggcatggga

SEQ ID NO: 8975 - DNA, 37 bp, Artificial Sequence
  Synthetic oligonucleotide
gtccgcctccctctccgcactccagcccgttccgtga

SEQ ID NO: 8976 - DNA, 33 bp, Artificial Sequence
  Synthetic oligonucleotide
tggacccgctgtgcgtgaacctactcgacttat

SEQ ID NO: 8977 - DNA, 35 bp, Artificial Sequence
  Synthetic oligonucleotide
ttggtcgcataccccatgttttactaccaccttct

SEQ ID NO: 8978 - DNA, 35 bp, Artificial Sequence
  Synthetic oligonucleotide
acccatcctctatgcgtgacactattacctgccgc

SEQ ID NO: 8979 - DNA, 35 bp, Artificial Sequence
  Synthetic oligonucleotide
ttgcgaccatgctctaccccgtgccaatatgccct

SEQ ID NO: 8980 - DNA, 36 bp, Artificial Sequence
  Synthetic oligonucleotide
atccaccggagcagttttctttcgtcgcgttcacaa

SEQ ID NO: 8981 - DNA, 35 bp, Artificial Sequence
  Synthetic oligonucleotide
gtacctgcacctgctccggaccaattcatgcactc

SEQ ID NO: 8982 - DNA, 37 bp, Artificial Sequence
  Synthetic oligonucleotide
agcggaggaagaaagatcaaaggaggggccaagcgga

SEQ ID NO: 8983 - DNA, 35 bp, Artificial Sequence
  Synthetic oligonucleotide
tcaactccaggcctccctcgacacggtctagcttc

SEQ ID NO: 8984 - DNA, 35 bp, Artificial Sequence
  Synthetic oligonucleotide
acatccgcaagtgacagcttatttttttcgccgtc

SEQ ID NO: 8985 - DNA, 38 bp, Artificial Sequence
  Synthetic oligonucleotide
ttagcagacctccgcccacttatgactttgccacgtga

SEQ ID NO: 8986 - DNA, 35 bp, Artificial Sequence
  Synthetic oligonucleotide
gcatagcaaacaagggggggtcggaaataaaaggg

SEQ ID NO: 8987 - DNA, 35 bp, Artificial Sequence
  Synthetic oligonucleotide
tagcacatggctcctgttctcatcatctgtttgtc

SEQ ID NO: 8988 - DNA, 37 bp, Artificial Sequence
  Synthetic oligonucleotide
gccccccacgcctatcgttttgccctatgcctatgga

SEQ ID NO: 8989 - DNA, 37 bp, Artificial Sequence
  Synthetic oligonucleotide
aaccgcctctgtgcgttactagcctcacccttgctga

SEQ ID NO: 8990 - DNA, 35 bp, Artificial Sequence
  Synthetic oligonucleotide
acatcccgatccgttagtgcctcactgctggcgac

SEQ ID NO: 8991 - DNA, 35 bp, Artificial Sequence
  Synthetic oligonucleotide
acaccctgctgcgatatgttccgtcctcaccgccc

SEQ ID NO: 8992 - DNA, 38 bp, Artificial Sequence
  Synthetic oligonucleotide
gtgccccggccacacaccgccctgcatccctaggatga

SEQ ID NO: 8993 - DNA, 37 bp, Artificial Sequence
  Synthetic oligonucleotide
actccaaccgctcatgctttggccttctttatatcga

SEQ ID NO: 8994 - DNA, 36 bp, Artificial Sequence
  Synthetic oligonucleotide
acacacggcataccgtttatcctgaacccgccacca

SEQ ID NO: 8995 - DNA, 36 bp, Artificial Sequence
  Synthetic oligonucleotide
tcacgcctaccccattgaatagcaccagtttaatca

SEQ ID NO: 8996 - DNA, 35 bp, Artificial Sequence
  Synthetic oligonucleotide
actccgatacatcaggtcgctgttcactattctcg

SEQ ID NO: 8997 - DNA, 35 bp, Artificial Sequence
  Synthetic oligonucleotide
tgttgaggtccggccctgtcatactatcccttctg

SEQ ID NO: 8998 - DNA, 35 bp, Artificial Sequence
  Synthetic oligonucleotide
acgatcaggtgggtagggctgggcaagggagtggt

SEQ ID NO: 8999 - DNA, 35 bp, Artificial Sequence
  Synthetic oligonucleotide
acaactgcccctgcaacgaactcaaagtcttccga

SEQ ID NO: 9000 - DNA, 38 bp, Artificial Sequence
  Synthetic oligonucleotide
gacccacccccgttgtctgaaacaaggaactcaattga

SEQ ID NO: 9001 - DNA, 34 bp, Artificial Sequence
  Synthetic oligonucleotide
aaccgctcgtagcggtatcatgctcccattcaca

SEQ ID NO: 9002 - DNA, 36 bp, Artificial Sequence
  Synthetic oligonucleotide
gaaccgcctcctggcacctctttctttacagttcca

SEQ ID NO: 9003 - DNA, 37 bp, Artificial Sequence
  Synthetic oligonucleotide
gaggagtggggggagtaggtggaacattggccaagga

SEQ ID NO: 9004 - DNA, 36 bp, Artificial Sequence
  Synthetic oligonucleotide
actcccgccacacccgattgctccgactcaaaggca

SEQ ID NO: 9005 - DNA, 35 bp, Artificial Sequence
  Synthetic oligonucleotide
tcgtcccaccacctacccaacaatcccgcccgagg

SEQ ID NO: 9006 - DNA, 35 bp, Artificial Sequence
  Synthetic oligonucleotide
attgaggccccatacgaagcacctgccactctagc

SEQ ID NO: 9007 - DNA, 37 bp, Artificial Sequence
  Synthetic oligonucleotide
aatgagggaacagggaaagcaataggtgcgggagaga

SEQ ID NO: 9008 - DNA, 35 bp, Artificial Sequence
  Synthetic oligonucleotide
tccgccttccagaccgccttaaacgccgcccatga

SEQ ID NO: 9009 - DNA, 38 bp, Artificial Sequence
  Synthetic oligonucleotide
atgggtgggggccaagcttgggacaaaaaggggtgtga

SEQ ID NO: 9010 - DNA, 35 bp, Artificial Sequence
  Synthetic oligonucleotide
actacgcccctatgccttgctcctcagtttgccgt

SEQ ID NO: 9011 - DNA, 35 bp, Artificial Sequence
  Synthetic oligonucleotide
tcatacaccatagatctgtcctcggttcacccgac

SEQ ID NO: 9012 - DNA, 35 bp, Artificial Sequence
  Synthetic oligonucleotide
agccacttactctggtgcttgcaaaccctgtctct

SEQ ID NO: 9013 - DNA, 38 bp, Artificial Sequence
  Synthetic oligonucleotide
tgtccaccctctcctatccttatcacggtcccacctga

SEQ ID NO: 9014 - DNA, 36 bp, Artificial Sequence
  Synthetic oligonucleotide
acgtacccccgcgatattaacaccatgctacgctta

SEQ ID NO: 9015 - DNA, 35 bp, Artificial Sequence
  Synthetic oligonucleotide
agacgcccctccttcgcaccccatgtagtactttg

SEQ ID NO: 9016 - DNA, 36 bp, Artificial Sequence
  Synthetic oligonucleotide
gatgcacacctcttcccgcgccccctagacgtgcga

SEQ ID NO: 9017 - DNA, 35 bp, Artificial Sequence
  Synthetic oligonucleotide
tagcacatcggcgtctatttttccttcgttctctc

SEQ ID NO: 9018 - DNA, 35 bp, Artificial Sequence
  Synthetic oligonucleotide
gatcccccgtttagtcttgcaccttcaggcttggc

SEQ ID NO: 9019 - DNA, 35 bp, Artificial Sequence
  Synthetic oligonucleotide
agcgagtcgcccttgctgctctgtaccacctcttt

SEQ ID NO: 9020 - DNA, 37 bp, Artificial Sequence
  Synthetic oligonucleotide
gtcacccccccataaatgcctgtcatctcagttccga

SEQ ID NO: 9021 - DNA, 35 bp, Artificial Sequence
  Synthetic oligonucleotide
tcgaaccgcgcccgtgccatcatcttgctcttccg

SEQ ID NO: 9022 - DNA, 35 bp, Artificial Sequence
  Synthetic oligonucleotide
tgcacaggcagtctcccatagtactttttcgcgca

SEQ ID NO: 9023 - DNA, 36 bp, Artificial Sequence
  Synthetic oligonucleotide
gacctcacattggtgaatgaaaacgaccctcccaca

SEQ ID NO: 9024 - DNA, 36 bp, Artificial Sequence
  Synthetic oligonucleotide
tccgtccccgcgtgcccaattcaccaccgcacctta

SEQ ID NO: 9025 - DNA, 35 bp, Artificial Sequence
  Synthetic oligonucleotide
acgcgtgccctccacactgacttagtactttttgc

SEQ ID NO: 9026 - DNA, 35 bp, Artificial Sequence
  Synthetic oligonucleotide
gtgtacttgcccatgttttcgccgaggcccacttc

SEQ ID NO: 9027 - DNA, 35 bp, Artificial Sequence
  Synthetic oligonucleotide
tcccataaccgcccctctctatgcgccgtaccgcg

SEQ ID NO: 9028 - DNA, 36 bp, Artificial Sequence
  Synthetic oligonucleotide
ggagggggagggttcgcggagggcggtagaggtaca

SEQ ID NO: 9029 - DNA, 37 bp, Artificial Sequence
  Synthetic oligonucleotide
gattggagcgtaccgtccagccccaacacccacccca

SEQ ID NO: 9030 - DNA, 35 bp, Artificial Sequence
  Synthetic oligonucleotide
gccacatttcctgatagcttccacagtcaacctct

SEQ ID NO: 9031 - DNA, 36 bp, Artificial Sequence
  Synthetic oligonucleotide
tcacgctaccgtaactgccttaacacttcgaagcca

SEQ ID NO: 9032 - DNA, 37 bp, Artificial Sequence
  Synthetic oligonucleotide
tactggagtacgggtggggacggggtgctttcgggga

SEQ ID NO: 9033 - DNA, 36 bp, Artificial Sequence
  Synthetic oligonucleotide
acgcggggagaggaggaggggaagctggagggggaa

SEQ ID NO: 9034 - DNA, 35 bp, Artificial Sequence
  Synthetic oligonucleotide
acccgcaccccctcgcaccagccgccttgcactca

SEQ ID NO: 9035 - DNA, 36 bp, Artificial Sequence
  Synthetic oligonucleotide
gaacggagtggaggatgatacattagggggaagaaa

SEQ ID NO: 9036 - DNA, 35 bp, Artificial Sequence
  Synthetic oligonucleotide
acccattcacgacctgctgcaccacactcgtcaca

SEQ ID NO: 9037 - DNA, 36 bp, Artificial Sequence
  Synthetic oligonucleotide
atcaaggcgcgcacctcagtccttcgtcctgcacta

SEQ ID NO: 9038 - DNA, 35 bp, Artificial Sequence
  Synthetic oligonucleotide
atccccgcatgttcatcacggctccatcggccccc

SEQ ID NO: 9039 - DNA, 38 bp, Artificial Sequence
  Synthetic oligonucleotide
gagagaggggtagggtgttcctggggggcattgagtga

SEQ ID NO: 9040 - DNA, 37 bp, Artificial Sequence
  Synthetic oligonucleotide
aacacatgccccagcatctacacgtgaaccaaattga

SEQ ID NO: 9041 - DNA, 38 bp, Artificial Sequence
  Synthetic oligonucleotide
ttccgcccacgcgactcttcgttactactcgcccctga

SEQ ID NO: 9042 - DNA, 35 bp, Artificial Sequence
  Synthetic oligonucleotide
tccatccgggggtctttccacgtaaacacgcactc

SEQ ID NO: 9043 - DNA, 36 bp, Artificial Sequence
  Synthetic oligonucleotide
atcgaccagccgtcacttttctttcgatcggtcgta

SEQ ID NO: 9044 - DNA, 37 bp, Artificial Sequence
  Synthetic oligonucleotide
atgggtaggagtgggagggagggtgatgtagcgggga

SEQ ID NO: 9045 - DNA, 35 bp, Artificial Sequence
  Synthetic oligonucleotide
gatcgcactcggactctctttccagctctccgccc

SEQ ID NO: 9046 - DNA, 36 bp, Artificial Sequence
  Synthetic oligonucleotide
gctcatagggggtaaggggctggagggaaggtggga

SEQ ID NO: 9047 - DNA, 36 bp, Artificial Sequence
  Synthetic oligonucleotide
tgtacccaccctcagaggtattactccttgccgctc

SEQ ID NO: 9048 - DNA, 35 bp, Artificial Sequence
  Synthetic oligonucleotide
acccgctacatggtccctatctgaccctcccatct

SEQ ID NO: 9049 - DNA, 35 bp, Artificial Sequence
  Synthetic oligonucleotide
tgtgaacctgcctttctggtccccactgttgccac

SEQ ID NO: 9050 - DNA, 38 bp, Artificial Sequence
  Synthetic oligonucleotide
gagcaccctactagcccagagccttcctccttccgtga

SEQ ID NO: 9051 - DNA, 38 bp, Artificial Sequence
  Synthetic oligonucleotide
ttgcgggggggagggacgctgggaagtgcgtgttgtga

SEQ ID NO: 9052 - DNA, 36 bp, Artificial Sequence
  Synthetic oligonucleotide
tagatgtgcaccaccacctccagttaagcctagcca

SEQ ID NO: 9053 - DNA, 36 bp, Artificial Sequence
  Synthetic oligonucleotide
taagcctgactgctagttatcacctccgaccttcca

SEQ ID NO: 9054 - DNA, 37 bp, Artificial Sequence
  Synthetic oligonucleotide
gaccccccacccatgctgtacttttctcatgcataga

SEQ ID NO: 9055 - DNA, 33 bp, Artificial Sequence
  Synthetic oligonucleotide
aatgcacctcaatgcattgccacatcttgctta

SEQ ID NO: 9056 - DNA, 35 bp, Artificial Sequence
  Synthetic oligonucleotide
acacatccggccagcattacaagcgcgctccactt

SEQ ID NO: 9057 - DNA, 37 bp, Artificial Sequence
  Synthetic oligonucleotide
gagaggagtgagggggaggtgcgaggagcgtgacaga

SEQ ID NO: 9058 - DNA, 36 bp, Artificial Sequence
  Synthetic oligonucleotide
tgtaatcgcgacgcaatctgtcctgccggttccatc

SEQ ID NO: 9059 - DNA, 35 bp, Artificial Sequence
  Synthetic oligonucleotide
taatgcgcccgtcacccttgtcctcggtccgcgct

SEQ ID NO: 9060 - DNA, 36 bp, Artificial Sequence
  Synthetic oligonucleotide
gttcaggggtgggaaaacgtggtgaatggggaataa

SEQ ID NO: 9061 - DNA, 37 bp, Artificial Sequence
  Synthetic oligonucleotide
gcggggaggacgcggagcaagggaaggggtggctgga

SEQ ID NO: 9062 - DNA, 37 bp, Artificial Sequence
  Synthetic oligonucleotide
tactgacagtgccccgtcgcttattgccctcctttga

SEQ ID NO: 9063 - DNA, 34 bp, Artificial Sequence
  Synthetic oligonucleotide
agccccccccccgatctccgggttgccacttgcc

SEQ ID NO: 9064 - DNA, 35 bp, Artificial Sequence
  Synthetic oligonucleotide
tcagacctgtcgttaccgttcaacccttaggctcc

SEQ ID NO: 9065 - DNA, 35 bp, Artificial Sequence
  Synthetic oligonucleotide
gaccggctcctctgcacctcattttgaacgcctcg

SEQ ID NO: 9066 - DNA, 38 bp, Artificial Sequence
  Synthetic oligonucleotide
gctcatccgcccgaaccgcctcgcagtaccattcatga

SEQ ID NO: 9067 - DNA, 37 bp, Artificial Sequence
  Synthetic oligonucleotide
tccgcccctattccaagtcctatatcgagccctttga

SEQ ID NO: 9068 - DNA, 35 bp, Artificial Sequence
  Synthetic oligonucleotide
ttgctaccacatggttccagtctgtcctcgttgtc

SEQ ID NO: 9069 - DNA, 35 bp, Artificial Sequence
  Synthetic oligonucleotide
acaccaccgtcgcattttttgtccgccgttacccg

SEQ ID NO: 9070 - DNA, 35 bp, Artificial Sequence
  Synthetic oligonucleotide
acgacctacccgcagaaccgccttataattccgta

SEQ ID NO: 9071 - DNA, 35 bp, Artificial Sequence
  Synthetic oligonucleotide
tccagcccccggcaggcctgtttacctccgcacca

SEQ ID NO: 9072 - DNA, 37 bp, Artificial Sequence
  Synthetic oligonucleotide
atccgacccggcgcccatccccatcgtaatcgctcga

SEQ ID NO: 9073 - DNA, 37 bp, Artificial Sequence
  Synthetic oligonucleotide
gtgaggggggagtgagcgttaaaaggtgggacgtcga

SEQ ID NO: 9074 - DNA, 36 bp, Artificial Sequence
  Synthetic oligonucleotide
tccactgccccgatcctctgaagtctgtattccgca

SEQ ID NO: 9075 - DNA, 36 bp, Artificial Sequence
  Synthetic oligonucleotide
tcactatccagcccctgatctagtctcttccacaca

SEQ ID NO: 9076 - DNA, 35 bp, Artificial Sequence
  Synthetic oligonucleotide
gacgcctctcagcatctgcctagtatgtctttcct

SEQ ID NO: 9077 - DNA, 35 bp, Artificial Sequence
  Synthetic oligonucleotide
ttctagccgggctttgcattggcgtcccctttccc

SEQ ID NO: 9078 - DNA, 35 bp, Artificial Sequence
  Synthetic oligonucleotide
actcatcccccgccacctaataacatcagtacttg

SEQ ID NO: 9079 - DNA, 36 bp, Artificial Sequence
  Synthetic oligonucleotide
tctacgacccatgccctacttctttcgacgttccca

SEQ ID NO: 9080 - DNA, 37 bp, Artificial Sequence
  Synthetic oligonucleotide
tgcacacgcccatctcttcttaggtttcacacggtga

SEQ ID NO: 9081 - DNA, 34 bp, Artificial Sequence
  Synthetic oligonucleotide
tgcctaggccgaaacaccacctcccccataaggt

SEQ ID NO: 9082 - DNA, 35 bp, Artificial Sequence
  Synthetic oligonucleotide
gtcatgcacggacccacctatcgagccttgttaat

SEQ ID NO: 9083 - DNA, 36 bp, Artificial Sequence
  Synthetic oligonucleotide
atgcaccacctgctgcgagaatctatgaattcatca

SEQ ID NO: 9084 - DNA, 35 bp, Artificial Sequence
  Synthetic oligonucleotide
tcccgcattggcgatccttccccccccctcgcgtg

SEQ ID NO: 9085 - DNA, 38 bp, Artificial Sequence
  Synthetic oligonucleotide
tatccgccggcctgttgaggcgcgtgacttccccctga

SEQ ID NO: 9086 - DNA, 38 bp, Artificial Sequence
  Synthetic oligonucleotide
gtacacgggggtggaggaaaggggtagggggcctgtga

SEQ ID NO: 9087 - DNA, 35 bp, Artificial Sequence
  Synthetic oligonucleotide
ttgcgaccctaagcatcggcgtcacactcgccccc

SEQ ID NO: 9088 - DNA, 37 bp, Artificial Sequence
  Synthetic oligonucleotide
taccccccgacccgcacctattgacgtcccgaaccga

SEQ ID NO: 9089 - DNA, 38 bp, Artificial Sequence
  Synthetic oligonucleotide
gtccacactcgattcccggtgccttttatgacagctga

SEQ ID NO: 9090 - DNA, 32 bp, Artificial Sequence
  Synthetic oligonucleotide
tcctgcccctccacaacctctttctacgagta

SEQ ID NO: 9091 - DNA, 35 bp, Artificial Sequence
  Synthetic oligonucleotide
cactgtagctattcgcatatgcagcccccccttac

SEQ ID NO: 9092 - DNA, 35 bp, Artificial Sequence
  Synthetic oligonucleotide
gcctgccctccggattaatagtcttgcttcctgtt

SEQ ID NO: 9093 - DNA, 35 bp, Artificial Sequence
  Synthetic oligonucleotide
tcccgcgggtggtctgctcgtacctttcattctcc

SEQ ID NO: 9094 - DNA, 36 bp, Artificial Sequence
  Synthetic oligonucleotide
tcactctgccgaccttatcgtttactgcttccgaca

SEQ ID NO: 9095 - DNA, 37 bp, Artificial Sequence
  Synthetic oligonucleotide
tcccgccggcattcagctcgcgatctctctacactga

SEQ ID NO: 9096 - DNA, 38 bp, Artificial Sequence
  Synthetic oligonucleotide
atcacagaatcgagggagattctgcataccctacttga

SEQ ID NO: 9097 - DNA, 36 bp, Artificial Sequence
  Synthetic oligonucleotide
acgaccacagccacactcctcactaagtcgatctta

SEQ ID NO: 9098 - DNA, 36 bp, Artificial Sequence
  Synthetic oligonucleotide
acctcgtgaccactatatgtacttggcccttgcata

SEQ ID NO: 9099 - DNA, 35 bp, Artificial Sequence
  Synthetic oligonucleotide
gacgacgccctgccttactgcttctgtgcacattt

SEQ ID NO: 9100 - DNA, 37 bp, Artificial Sequence
  Synthetic oligonucleotide
tagcacacttcctctccaagatcacctcccctttgga

SEQ ID NO: 9101 - DNA, 34 bp, Artificial Sequence
  Synthetic oligonucleotide
tccccaccacaagaaaccaaatgttcagtcacca

SEQ ID NO: 9102 - DNA, 36 bp, Artificial Sequence
  Synthetic oligonucleotide
gccccacccacttgtcgccaacggtcctgaacctca

SEQ ID NO: 9103 - DNA, 35 bp, Artificial Sequence
  Synthetic oligonucleotide
tgacagactcagctacaccgctctcgccctccagt

SEQ ID NO: 9104 - DNA, 35 bp, Artificial Sequence
  Synthetic oligonucleotide
tagttccccctctgtgctaactgtaaactattttt

SEQ ID NO: 9105 - DNA, 37 bp, Artificial Sequence
  Synthetic oligonucleotide
ggatccacccagttcctccgttcctgcctcttataga

SEQ ID NO: 9106 - DNA, 35 bp, Artificial Sequence
  Synthetic oligonucleotide
tagtggccccgctatgtatcccttcctgactccgc

SEQ ID NO: 9107 - DNA, 38 bp, Artificial Sequence
  Synthetic oligonucleotide
acccattaccacccccctcagacctggacagccgttga

SEQ ID NO: 9108 - DNA, 35 bp, Artificial Sequence
  Synthetic oligonucleotide
tgcgcactccgtgaccatcctcccgcgacccctgc

SEQ ID NO: 9109 - DNA, 38 bp, Artificial Sequence
  Synthetic oligonucleotide
acactccccccccagtgttaccaggcacctctctgtga

SEQ ID NO: 9110 - DNA, 35 bp, Artificial Sequence
  Synthetic oligonucleotide
gagtgcgctctcgcagtcctcttattccctgtcgc

SEQ ID NO: 9111 - DNA, 35 bp, Artificial Sequence
  Synthetic oligonucleotide
gacgctgactctcctcctaccaacgcccctcggag

SEQ ID NO: 9112 - DNA, 35 bp, Artificial Sequence
  Synthetic oligonucleotide
tgtacaccgcctccgttcccagctcggatctctct

SEQ ID NO: 9113 - DNA, 35 bp, Artificial Sequence
  Synthetic oligonucleotide
acacccaggtgtctgttcgatccgctttccgcaca

SEQ ID NO: 9114 - DNA, 36 bp, Artificial Sequence
  Synthetic oligonucleotide
gcaccgccccataacatctgcggtcacactcccgta

SEQ ID NO: 9115 - DNA, 35 bp, Artificial Sequence
  Synthetic oligonucleotide
atgccatattaccagcctttcgatcgagcccataa

SEQ ID NO: 9116 - DNA, 36 bp, Artificial Sequence
  Synthetic oligonucleotide
agcactaccccgcgtgcatcaaacacattgaccgta

SEQ ID NO: 9117 - DNA, 35 bp, Artificial Sequence
  Synthetic oligonucleotide
gtacagccatacgtgctacgatgcactgacccccc

SEQ ID NO: 9118 - DNA, 35 bp, Artificial Sequence
  Synthetic oligonucleotide
gccctctacccccccagtatttccggctatatggc

SEQ ID NO: 9119 - DNA, 35 bp, Artificial Sequence
  Synthetic oligonucleotide
ttacccgcatccgttgacctctgcctgaaattgtc

SEQ ID NO: 9120 - DNA, 35 bp, Artificial Sequence
  Synthetic oligonucleotide
gtcgcaaagcactcggttaccttgccatctaccac

SEQ ID NO: 9121 - DNA, 36 bp, Artificial Sequence
  Synthetic oligonucleotide
tgcaagccgatattccctcctatccgcgcaccttca

SEQ ID NO: 9122 - DNA, 35 bp, Artificial Sequence
  Synthetic oligonucleotide
aatgcacgtactttactctcgtcctccgtcgctgg

SEQ ID NO: 9123 - DNA, 35 bp, Artificial Sequence
  Synthetic oligonucleotide
taggccccgcttggtatagcgccttcctccctcac

SEQ ID NO: 9124 - DNA, 35 bp, Artificial Sequence
  Synthetic oligonucleotide
tcacctccagagcctgtggcattatcatttccctc

SEQ ID NO: 9125 - DNA, 36 bp, Artificial Sequence
  Synthetic oligonucleotide
accgactaggtacggctagattacttcggtcttcaa

SEQ ID NO: 9126 - DNA, 35 bp, Artificial Sequence
  Synthetic oligonucleotide
ttacccgcgccccgtatcatcttttcgcggctcca

SEQ ID NO: 9127 - DNA, 37 bp, Artificial Sequence
  Synthetic oligonucleotide
gggggccgggggcattaggtaaaacgcgggaaaagga

SEQ ID NO: 9128 - DNA, 38 bp, Artificial Sequence
  Synthetic oligonucleotide
gcagggggtaacctggggaaaacgggcaaaagtggtga

SEQ ID NO: 9129 - DNA, 35 bp, Artificial Sequence
  Synthetic oligonucleotide
gacatcacactgcttcatccttgttccttcgatgc

SEQ ID NO: 9130 - DNA, 36 bp, Artificial Sequence
  Synthetic oligonucleotide
tcgcacatcttgccaccgccgatatctgattcatta

SEQ ID NO: 9131 - DNA, 38 bp, Artificial Sequence
  Synthetic oligonucleotide
gaaccccctccatcgtatggtccagtctggagccatga

SEQ ID NO: 9132 - DNA, 36 bp, Artificial Sequence
  Synthetic oligonucleotide
aatgggaggcggaagggagtagaagggttgtgccag

SEQ ID NO: 9133 - DNA, 38 bp, Artificial Sequence
  Synthetic oligonucleotide
gcagtgcctccgatgccttgccgccccctcccagttga

SEQ ID NO: 9134 - DNA, 35 bp, Artificial Sequence
  Synthetic oligonucleotide
atccgccccgcccaaattgctccatgctcccggcg

SEQ ID NO: 9135 - DNA, 34 bp, Artificial Sequence
  Synthetic oligonucleotide
acgccctcgcaccaccatattgacatttgaggta

SEQ ID NO: 9136 - DNA, 35 bp, Artificial Sequence
  Synthetic oligonucleotide
actacacccgctctacaggtcttgacaccaacgtt

SEQ ID NO: 9137 - DNA, 35 bp, Artificial Sequence
  Synthetic oligonucleotide
atacccaccgcctacagtatctatcctcgccataa

SEQ ID NO: 9138 - DNA, 37 bp, Artificial Sequence
  Synthetic oligonucleotide
tgaccccaccaggggatttccctcccgattacttgga

SEQ ID NO: 9139 - DNA, 35 bp, Artificial Sequence
  Synthetic oligonucleotide
gccaccattcctgcgaacactatcacatttggtct

SEQ ID NO: 9140 - DNA, 35 bp, Artificial Sequence
  Synthetic oligonucleotide
ttgtcccactgacttgccccccgattacgatacta

SEQ ID NO: 9141 - DNA, 36 bp, Artificial Sequence
  Synthetic oligonucleotide
gacagggggggtacgggtggggtgatgtaggaatca

SEQ ID NO: 9142 - DNA, 37 bp, Artificial Sequence
  Synthetic oligonucleotide
ttgccacaatcggtacaccttagccttcgcactacga

SEQ ID NO: 9143 - DNA, 37 bp, Artificial Sequence
  Synthetic oligonucleotide
tcacactgtccccggcctaacaccacacactgaccga

SEQ ID NO: 9144 - DNA, 35 bp, Artificial Sequence
  Synthetic oligonucleotide
agccctcgctacattagggtccttttctgtctttc

SEQ ID NO: 9145 - DNA, 35 bp, Artificial Sequence
  Synthetic oligonucleotide
gcccggggtagggcgggaagtacggtaggggggga

SEQ ID NO: 9146 - DNA, 35 bp, Artificial Sequence
  Synthetic oligonucleotide
gtctcgctgctctcatctccccttgaactgctgga

SEQ ID NO: 9147 - DNA, 35 bp, Artificial Sequence
  Synthetic oligonucleotide
tcacctcaccgctaatagatcaagggccttctgta

SEQ ID NO: 9148 - DNA, 35 bp, Artificial Sequence
  Synthetic oligonucleotide
aacccgcgtactccctccgtccggcacacaccatc

SEQ ID NO: 9149 - DNA, 35 bp, Artificial Sequence
  Synthetic oligonucleotide
gcctcatcgcatctgagccgattgcccttttgctc

SEQ ID NO: 9150 - DNA, 38 bp, Artificial Sequence
  Synthetic oligonucleotide
gcgatcgcacgccctccaccatagatacctcacactga

SEQ ID NO: 9151 - DNA, 37 bp, Artificial Sequence
  Synthetic oligonucleotide
tcaccaacgctgaccacgtgtactccatcctttcaga

SEQ ID NO: 9152 - DNA, 37 bp, Artificial Sequence
  Synthetic oligonucleotide
gagaaaggggggatcgaaatggacgggatgagtgcga

SEQ ID NO: 9153 - DNA, 38 bp, Artificial Sequence
  Synthetic oligonucleotide
tcccctgccacattttgggttatcctcgtgctccttga

SEQ ID NO: 9154 - DNA, 36 bp, Artificial Sequence
  Synthetic oligonucleotide
gacccctcacccatgcactttattctgactgaacga

SEQ ID NO: 9155 - DNA, 35 bp, Artificial Sequence
  Synthetic oligonucleotide
gtacgccacccgacgctgccatgtcacgtctatcc

SEQ ID NO: 9156 - DNA, 35 bp, Artificial Sequence
  Synthetic oligonucleotide
gacgacacttccgctacatcatgtcctggatgtcc

SEQ ID NO: 9157 - DNA, 35 bp, Artificial Sequence
  Synthetic oligonucleotide
gttagcgccgaattcctccattgctatagttcctc

SEQ ID NO: 9158 - DNA, 38 bp, Artificial Sequence
  Synthetic oligonucleotide
ggagggtgagaggcaagaacgagaaggggtacagctga

SEQ ID NO: 9159 - DNA, 36 bp, Artificial Sequence
  Synthetic oligonucleotide
gacccgcaccactagtttgctcgacaccctacttta

SEQ ID NO: 9160 - DNA, 38 bp, Artificial Sequence
  Synthetic oligonucleotide
gcccagcgcagcctgcccttcgaattccgtctcgttga

SEQ ID NO: 9161 - DNA, 35 bp, Artificial Sequence
  Synthetic oligonucleotide
tcaccgccacgaatctggcgcagtatattccttcc

SEQ ID NO: 9162 - DNA, 37 bp, Artificial Sequence
  Synthetic oligonucleotide
aacgaaagggaggagggccggcgggtgggaagaatga

SEQ ID NO: 9163 - DNA, 35 bp, Artificial Sequence
  Synthetic oligonucleotide
ttgtggccacgcatggaagctaacccacctcatcg

SEQ ID NO: 9164 - DNA, 37 bp, Artificial Sequence
  Synthetic oligonucleotide
acaggaaggggaaggacggggcaaggatgagctgaga

SEQ ID NO: 9165 - DNA, 36 bp, Artificial Sequence
  Synthetic oligonucleotide
gcatctgccacctgccgttaatttcgtttgttcgta

SEQ ID NO: 9166 - DNA, 35 bp, Artificial Sequence
  Synthetic oligonucleotide
gccacagacgttcgcttcatccgcaaccctggcct

SEQ ID NO: 9167 - DNA, 35 bp, Artificial Sequence
  Synthetic oligonucleotide
tgagccccgccaacacctctgctatcacgcttaaa

SEQ ID NO: 9168 - DNA, 35 bp, Artificial Sequence
  Synthetic oligonucleotide
tagtgccgcccgtgtgtctcctttacatctacagg

SEQ ID NO: 9169 - DNA, 36 bp, Artificial Sequence
  Synthetic oligonucleotide
tcacgcctccccccggatattcgttggtcttatcga

SEQ ID NO: 9170 - DNA, 35 bp, Artificial Sequence
  Synthetic oligonucleotide
tcgcagaaaacacgcgcccctcgccaccgatccat

SEQ ID NO: 9171 - DNA, 36 bp, Artificial Sequence
  Synthetic oligonucleotide
gccacatgtccctgcagctcgcattaccccgaccga

SEQ ID NO: 9172 - DNA, 35 bp, Artificial Sequence
  Synthetic oligonucleotide
ggaggggggaacggggaagggatgggggttcctgc

SEQ ID NO: 9173 - DNA, 35 bp, Artificial Sequence
  Synthetic oligonucleotide
acaccaccaatgacgttctccggtgatgaaaaatt

SEQ ID NO: 9174 - DNA, 35 bp, Artificial Sequence
  Synthetic oligonucleotide
aagcgcaccgggcacgacccttccactcaagcttt

SEQ ID NO: 9175 - DNA, 35 bp, Artificial Sequence
  Synthetic oligonucleotide
tccagcgcttgccttttatcgtgcccattgcgtta

SEQ ID NO: 9176 - DNA, 35 bp, Artificial Sequence
  Synthetic oligonucleotide
ttcccccgatagtgccatgttacatcatcctcgtt

SEQ ID NO: 9177 - DNA, 35 bp, Artificial Sequence
  Synthetic oligonucleotide
tgaccttgcacacgcagcttatcgcccatccatga

SEQ ID NO: 9178 - DNA, 35 bp, Artificial Sequence
  Synthetic oligonucleotide
tcttccgtaccgctcccgcagcctttttcgcttgt

SEQ ID NO: 9179 - DNA, 35 bp, Artificial Sequence
  Synthetic oligonucleotide
gtacccctcgctcgcttaggttattcaaccgtttt

SEQ ID NO: 9180 - DNA, 36 bp, Artificial Sequence
  Synthetic oligonucleotide
gcacgaacccgtaatttgccgattgcaaccgcttca

SEQ ID NO: 9181 - DNA, 34 bp, Artificial Sequence
  Synthetic oligonucleotide
gccactcctgttatttggcactcactcccacgga

SEQ ID NO: 9182 - DNA, 35 bp, Artificial Sequence
  Synthetic oligonucleotide
actcggagggggggcaaagggaggaggtgacgcag

SEQ ID NO: 9183 - DNA, 37 bp, Artificial Sequence
  Synthetic oligonucleotide
tgagaggggaagggcggagaagtatggtaatgaatga

SEQ ID NO: 9184 - DNA, 37 bp, Artificial Sequence
  Synthetic oligonucleotide
cgccccgtcgaatctgctcacatctttttaccattga

SEQ ID NO: 9185 - DNA, 35 bp, Artificial Sequence
  Synthetic oligonucleotide
gtatgcaccatcccaattggcgttattgccaggtc

SEQ ID NO: 9186 - DNA, 35 bp, Artificial Sequence
  Synthetic oligonucleotide
gattagcacctgccattcccctgatctcggtttct

SEQ ID NO: 9187 - DNA, 36 bp, Artificial Sequence
  Synthetic oligonucleotide
gccagggtggggtagatagggaaggcggggagccaa

SEQ ID NO: 9188 - DNA, 35 bp, Artificial Sequence
  Synthetic oligonucleotide
gatcacgcctggctctgtacggttgctccctacac

SEQ ID NO: 9189 - DNA, 35 bp, Artificial Sequence
  Synthetic oligonucleotide
tcccaaccagtaagctgaacctatcccgggcaatt

SEQ ID NO: 9190 - DNA, 38 bp, Artificial Sequence
  Synthetic oligonucleotide
gactgtagcgccgccgcgggcctaccctccaccattga

SEQ ID NO: 9191 - DNA, 38 bp, Artificial Sequence
  Synthetic oligonucleotide
acgcactcgacgaagttcgtttgcgaatacctctttga

SEQ ID NO: 9192 - DNA, 35 bp, Artificial Sequence
  Synthetic oligonucleotide
tcacaagtgcgagggggatatccggtgggaagtgg

SEQ ID NO: 9193 - DNA, 36 bp, Artificial Sequence
  Synthetic oligonucleotide
gcccccccgccacatccgtggtatctcacccatgaa

SEQ ID NO: 9194 - DNA, 36 bp, Artificial Sequence
  Synthetic oligonucleotide
ttcaccccccacctcccgtgaatggaatggaattta

SEQ ID NO: 9195 - DNA, 35 bp, Artificial Sequence
  Synthetic oligonucleotide
gcatcgggctacgtaccgagcactatcaatccatc

SEQ ID NO: 9196 - DNA, 36 bp, Artificial Sequence
  Synthetic oligonucleotide
aacgcactccctcccacacgccacttgcctcggtga

SEQ ID NO: 9197 - DNA, 37 bp, Artificial Sequence
  Synthetic oligonucleotide
gagacaccaccatctgtccatttcgcccccggtagga

SEQ ID NO: 9198 - DNA, 35 bp, Artificial Sequence
  Synthetic oligonucleotide
ggaccgggcccaatgccttactttctccacgttac

SEQ ID NO: 9199 - DNA, 35 bp, Artificial Sequence
  Synthetic oligonucleotide
gctatgccttagcattatagaaccactgcaacatc

SEQ ID NO: 9200 - DNA, 35 bp, Artificial Sequence
  Synthetic oligonucleotide
gaggaacgtcgggcggggcaaactcgggatagggg

SEQ ID NO: 9201 - DNA, 35 bp, Artificial Sequence
  Synthetic oligonucleotide
acatttgcccctgctggaccccttacgcttcgagc

SEQ ID NO: 9202 - DNA, 38 bp, Artificial Sequence
  Synthetic oligonucleotide
gtcgacgtcttctcgcgctaactggacctcacctctga

SEQ ID NO: 9203 - DNA, 35 bp, Artificial Sequence
  Synthetic oligonucleotide
aacccgatacgtcttagcacacgccagttctcctc

SEQ ID NO: 9204 - DNA, 35 bp, Artificial Sequence
  Synthetic oligonucleotide
tcccaactctcgaatgagatgcctctattgtacac

SEQ ID NO: 9205 - DNA, 37 bp, Artificial Sequence
  Synthetic oligonucleotide
attgcaccccccacctccaccgtggtatgatcactga

SEQ ID NO: 9206 - DNA, 38 bp, Artificial Sequence
  Synthetic oligonucleotide
gcgagcccacttgctgaaccatccatactcttccgtga

SEQ ID NO: 9207 - DNA, 36 bp, Artificial Sequence
  Synthetic oligonucleotide
gtcatcccacacaacatgcctctccatctaagggca

SEQ ID NO: 9208 - DNA, 37 bp, Artificial Sequence
  Synthetic oligonucleotide
tgcaccaatcgcaccgccaaccgcatccgccatccga

SEQ ID NO: 9209 - DNA, 35 bp, Artificial Sequence
  Synthetic oligonucleotide
gcccatctaccgcctcatgaatgcgtcttggcatc

SEQ ID NO: 9210 - DNA, 38 bp, Artificial Sequence
  Synthetic oligonucleotide
aaccacaacctggcccccggtatttatcagtcctctga

SEQ ID NO: 9211 - DNA, 36 bp, Artificial Sequence
  Synthetic oligonucleotide
atccgccgtttcccgattaattttgcaccactacga

SEQ ID NO: 9212 - DNA, 37 bp, Artificial Sequence
  Synthetic oligonucleotide
gcataccggttcaaccctcgatcattgcccactttga

SEQ ID NO: 9213 - DNA, 35 bp, Artificial Sequence
  Synthetic oligonucleotide
taccaacccgattgtccaaccttcacaggtcacgc

SEQ ID NO: 9214 - DNA, 37 bp, Artificial Sequence
  Synthetic oligonucleotide
tgctccatccgagtgggctcgcatttctccatatcga

SEQ ID NO: 9215 - DNA, 35 bp, Artificial Sequence
  Synthetic oligonucleotide
acacacatcgaccttgcttgttccttcccgtattc

SEQ ID NO: 9216 - DNA, 35 bp, Artificial Sequence
  Synthetic oligonucleotide
gtcacgccaccgttcccgtcacaatccagcggttt

SEQ ID NO: 9217 - DNA, 35 bp, Artificial Sequence
  Synthetic oligonucleotide
acacgcaacccctctttgactcgctttgtcctgct

SEQ ID NO: 9218 - DNA, 37 bp, Artificial Sequence
  Synthetic oligonucleotide
gataggggaaggaggatgggggccactactcatggga

SEQ ID NO: 9219 - DNA, 35 bp, Artificial Sequence
  Synthetic oligonucleotide
tctagcccacacaccgccgattcgttgtttgaact

SEQ ID NO: 9220 - DNA, 37 bp, Artificial Sequence
  Synthetic oligonucleotide
aagagaatgcggggggctgggtgaagggtaagataga

SEQ ID NO: 9221 - DNA, 37 bp, Artificial Sequence
  Synthetic oligonucleotide
gcaggaagaggaggagaacggggatgggaatggggga

SEQ ID NO: 9222 - DNA, 35 bp, Artificial Sequence
  Synthetic oligonucleotide
atcacaactacctaccgtggctaccccgcacttgc

SEQ ID NO: 9223 - DNA, 35 bp, Artificial Sequence
  Synthetic oligonucleotide
tcatgctgaatgtcatgccgttcccactcttcctt

SEQ ID NO: 9224 - DNA, 36 bp, Artificial Sequence
  Synthetic oligonucleotide
atacgccaccgtccatgcatcacgtctctcttggca

SEQ ID NO: 9225 - DNA, 37 bp, Artificial Sequence
  Synthetic oligonucleotide
ttggcacccctccccgtacctacgctctcagccacga

SEQ ID NO: 9226 - DNA, 35 bp, Artificial Sequence
  Synthetic oligonucleotide
tgcaccccactcccgtggcaaccaacatagaaacc

SEQ ID NO: 9227 - DNA, 36 bp, Artificial Sequence
  Synthetic oligonucleotide
gcgccctaccgcaggtctctacatctgtccatcgta

SEQ ID NO: 9228 - DNA, 35 bp, Artificial Sequence
  Synthetic oligonucleotide
gtccaccccgcagacacgagccacgacggtgcgag

SEQ ID NO: 9229 - DNA, 36 bp, Artificial Sequence
  Synthetic oligonucleotide
atgagggtaagggagggataaagggactaaacggca

SEQ ID NO: 9230 - DNA, 38 bp, Artificial Sequence
  Synthetic oligonucleotide
gtggagagggaacgggggagaagaagagaattctatga

SEQ ID NO: 9231 - DNA, 37 bp, Artificial Sequence
  Synthetic oligonucleotide
atgccatccatacatctcaggacgagtcctgccttga

SEQ ID NO: 9232 - DNA, 36 bp, Artificial Sequence
  Synthetic oligonucleotide
attgtgccccactcactagccatccggtcctgtaca

SEQ ID NO: 9233 - DNA, 38 bp, Artificial Sequence
  Synthetic oligonucleotide
ttgccaccgcaggtcctataatctatcgcactctctga

SEQ ID NO: 9234 - DNA, 34 bp, Artificial Sequence
  Synthetic oligonucleotide
tcccgcccattactgttgtatttgttctccctac

SEQ ID NO: 9235 - DNA, 35 bp, Artificial Sequence
  Synthetic oligonucleotide
acattgacgggggggagggacgaagggacgcatca

SEQ ID NO: 9236 - DNA, 36 bp, Artificial Sequence
  Synthetic oligonucleotide
tgcaggcccctcctgttatttgctccttagatccca

SEQ ID NO: 9237 - DNA, 38 bp, Artificial Sequence
  Synthetic oligonucleotide
gaaggcggacgggggaggaaaagccgggaaaagcgtga

SEQ ID NO: 9238 - DNA, 36 bp, Artificial Sequence
  Synthetic oligonucleotide
aacgactcttgcccacgacgacatccctcttgcata

SEQ ID NO: 9239 - DNA, 29 bp, Artificial Sequence
  Synthetic oligonucleotide
tccaaatccaacacctcgtggctccttat

SEQ ID NO: 9240 - DNA, 36 bp, Artificial Sequence
  Synthetic oligonucleotide
ttccagccagcccgtaccatcttttaactccaggaa

SEQ ID NO: 9241 - DNA, 35 bp, Artificial Sequence
  Synthetic oligonucleotide
gtggggtggggggactgcgggataatgacctatat

SEQ ID NO: 9242 - DNA, 36 bp, Artificial Sequence
  Synthetic oligonucleotide
actccgccgaagtgcagtcccatccgctttttttta

SEQ ID NO: 9243 - DNA, 35 bp, Artificial Sequence
  Synthetic oligonucleotide
tctcccaccgcatagttgcatcctcatcctcgcgc

SEQ ID NO: 9244 - DNA, 35 bp, Artificial Sequence
  Synthetic oligonucleotide
tccacctacccgcttgctcccattcaggattaccc

SEQ ID NO: 9245 - DNA, 34 bp, Artificial Sequence
  Synthetic oligonucleotide
acctcaccgccacatatatcctccgtgtatacgt

SEQ ID NO: 9246 - DNA, 35 bp, Artificial Sequence
  Synthetic oligonucleotide
agtccctgccccgtagttcgctcacgcttgctctt

SEQ ID NO: 9247 - DNA, 38 bp, Artificial Sequence
  Synthetic oligonucleotide
agcccttccgcccgactactatttgcttcccagtatga

SEQ ID NO: 9248 - DNA, 35 bp, Artificial Sequence
  Synthetic oligonucleotide
gagtcaccaggcctccgtagctgaatacgcactcc

SEQ ID NO: 9249 - DNA, 36 bp, Artificial Sequence
  Synthetic oligonucleotide
actccacataaccactgtcaccatggctcattccca

SEQ ID NO: 9250 - DNA, 35 bp, Artificial Sequence
  Synthetic oligonucleotide
gcatactacagccgctcactggcagtttaacaccc

SEQ ID NO: 9251 - DNA, 35 bp, Artificial Sequence
  Synthetic oligonucleotide
tgtacgtcgcgcgatattccgcccctgccatgctc

SEQ ID NO: 9252 - DNA, 35 bp, Artificial Sequence
  Synthetic oligonucleotide
gcactcaccggtagcatcttggtcctccactgctt

SEQ ID NO: 9253 - DNA, 35 bp, Artificial Sequence
  Synthetic oligonucleotide
gtgcctgcgcaaagctctgatccctcctcactcgt

SEQ ID NO: 9254 - DNA, 37 bp, Artificial Sequence
  Synthetic oligonucleotide
tacccatccaaagctgtcctgtcccatcctctgccga

SEQ ID NO: 9255 - DNA, 37 bp, Artificial Sequence
  Synthetic oligonucleotide
gaaaacctgcagccacactccggacctcaccttgcga

SEQ ID NO: 9256 - DNA, 35 bp, Artificial Sequence
  Synthetic oligonucleotide
actcgcttcctgtccgttccggttttcctctgtac

SEQ ID NO: 9257 - DNA, 35 bp, Artificial Sequence
  Synthetic oligonucleotide
gtgccccatgtatcccttttgccatctctatgtga

SEQ ID NO: 9258 - DNA, 35 bp, Artificial Sequence
  Synthetic oligonucleotide
tcacaccccagggcgaataaccggtcccccttgtt

SEQ ID NO: 9259 - DNA, 37 bp, Artificial Sequence
  Synthetic oligonucleotide
tgcctacacctgcttaactgttccttcgatcatgcga

SEQ ID NO: 9260 - DNA, 35 bp, Artificial Sequence
  Synthetic oligonucleotide
acacctcggtgacacaccgcttacctaatacccca

SEQ ID NO: 9261 - DNA, 35 bp, Artificial Sequence
  Synthetic oligonucleotide
tcgcaacccactctatgttcgtagtcttccttggt

SEQ ID NO: 9262 - DNA, 35 bp, Artificial Sequence
  Synthetic oligonucleotide
ttaccaccctatgttcttgacgcgtaccctgaccc

SEQ ID NO: 9263 - DNA, 35 bp, Artificial Sequence
  Synthetic oligonucleotide
acccaagccacccctcgatatcggtgatgcccttc

SEQ ID NO: 9264 - DNA, 35 bp, Artificial Sequence
  Synthetic oligonucleotide
tcccatatgcgcttatcccgttgtagtgctctctt

SEQ ID NO: 9265 - DNA, 38 bp, Artificial Sequence
  Synthetic oligonucleotide
gcagaggggataaatgggggagggaacatgggaggtga

SEQ ID NO: 9266 - DNA, 35 bp, Artificial Sequence
  Synthetic oligonucleotide
atgctcagccccagccaaacgaatcacctacttgt

SEQ ID NO: 9267 - DNA, 36 bp, Artificial Sequence
  Synthetic oligonucleotide
gaagagcccatatattgtctggcccctgttttttca

SEQ ID NO: 9268 - DNA, 36 bp, Artificial Sequence
  Synthetic oligonucleotide
atcgcacgcctgccacgtacgacctggcccttaaca

SEQ ID NO: 9269 - DNA, 38 bp, Artificial Sequence
  Synthetic oligonucleotide
gcacgcctcggtaatcgagcccccatcctaccacatga

SEQ ID NO: 9270 - DNA, 35 bp, Artificial Sequence
  Synthetic oligonucleotide
acacgcctcgcgatctcatagggttccctctttcg

SEQ ID NO: 9271 - DNA, 38 bp, Artificial Sequence
  Synthetic oligonucleotide
tgagccctttgacgccattacgttcatacataccatga

SEQ ID NO: 9272 - DNA, 35 bp, Artificial Sequence
  Synthetic oligonucleotide
acaagtactggctcgcctcactggttctctctctc

SEQ ID NO: 9273 - DNA, 37 bp, Artificial Sequence
  Synthetic oligonucleotide
gcgaccgacgacctctcatgcgaaccattccatccga

SEQ ID NO: 9274 - DNA, 37 bp, Artificial Sequence
  Synthetic oligonucleotide
gtgagagacagggtggaaggaagataccggtggacga

SEQ ID NO: 9275 - DNA, 38 bp, Artificial Sequence
  Synthetic oligonucleotide
gcccgcacgcccgtctcgcgcccctacacaaccaatga

SEQ ID NO: 9276 - DNA, 35 bp, Artificial Sequence
  Synthetic oligonucleotide
acatccctgatgtcccagcatctaaccctgaccgc

SEQ ID NO: 9277 - DNA, 36 bp, Artificial Sequence
  Synthetic oligonucleotide
agccacgatccctgacccagcaccctctttttgtga

SEQ ID NO: 9278 - DNA, 38 bp, Artificial Sequence
  Synthetic oligonucleotide
aacgccccaccgctctgcgttcaagcttaaacctttga

SEQ ID NO: 9279 - DNA, 35 bp, Artificial Sequence
  Synthetic oligonucleotide
gagacccacctctctgtgacgtttacttgtacgac

SEQ ID NO: 9280 - DNA, 35 bp, Artificial Sequence
  Synthetic oligonucleotide
ggtgtgatccacgtgcctgactcgccttcatattc

SEQ ID NO: 9281 - DNA, 36 bp, Artificial Sequence
  Synthetic oligonucleotide
gcatccacccgcctctctcataccgcggcctccgga

SEQ ID NO: 9282 - DNA, 36 bp, Artificial Sequence
  Synthetic oligonucleotide
gtgtgctgccatcaatcgctgttttccggcctgtta

SEQ ID NO: 9283 - DNA, 35 bp, Artificial Sequence
  Synthetic oligonucleotide
acgcgacgcaagcgtaataccccgcatctcgtctc

SEQ ID NO: 9284 - DNA, 37 bp, Artificial Sequence
  Synthetic oligonucleotide
gacgcggagggtgggtgggaagcaatgagggtcgtga

SEQ ID NO: 9285 - DNA, 36 bp, Artificial Sequence
  Synthetic oligonucleotide
aggacggagtgggcggtgggagggcagagggctgga

SEQ ID NO: 9286 - DNA, 35 bp, Artificial Sequence
  Synthetic oligonucleotide
tttacatgccgctttgttttttttgatcatcccca

SEQ ID NO: 9287 - DNA, 35 bp, Artificial Sequence
  Synthetic oligonucleotide
gccgcctcctcagccacgcccttgctgcatattac

SEQ ID NO: 9288 - DNA, 36 bp, Artificial Sequence
  Synthetic oligonucleotide
gtgaccccccatgacctgaatatcgcgtttcatcca

SEQ ID NO: 9289 - DNA, 35 bp, Artificial Sequence
  Synthetic oligonucleotide
gtgagcgagggtggagagggaagggcgtaggaata

SEQ ID NO: 9290 - DNA, 35 bp, Artificial Sequence
  Synthetic oligonucleotide
gaagccctcacactatcgcactccacgcaaggttt

SEQ ID NO: 9291 - DNA, 35 bp, Artificial Sequence
  Synthetic oligonucleotide
tccgtttccccgtcacatctaccgtctccctgttg

SEQ ID NO: 9292 - DNA, 37 bp, Artificial Sequence
  Synthetic oligonucleotide
gacgatgggggaacgtagggaaaaagaatagcacaga

SEQ ID NO: 9293 - DNA, 37 bp, Artificial Sequence
  Synthetic oligonucleotide
agtcgggcaaaaggggcgaataggagtatggggggga

SEQ ID NO: 9294 - DNA, 35 bp, Artificial Sequence
  Synthetic oligonucleotide
ttaccgactgtaccctgccaacgatacacgcttcc

SEQ ID NO: 9295 - DNA, 35 bp, Artificial Sequence
  Synthetic oligonucleotide
tgtcccatctgtagagctatgttgcccggttccct

SEQ ID NO: 9296 - DNA, 36 bp, Artificial Sequence
  Synthetic oligonucleotide
ttcacaccatccgccttggttccagtggctcttcaa

SEQ ID NO: 9297 - DNA, 37 bp, Artificial Sequence
  Synthetic oligonucleotide
gacatccggcactcttcgcctaagttcgccctcctga

SEQ ID NO: 9298 - DNA, 37 bp, Artificial Sequence
  Synthetic oligonucleotide
tccgccgccctgcccgcacctcttctgcctcacgtga

SEQ ID NO: 9299 - DNA, 37 bp, Artificial Sequence
  Synthetic oligonucleotide
gaaggggagggggctcatgggtgggtaattctctgga

SEQ ID NO: 9300 - DNA, 37 bp, Artificial Sequence
  Synthetic oligonucleotide
atgcccgcctccctcgaacgcccgccccagtacttga

SEQ ID NO: 9301 - DNA, 35 bp, Artificial Sequence
  Synthetic oligonucleotide
tcccatcccgtataacgatcatcgtctcgttcgcc

SEQ ID NO: 9302 - DNA, 37 bp, Artificial Sequence
  Synthetic oligonucleotide
tccacccgctggtttccttgacccccatctcacatga

SEQ ID NO: 9303 - DNA, 37 bp, Artificial Sequence
  Synthetic oligonucleotide
tgggaggggacgacgggggtctaggaaagcgggacga

SEQ ID NO: 9304 - DNA, 37 bp, Artificial Sequence
  Synthetic oligonucleotide
atcgccacacttgaattactattagaccctctgccga

SEQ ID NO: 9305 - DNA, 37 bp, Artificial Sequence
  Synthetic oligonucleotide
gttaaacgggggggtgggcaaaaggggtattccggga

SEQ ID NO: 9306 - DNA, 37 bp, Artificial Sequence
  Synthetic oligonucleotide
tacccgccccgtctccccctcctatgcgatatttgga

SEQ ID NO: 9307 - DNA, 38 bp, Artificial Sequence
  Synthetic oligonucleotide
ttgacaaggccactcgatgcgattcacccttcttctga

SEQ ID NO: 9308 - DNA, 38 bp, Artificial Sequence
  Synthetic oligonucleotide
aacagcccaaccgccgccactacgaagacatgttttga

SEQ ID NO: 9309 - DNA, 35 bp, Artificial Sequence
  Synthetic oligonucleotide
ttcgtcacccctagcgttgctccatcgttatctcc

SEQ ID NO: 9310 - DNA, 35 bp, Artificial Sequence
  Synthetic oligonucleotide
tacgtcccctttccgctgcccgactcgtgcctaga

SEQ ID NO: 9311 - DNA, 35 bp, Artificial Sequence
  Synthetic oligonucleotide
atgccacgccctcgcatacgacctgcccatccaat

SEQ ID NO: 9312 - DNA, 35 bp, Artificial Sequence
  Synthetic oligonucleotide
tgtaactctgcctccatgtccactcttacattcca

SEQ ID NO: 9313 - DNA, 35 bp, Artificial Sequence
  Synthetic oligonucleotide
tcagagcgcacccctggcgcttcgtaccttcctta

SEQ ID NO: 9314 - DNA, 35 bp, Artificial Sequence
  Synthetic oligonucleotide
acctaggtcggtcgatacattccgtcttgctttac

SEQ ID NO: 9315 - DNA, 35 bp, Artificial Sequence
  Synthetic oligonucleotide
tccagaccctgttccggttgaaacactttgctttc

SEQ ID NO: 9316 - DNA, 37 bp, Artificial Sequence
  Synthetic oligonucleotide
tgctgacgctcgcactgcccggtttccctttccctga

SEQ ID NO: 9317 - DNA, 37 bp, Artificial Sequence
  Synthetic oligonucleotide
tgaactcacaaagggcgggatagtgcgggcggggcga

SEQ ID NO: 9318 - DNA, 35 bp, Artificial Sequence
  Synthetic oligonucleotide
ttgtgacagctcattcctgctgctttatcatcttc

SEQ ID NO: 9319 - DNA, 36 bp, Artificial Sequence
  Synthetic oligonucleotide
tccgaccctcacccggcgctctgtcctacgctttca

SEQ ID NO: 9320 - DNA, 35 bp, Artificial Sequence
  Synthetic oligonucleotide
tgagcccttcgcgctgtccatcctttatccgtttc

SEQ ID NO: 9321 - DNA, 35 bp, Artificial Sequence
  Synthetic oligonucleotide
tccccgggcctcacccccctacgctctcatgcgcg

SEQ ID NO: 9322 - DNA, 35 bp, Artificial Sequence
  Synthetic oligonucleotide
gccgccacacgtactcgatacccatcgcctctcat

SEQ ID NO: 9323 - DNA, 35 bp, Artificial Sequence
  Synthetic oligonucleotide
ttcactgccctgcctctcgaccgccaattcactct

SEQ ID NO: 9324 - DNA, 34 bp, Artificial Sequence
  Synthetic oligonucleotide
acttcaccctactcatgcggccaacttgctccaa

SEQ ID NO: 9325 - DNA, 37 bp, Artificial Sequence
  Synthetic oligonucleotide
gatcctgccccttgttaaagcttctcccttgcctgga

SEQ ID NO: 9326 - DNA, 35 bp, Artificial Sequence
  Synthetic oligonucleotide
tgtactcgccccgccatattttaacatcatcctgc

SEQ ID NO: 9327 - DNA, 35 bp, Artificial Sequence
  Synthetic oligonucleotide
tgccacccccctttctgagactattaagtcttggt

SEQ ID NO: 9328 - DNA, 37 bp, Artificial Sequence
  Synthetic oligonucleotide
tagccacctggccactccgctgttgctcttcaccgga

SEQ ID NO: 9329 - DNA, 35 bp, Artificial Sequence
  Synthetic oligonucleotide
tgtctccgccattcgcgctatcacccgcaaacaac

SEQ ID NO: 9330 - DNA, 35 bp, Artificial Sequence
  Synthetic oligonucleotide
gcaacctccactgcccgtcagtctcgttcttcgag

SEQ ID NO: 9331 - DNA, 35 bp, Artificial Sequence
  Synthetic oligonucleotide
tccaacgggagctctccataacacccatccccagt

SEQ ID NO: 9332 - DNA, 34 bp, Artificial Sequence
  Synthetic oligonucleotide
tcacaacgtgcacccgagaacgctccagtactat

SEQ ID NO: 9333 - DNA, 35 bp, Artificial Sequence
  Synthetic oligonucleotide
acctcactgcctcgctcctagttcatatagcctat

SEQ ID NO: 9334 - DNA, 35 bp, Artificial Sequence
  Synthetic oligonucleotide
accgccaatccgccactctgctctaattgtatcca

SEQ ID NO: 9335 - DNA, 35 bp, Artificial Sequence
  Synthetic oligonucleotide
tcgtagaacgggggtaggttagaagggaaaggtgt

SEQ ID NO: 9336 - DNA, 35 bp, Artificial Sequence
  Synthetic oligonucleotide
gtccgctcggctccattcccaccttgtgcccttcg

SEQ ID NO: 9337 - DNA, 35 bp, Artificial Sequence
  Synthetic oligonucleotide
gtaccgcgtagacactccgccctcactacttgttg

SEQ ID NO: 9338 - DNA, 35 bp, Artificial Sequence
  Synthetic oligonucleotide
gttcatccacaatccaacgtgtcattacgttcgtt

SEQ ID NO: 9339 - DNA, 37 bp, Artificial Sequence
  Synthetic oligonucleotide
taggggaagggggaggttatggcggaatgtagaggga

SEQ ID NO: 9340 - DNA, 35 bp, Artificial Sequence
  Synthetic oligonucleotide
gcccccgtgacatcactccatcccgcagaccgtgc

SEQ ID NO: 9341 - DNA, 35 bp, Artificial Sequence
  Synthetic oligonucleotide
ggtcgacaaatacgggggtaggatattggaggggg

SEQ ID NO: 9342 - DNA, 36 bp, Artificial Sequence
  Synthetic oligonucleotide
ttgcacatagcgactgctcccgctccctccgactga

SEQ ID NO: 9343 - DNA, 38 bp, Artificial Sequence
  Synthetic oligonucleotide
gccacgctgccgtttctttcgtttcactcgttctgtga

SEQ ID NO: 9344 - DNA, 35 bp, Artificial Sequence
  Synthetic oligonucleotide
atggacgggtaggttgaacgggggaatgcacgggt

SEQ ID NO: 9345 - DNA, 36 bp, Artificial Sequence
  Synthetic oligonucleotide
ttgctaccctccgtctcagccgcccgtctcaaagca

SEQ ID NO: 9346 - DNA, 35 bp, Artificial Sequence
  Synthetic oligonucleotide
gcccacctcaccgcccatgccctccctgtcgagag

SEQ ID NO: 9347 - DNA, 35 bp, Artificial Sequence
  Synthetic oligonucleotide
tttcgccgcctgccttttatgtcttttcgactctt

SEQ ID NO: 9348 - DNA, 37 bp, Artificial Sequence
  Synthetic oligonucleotide
gagcaccctgcccgttacaaatgcttctcgttcaaga

SEQ ID NO: 9349 - DNA, 38 bp, Artificial Sequence
  Synthetic oligonucleotide
taacaacgggggggtggggtccggggtaaacatggtga

SEQ ID NO: 9350 - DNA, 35 bp, Artificial Sequence
  Synthetic oligonucleotide
gtgtaacgccggcctttaaaacacgaccttcgcca

SEQ ID NO: 9351 - DNA, 38 bp, Artificial Sequence
  Synthetic oligonucleotide
tcctgtcccctgatcgtcgcgggccaatctcaccttga

SEQ ID NO: 9352 - DNA, 35 bp, Artificial Sequence
  Synthetic oligonucleotide
actcagcccttccatcagcaccgtgcacctgaaca

SEQ ID NO: 9353 - DNA, 36 bp, Artificial Sequence
  Synthetic oligonucleotide
gtaaccaccacctgatctgtccccacgcagaaaata

SEQ ID NO: 9354 - DNA, 35 bp, Artificial Sequence
  Synthetic oligonucleotide
tatgctgggtggagtgggggggtgtggcgtattta

SEQ ID NO: 9355 - DNA, 37 bp, Artificial Sequence
  Synthetic oligonucleotide
gttgggcatgggggggtgggcatttggcgattttaga

SEQ ID NO: 9356 - DNA, 36 bp, Artificial Sequence
  Synthetic oligonucleotide
tcacaccgtaccctctgaattacctgtctccgaaca

SEQ ID NO: 9357 - DNA, 35 bp, Artificial Sequence
  Synthetic oligonucleotide
atgcctcccctcccctcttttttgaaccgttccca

SEQ ID NO: 9358 - DNA, 35 bp, Artificial Sequence
  Synthetic oligonucleotide
gagcaagccactcgccatagaatgccatccttcac

SEQ ID NO: 9359 - DNA, 35 bp, Artificial Sequence
  Synthetic oligonucleotide
tgcatgttcaagccccatgatgccacattttttat

SEQ ID NO: 9360 - DNA, 37 bp, Artificial Sequence
  Synthetic oligonucleotide
ttagcccggccgctcgcccttgcatccacatcattga

SEQ ID NO: 9361 - DNA, 35 bp, Artificial Sequence
  Synthetic oligonucleotide
tactccgccacctagtggatatatatgtcccttct

SEQ ID NO: 9362 - DNA, 35 bp, Artificial Sequence
  Synthetic oligonucleotide
gtcttcccatcgtgctatctgccccgggtctttca

SEQ ID NO: 9363 - DNA, 37 bp, Artificial Sequence
  Synthetic oligonucleotide
aactggggccgaaggggaacggggggaacaatatcga

SEQ ID NO: 9364 - DNA, 38 bp, Artificial Sequence
  Synthetic oligonucleotide
tcctccttacctccgcctgttagtccatcacgtagtga

SEQ ID NO: 9365 - DNA, 35 bp, Artificial Sequence
  Synthetic oligonucleotide
gtggccggcacacatagcactcgccatttccatta

SEQ ID NO: 9366 - DNA, 35 bp, Artificial Sequence
  Synthetic oligonucleotide
actcgcaaccacctcttctggtcgatcaacactat

SEQ ID NO: 9367 - DNA, 36 bp, Artificial Sequence
  Synthetic oligonucleotide
atacgggaggggaaatgtcgggtggggtatcgaaca

SEQ ID NO: 9368 - DNA, 34 bp, Artificial Sequence
  Synthetic oligonucleotide
gatggggtacgggagggggcaagttgaagctggg

SEQ ID NO: 9369 - DNA, 36 bp, Artificial Sequence
  Synthetic oligonucleotide
tcaccctgggattgatgcccgttttgccttttggaa

SEQ ID NO: 9370 - DNA, 38 bp, Artificial Sequence
  Synthetic oligonucleotide
atgcgtggtactcttagtcgtccctgcctacccattga

SEQ ID NO: 9371 - DNA, 35 bp, Artificial Sequence
  Synthetic oligonucleotide
gaaccgcacatacctatgacccctatttagtctca

SEQ ID NO: 9372 - DNA, 35 bp, Artificial Sequence
  Synthetic oligonucleotide
tcttccacaccgccggcccccctgctttcgaggga

SEQ ID NO: 9373 - DNA, 36 bp, Artificial Sequence
  Synthetic oligonucleotide
acccatgcactggctttcgaccgcccaccactcgca

SEQ ID NO: 9374 - DNA, 36 bp, Artificial Sequence
  Synthetic oligonucleotide
taccccctgcgcatgctctccctgggccatcacgca

SEQ ID NO: 9375 - DNA, 37 bp, Artificial Sequence
  Synthetic oligonucleotide
acctacgttccgactcttgccgccctgtgcccttgga

SEQ ID NO: 9376 - DNA, 35 bp, Artificial Sequence
  Synthetic oligonucleotide
agttgcacctctgctacctcaccttgcattaacac

SEQ ID NO: 9377 - DNA, 36 bp, Artificial Sequence
  Synthetic oligonucleotide
gtcaaccctgcaaaacccagcgttcgcattccaaca

SEQ ID NO: 9378 - DNA, 36 bp, Artificial Sequence
  Synthetic oligonucleotide
tgagctcggcacccttccatttctgtctctcctgca

SEQ ID NO: 9379 - DNA, 38 bp, Artificial Sequence
  Synthetic oligonucleotide
ttgcgaacgggcgagaagcgggtgggaggtggggttga

SEQ ID NO: 9380 - DNA, 35 bp, Artificial Sequence
  Synthetic oligonucleotide
tacatgctgctcagctcaggcaagttccatcccat

SEQ ID NO: 9381 - DNA, 35 bp, Artificial Sequence
  Synthetic oligonucleotide
gaagcccgccttgggaacaacagcccttcgtaacc

SEQ ID NO: 9382 - DNA, 35 bp, Artificial Sequence
  Synthetic oligonucleotide
ggtccgtacgcgctcgtgcacctttccctctcacc

SEQ ID NO: 9383 - DNA, 35 bp, Artificial Sequence
  Synthetic oligonucleotide
atcaacaccatcattgatcatgcgtttccaactct

SEQ ID NO: 9384 - DNA, 36 bp, Artificial Sequence
  Synthetic oligonucleotide
tcacgacccctcttctcaatgtatgcctgttcttca

SEQ ID NO: 9385 - DNA, 38 bp, Artificial Sequence
  Synthetic oligonucleotide
ttggactggtgtggggcacaggagggtgggagggatga

SEQ ID NO: 9386 - DNA, 35 bp, Artificial Sequence
  Synthetic oligonucleotide
tcctacgcccgaaatcatggcctgaactgactcta

SEQ ID NO: 9387 - DNA, 35 bp, Artificial Sequence
  Synthetic oligonucleotide
gactgtcgatggtgccggccgttctttttccttct

SEQ ID NO: 9388 - DNA, 36 bp, Artificial Sequence
  Synthetic oligonucleotide
ttcaagcacgccgctttgattaacgcccttttccta

SEQ ID NO: 9389 - DNA, 35 bp, Artificial Sequence
  Synthetic oligonucleotide
accacacccccgccatggataacccccgctgctaa

SEQ ID NO: 9390 - DNA, 38 bp, Artificial Sequence
  Synthetic oligonucleotide
acatcccgtgacgattgcttcatcgtgctttctcttga

SEQ ID NO: 9391 - DNA, 36 bp, Artificial Sequence
  Synthetic oligonucleotide
gtgaccctgcgtgccccttcccgattataccagtca

SEQ ID NO: 9392 - DNA, 38 bp, Artificial Sequence
  Synthetic oligonucleotide
gcacggggaactgcaaggaagggcactgtggggaatga

SEQ ID NO: 9393 - DNA, 37 bp, Artificial Sequence
  Synthetic oligonucleotide
gtgtggcgttgcgatcccccgctctgttctaccgtga

SEQ ID NO: 9394 - DNA, 37 bp, Artificial Sequence
  Synthetic oligonucleotide
tggtcccgcacttatttgccactcgcctctccattga

SEQ ID NO: 9395 - DNA, 35 bp, Artificial Sequence
  Synthetic oligonucleotide
ttgtcccgtatcgcggggtttttcctgttcattac

SEQ ID NO: 9396 - DNA, 35 bp, Artificial Sequence
  Synthetic oligonucleotide
atcgggatcagccccatctgtcatccatccacagt

SEQ ID NO: 9397 - DNA, 35 bp, Artificial Sequence
  Synthetic oligonucleotide
tgtacgccccaccaatggtatcgtacgccctattt

SEQ ID NO: 9398 - DNA, 35 bp, Artificial Sequence
  Synthetic oligonucleotide
gctcctatccgaccgtctattaaagctccctcctt

SEQ ID NO: 9399 - DNA, 38 bp, Artificial Sequence
  Synthetic oligonucleotide
atgcgagcatggtccgcccccccacgtactagccctga

SEQ ID NO: 9400 - DNA, 38 bp, Artificial Sequence
  Synthetic oligonucleotide
tccgacacctcgccccatttcaccaggctctgccttga

SEQ ID NO: 9401 - DNA, 35 bp, Artificial Sequence
  Synthetic oligonucleotide
gattgccccccaccgaccccgtggccattggaaca

SEQ ID NO: 9402 - DNA, 36 bp, Artificial Sequence
  Synthetic oligonucleotide
agaacgaaaataggtgggggcacgagggggaaacga

SEQ ID NO: 9403 - DNA, 35 bp, Artificial Sequence
  Synthetic oligonucleotide
tgcctccccttgtctattggcgccggttccatgcc

SEQ ID NO: 9404 - DNA, 35 bp, Artificial Sequence
  Synthetic oligonucleotide
tttccaccaagcatcaccattgcctaacaccatgc

SEQ ID NO: 9405 - DNA, 36 bp, Artificial Sequence
  Synthetic oligonucleotide
gataggggccgggcgggaggctgatacgtgggcgga

SEQ ID NO: 9406 - DNA, 37 bp, Artificial Sequence
  Synthetic oligonucleotide
tactccccccgactgttgcttctcgatactactttga

SEQ ID NO: 9407 - DNA, 36 bp, Artificial Sequence
  Synthetic oligonucleotide
tactccccacactgtttattactgcattgattttta

SEQ ID NO: 9408 - DNA, 35 bp, Artificial Sequence
  Synthetic oligonucleotide
ttccacgcgctcaatcgctatcattttcgctttac

SEQ ID NO: 9409 - DNA, 35 bp, Artificial Sequence
  Synthetic oligonucleotide
gatccatgtcgcccccactcgcgtccgtgcctcac

SEQ ID NO: 9410 - DNA, 38 bp, Artificial Sequence
  Synthetic oligonucleotide
taggggggagaagggggcgcgaggtacggcgggggtga

SEQ ID NO: 9411 - DNA, 35 bp, Artificial Sequence
  Synthetic oligonucleotide
aaccacgcattcgagttaaccaccctagccaattt

SEQ ID NO: 9412 - DNA, 36 bp, Artificial Sequence
  Synthetic oligonucleotide
tctgccccgtcgctcttcaccctgccgatcaacaca

SEQ ID NO: 9413 - DNA, 36 bp, Artificial Sequence
  Synthetic oligonucleotide
tccgtctccatcatcccgtcgtcacacctcgtagca

SEQ ID NO: 9414 - DNA, 35 bp, Artificial Sequence
  Synthetic oligonucleotide
gaaccatcctgcgatctcccgcgctacaactgcct

SEQ ID NO: 9415 - DNA, 38 bp, Artificial Sequence
  Synthetic oligonucleotide
taccgcaccacctttacccgtagtcacagatagcttga

SEQ ID NO: 9416 - DNA, 35 bp, Artificial Sequence
  Synthetic oligonucleotide
gagcgggaaggactgggatagggccggggtggata

SEQ ID NO: 9417 - DNA, 35 bp, Artificial Sequence
  Synthetic oligonucleotide
ccaaagagacccgcacgtcagtcccttgcctacta

SEQ ID NO: 9418 - DNA, 37 bp, Artificial Sequence
  Synthetic oligonucleotide
gacccgacccccctcagtccgacggtcgcctctgcga

SEQ ID NO: 9419 - DNA, 35 bp, Artificial Sequence
  Synthetic oligonucleotide
tgagcccatccgaatcctgactcgacccatcttct

SEQ ID NO: 9420 - DNA, 35 bp, Artificial Sequence
  Synthetic oligonucleotide
agccatgtaccgaaatccgctgcccgtcgaacgcc

SEQ ID NO: 9421 - DNA, 35 bp, Artificial Sequence
  Synthetic oligonucleotide
atgtcaccctgcatattctgtgttttctccgtaat

SEQ ID NO: 9422 - DNA, 36 bp, Artificial Sequence
  Synthetic oligonucleotide
gccaagccactttcacatgaacaccgctgcactcta

SEQ ID NO: 9423 - DNA, 36 bp, Artificial Sequence
  Synthetic oligonucleotide
tacgcgcccggaccgcctgcctttgccttaccgtta

SEQ ID NO: 9424 - DNA, 35 bp, Artificial Sequence
  Synthetic oligonucleotide
tcctcctagggccccttcctctgattttagaaccg

SEQ ID NO: 9425 - DNA, 35 bp, Artificial Sequence
  Synthetic oligonucleotide
ttcggagagggggtgcaggcgaagggcgggttttg

SEQ ID NO: 9426 - DNA, 35 bp, Artificial Sequence
  Synthetic oligonucleotide
gactccatccgctgtaccgtaagattctcggtcac

SEQ ID NO: 9427 - DNA, 36 bp, Artificial Sequence
  Synthetic oligonucleotide
gcacatccgtcaacatagcgcttactcttgccccca

SEQ ID NO: 9428 - DNA, 37 bp, Artificial Sequence
  Synthetic oligonucleotide
tgctggtagggtgcggtgggtgaaaatgggtgataga

SEQ ID NO: 9429 - DNA, 35 bp, Artificial Sequence
  Synthetic oligonucleotide
gcggacacagctgccttcaccatcttccgcgaatc

SEQ ID NO: 9430 - DNA, 36 bp, Artificial Sequence
  Synthetic oligonucleotide
taccacgcacatattctcacctcccaacaggaggca

SEQ ID NO: 9431 - DNA, 36 bp, Artificial Sequence
  Synthetic oligonucleotide
gaccccagctaccgtgccgccgaactccgtccatga

SEQ ID NO: 9432 - DNA, 35 bp, Artificial Sequence
  Synthetic oligonucleotide
ttggcgcacatatcgtgttctatcctcctgtcttc

SEQ ID NO: 9433 - DNA, 35 bp, Artificial Sequence
  Synthetic oligonucleotide
gtccgatccggccacccggtacatccatccgattc

SEQ ID NO: 9434 - DNA, 36 bp, Artificial Sequence
  Synthetic oligonucleotide
tacgcatagatgcaaggggaagggagggaaggtgca

SEQ ID NO: 9435 - DNA, 36 bp, Artificial Sequence
  Synthetic oligonucleotide
tgcacgtttcacatcaaggccacgtgaccaccccta

SEQ ID NO: 9436 - DNA, 35 bp, Artificial Sequence
  Synthetic oligonucleotide
gcccatccagctgcctgaaaccccttcgcccagta

SEQ ID NO: 9437 - DNA, 35 bp, Artificial Sequence
  Synthetic oligonucleotide
gttccctggcccccctcgcgtcgttacatcggtcc

SEQ ID NO: 9438 - DNA, 35 bp, Artificial Sequence
  Synthetic oligonucleotide
acgtgtcgcccatgcgcacaaccatcgatcccacc

SEQ ID NO: 9439 - DNA, 35 bp, Artificial Sequence
  Synthetic oligonucleotide
atgtgcgcccaccgaaaattacttgtctgtactca

SEQ ID NO: 9440 - DNA, 37 bp, Artificial Sequence
  Synthetic oligonucleotide
agtgccccggctccagtgatcctccttcgctttacga

SEQ ID NO: 9441 - DNA, 37 bp, Artificial Sequence
  Synthetic oligonucleotide
tgtggagggaaggtactggtaaggggtcgagattgga

SEQ ID NO: 9442 - DNA, 35 bp, Artificial Sequence
  Synthetic oligonucleotide
aacagacggcaccacatactttgctgccttgtccc

SEQ ID NO: 9443 - DNA, 35 bp, Artificial Sequence
  Synthetic oligonucleotide
atcacatgccccccctttcaccaccatcctatcag

SEQ ID NO: 9444 - DNA, 36 bp, Artificial Sequence
  Synthetic oligonucleotide
atcgctccagactccccccaccgttttgacctggta

SEQ ID NO: 9445 - DNA, 35 bp, Artificial Sequence
  Synthetic oligonucleotide
gaccagcatcctagtcttccctgcactacaagccc

SEQ ID NO: 9446 - DNA, 35 bp, Artificial Sequence
  Synthetic oligonucleotide
acatagccttcgtttcgcataatctgtccgctact

SEQ ID NO: 9447 - DNA, 35 bp, Artificial Sequence
  Synthetic oligonucleotide
atccctccctgccctacacacttagttaaagacct

SEQ ID NO: 9448 - DNA, 35 bp, Artificial Sequence
  Synthetic oligonucleotide
tgttattcccgcgtccttcgtctcttttttgcatt

SEQ ID NO: 9449 - DNA, 37 bp, Artificial Sequence
  Synthetic oligonucleotide
tgggcgggaggggtcggggggtgaggtaaatgtcgga

SEQ ID NO: 9450 - DNA, 35 bp, Artificial Sequence
  Synthetic oligonucleotide
tactcggtggatgtcctcatactacgcctcttctc

SEQ ID NO: 9451 - DNA, 35 bp, Artificial Sequence
  Synthetic oligonucleotide
gctcaacgacggtctacctattccacttccctgca

SEQ ID NO: 9452 - DNA, 37 bp, Artificial Sequence
  Synthetic oligonucleotide
tagccacgtcgcgtctattctccatcgcaccccacga

SEQ ID NO: 9453 - DNA, 36 bp, Artificial Sequence
  Synthetic oligonucleotide
tccagtccgtccaaatagtttctctttcccgcacca

SEQ ID NO: 9454 - DNA, 35 bp, Artificial Sequence
  Synthetic oligonucleotide
gtcgaagcgcctgtttccgttcactagtacacccc

SEQ ID NO: 9455 - DNA, 37 bp, Artificial Sequence
  Synthetic oligonucleotide
tgaggacgtcagtcctctgctatttcaccaccattga

SEQ ID NO: 9456 - DNA, 36 bp, Artificial Sequence
  Synthetic oligonucleotide
aaccccccccgtccgcgcctttccatcggggcgaaa

SEQ ID NO: 9457 - DNA, 38 bp, Artificial Sequence
  Synthetic oligonucleotide
tcgaccccaatccgctatacaggccctctcttcagtga

SEQ ID NO: 9458 - DNA, 36 bp, Artificial Sequence
  Synthetic oligonucleotide
taaccaccctcccgcaccgtgatgcctgttggcata

SEQ ID NO: 9459 - DNA, 35 bp, Artificial Sequence
  Synthetic oligonucleotide
gattgtgggtgagggtggagggtgtcacgtaactg

SEQ ID NO: 9460 - DNA, 35 bp, Artificial Sequence
  Synthetic oligonucleotide
acgctcccagactgcgcacgcccaatccctacgaa

SEQ ID NO: 9461 - DNA, 36 bp, Artificial Sequence
  Synthetic oligonucleotide
gacgcctacccccaacatgagtgtcaattaatgcca

SEQ ID NO: 9462 - DNA, 35 bp, Artificial Sequence
  Synthetic oligonucleotide
atcacctgcactcattgcctggttccacctatcta

SEQ ID NO: 9463 - DNA, 38 bp, Artificial Sequence
  Synthetic oligonucleotide
ttgtacgccacatctcgccctgccgtccttcaaactga

SEQ ID NO: 9464 - DNA, 35 bp, Artificial Sequence
  Synthetic oligonucleotide
gcctaccctgccatgcccattcatgttcgccttac

SEQ ID NO: 9465 - DNA, 37 bp, Artificial Sequence
  Synthetic oligonucleotide
ttcagtcccattgcgtctagctacccctcacatcgga

SEQ ID NO: 9466 - DNA, 35 bp, Artificial Sequence
  Synthetic oligonucleotide
gtcctcacttcactgcgccttaccaccggctctac

SEQ ID NO: 9467 - DNA, 38 bp, Artificial Sequence
  Synthetic oligonucleotide
tcacaccggccgactcaccccgcaatgttcctcgctga

SEQ ID NO: 9468 - DNA, 36 bp, Artificial Sequence
  Synthetic oligonucleotide
tcgcatccccgttcgcgtatccgcgctgttacgcca

SEQ ID NO: 9469 - DNA, 35 bp, Artificial Sequence
  Synthetic oligonucleotide
gacccccatgttgctatgctgctgctcttcgttta

SEQ ID NO: 9470 - DNA, 36 bp, Artificial Sequence
  Synthetic oligonucleotide
tccccttgccactccaacctatatagcacctggtta

SEQ ID NO: 9471 - DNA, 35 bp, Artificial Sequence
  Synthetic oligonucleotide
tgcctgctgcatatcgctgtttcatttcacttgcc

SEQ ID NO: 9472 - DNA, 35 bp, Artificial Sequence
  Synthetic oligonucleotide
tcctgccctcctctgttagtatttatttgtcatcc

SEQ ID NO: 9473 - DNA, 36 bp, Artificial Sequence
  Synthetic oligonucleotide
acatcacctgccatttgcggtccagatttccccgca

SEQ ID NO: 9474 - DNA, 35 bp, Artificial Sequence
  Synthetic oligonucleotide
tacccgtgaccgtcgcgcttacaccccagttatac

SEQ ID NO: 9475 - DNA, 37 bp, Artificial Sequence
  Synthetic oligonucleotide
gcccaacctcagcctgccgtagcacttacgcccatga

SEQ ID NO: 9476 - DNA, 35 bp, Artificial Sequence
  Synthetic oligonucleotide
atgatcaccacagctgcaccacctctcggtatcaa

SEQ ID NO: 9477 - DNA, 38 bp, Artificial Sequence
  Synthetic oligonucleotide
tccgacggggcacgggacgggggggtggaggattatga

SEQ ID NO: 9478 - DNA, 35 bp, Artificial Sequence
  Synthetic oligonucleotide
tcctcgcctcccccatatagctttgggacaaacct

SEQ ID NO: 9479 - DNA, 35 bp, Artificial Sequence
  Synthetic oligonucleotide
gtgccatcgagccgccacaccctttagtctctcct

SEQ ID NO: 9480 - DNA, 35 bp, Artificial Sequence
  Synthetic oligonucleotide
gccgacatccatagtgcgtggtgtcgtccccttct

SEQ ID NO: 9481 - DNA, 35 bp, Artificial Sequence
  Synthetic oligonucleotide
atgcccatgtacctggcccctcacagacaccattt

SEQ ID NO: 9482 - DNA, 38 bp, Artificial Sequence
  Synthetic oligonucleotide
ggaagccacgccgccctgcccccctcccccgtaactga

SEQ ID NO: 9483 - DNA, 38 bp, Artificial Sequence
  Synthetic oligonucleotide
gccaacacacggtgactcccagccattagcccctctga

SEQ ID NO: 9484 - DNA, 35 bp, Artificial Sequence
  Synthetic oligonucleotide
atgacagccgctatgcctcctcaatgagtcccgtc

SEQ ID NO: 9485 - DNA, 35 bp, Artificial Sequence
  Synthetic oligonucleotide
ttcacccccgaggatctgtgcaccacccaaccgca

SEQ ID NO: 9486 - DNA, 38 bp, Artificial Sequence
  Synthetic oligonucleotide
accacacccaattccagttaatcattcagtcacaatga

SEQ ID NO: 9487 - DNA, 35 bp, Artificial Sequence
  Synthetic oligonucleotide
gcataccagctttatcccctgtctgctgagcactc

SEQ ID NO: 9488 - DNA, 35 bp, Artificial Sequence
  Synthetic oligonucleotide
atgcccacacacacattcgtcccacaagggacccg

SEQ ID NO: 9489 - DNA, 35 bp, Artificial Sequence
  Synthetic oligonucleotide
gtggcaacataccgttgcgtcctagccctccatct

SEQ ID NO: 9490 - DNA, 36 bp, Artificial Sequence
  Synthetic oligonucleotide
acgatggaagagaggtggggtgcgaagtatgtggga

SEQ ID NO: 9491 - DNA, 37 bp, Artificial Sequence
  Synthetic oligonucleotide
gcaccagcaacaacacactgcgccacgccacctatga

SEQ ID NO: 9492 - DNA, 38 bp, Artificial Sequence
  Synthetic oligonucleotide
tgcccatctaatggctctctatgtaccactgcccttga

SEQ ID NO: 9493 - DNA, 36 bp, Artificial Sequence
  Synthetic oligonucleotide
tgtgtgcgcacccgctggccaaaagcaccttaaaaa

SEQ ID NO: 9494 - DNA, 36 bp, Artificial Sequence
  Synthetic oligonucleotide
tgcccccgcctcccgtgacccatcaaccaccaagca

SEQ ID NO: 9495 - DNA, 35 bp, Artificial Sequence
  Synthetic oligonucleotide
tccctgcataccatccagatccttcaccacgtaga

SEQ ID NO: 9496 - DNA, 37 bp, Artificial Sequence
  Synthetic oligonucleotide
atcgccccccatcatgagcaaatattacgatctccga

SEQ ID NO: 9497 - DNA, 35 bp, Artificial Sequence
  Synthetic oligonucleotide
accctagcagatgcgcaaactaccctacttccctc

SEQ ID NO: 9498 - DNA, 35 bp, Artificial Sequence
  Synthetic oligonucleotide
tccttaccatcccatacgtgtaagttcttttgtta

SEQ ID NO: 9499 - DNA, 35 bp, Artificial Sequence
  Synthetic oligonucleotide
gttggcctcctctattttccgcaacaccctgtttc

SEQ ID NO: 9500 - DNA, 35 bp, Artificial Sequence
  Synthetic oligonucleotide
taggtggggggacgggtgtagagggcgtggacatg

SEQ ID NO: 9501 - DNA, 36 bp, Artificial Sequence
  Synthetic oligonucleotide
gccacaccacgatcccgcctcgtctatttcatcgga

SEQ ID NO: 9502 - DNA, 35 bp, Artificial Sequence
  Synthetic oligonucleotide
attcacccctcgcctccagcctgttctcgctttta

SEQ ID NO: 9503 - DNA, 35 bp, Artificial Sequence
  Synthetic oligonucleotide
gtcaaccgcatgagtgcgcactgcctcgagcctcc

SEQ ID NO: 9504 - DNA, 36 bp, Artificial Sequence
  Synthetic oligonucleotide
gacggtgtagggtcgggatacaagaaggggatgaca

SEQ ID NO: 9505 - DNA, 35 bp, Artificial Sequence
  Synthetic oligonucleotide
gagcccaaatgggaacgccaatctcctgcaccaca

SEQ ID NO: 9506 - DNA, 37 bp, Artificial Sequence
  Synthetic oligonucleotide
gcacttgccccatcttatattgtcaccgaacttttga

SEQ ID NO: 9507 - DNA, 35 bp, Artificial Sequence
  Synthetic oligonucleotide
atgaccagggactccgtgcgtttactggccccact

SEQ ID NO: 9508 - DNA, 35 bp, Artificial Sequence
  Synthetic oligonucleotide
tcccgtccggccgttctttaccaccgcgcgcctct

SEQ ID NO: 9509 - DNA, 35 bp, Artificial Sequence
  Synthetic oligonucleotide
tttcacccacgttgggcccacgtccttatctgcac

SEQ ID NO: 9510 - DNA, 35 bp, Artificial Sequence
  Synthetic oligonucleotide
gtagccccaaatttcgccgtacaccatcgcctgcc

SEQ ID NO: 9511 - DNA, 36 bp, Artificial Sequence
  Synthetic oligonucleotide
tctgccttacaagtggtacccagccccaactctaca

SEQ ID NO: 9512 - DNA, 35 bp, Artificial Sequence
  Synthetic oligonucleotide
attgtcgctacctctatgctgcctttgcctgggcc

SEQ ID NO: 9513 - DNA, 32 bp, Artificial Sequence
  Synthetic oligonucleotide
tccctgctacgggggccatctattccgcttgc

SEQ ID NO: 9514 - DNA, 35 bp, Artificial Sequence
  Synthetic oligonucleotide
tcaggcactcttcttgcaaacacccgcagccttgc

SEQ ID NO: 9515 - DNA, 35 bp, Artificial Sequence
  Synthetic oligonucleotide
tagcccccccgttatgcctcttactcggccccggt

SEQ ID NO: 9516 - DNA, 36 bp, Artificial Sequence
  Synthetic oligonucleotide
gactgtcttccagcgtctatcagcccccatacccta

SEQ ID NO: 9517 - DNA, 35 bp, Artificial Sequence
  Synthetic oligonucleotide
tccgacgctacggattaattcgtgccccacttctc

SEQ ID NO: 9518 - DNA, 38 bp, Artificial Sequence
  Synthetic oligonucleotide
ttcaaccctcgcattattcacagccatgtctctcatga

SEQ ID NO: 9519 - DNA, 38 bp, Artificial Sequence
  Synthetic oligonucleotide
gcacagcgcacaactattcgtccacgctccctcgctga

SEQ ID NO: 9520 - DNA, 37 bp, Artificial Sequence
  Synthetic oligonucleotide
atcgctcggagacaaaaggagggaggggagggtacga

SEQ ID NO: 9521 - DNA, 35 bp, Artificial Sequence
  Synthetic oligonucleotide
gtcccgtatacgtccaatcgccctggtgaacctcc

SEQ ID NO: 9522 - DNA, 38 bp, Artificial Sequence
  Synthetic oligonucleotide
gcgaggagctacgggcgggagggggtggtatactgtga

SEQ ID NO: 9523 - DNA, 38 bp, Artificial Sequence
  Synthetic oligonucleotide
ggtacacccacatgctctccgcctgcaacttgaattga

SEQ ID NO: 9524 - DNA, 35 bp, Artificial Sequence
  Synthetic oligonucleotide
tacgcactcgacctgttcgttttctttggtctcta

SEQ ID NO: 9525 - DNA, 36 bp, Artificial Sequence
  Synthetic oligonucleotide
actaccccgaccctcgacagtttactgaactgacca

SEQ ID NO: 9526 - DNA, 37 bp, Artificial Sequence
  Synthetic oligonucleotide
accactagccactgcatgacttcaaatgacctgggga

SEQ ID NO: 9527 - DNA, 35 bp, Artificial Sequence
  Synthetic oligonucleotide
atgcccgcccgacatcggttccctcgttcgttaat

SEQ ID NO: 9528 - DNA, 35 bp, Artificial Sequence
  Synthetic oligonucleotide
tcacacgcgattcgttctttctcttgcacgtaggc

SEQ ID NO: 9529 - DNA, 35 bp, Artificial Sequence
  Synthetic oligonucleotide
gcgggagtaggaagggggggcagggattagggcat

SEQ ID NO: 9530 - DNA, 35 bp, Artificial Sequence
  Synthetic oligonucleotide
gtgacttcaggccggcctcacctactcccattgtt

SEQ ID NO: 9531 - DNA, 35 bp, Artificial Sequence
  Synthetic oligonucleotide
attgaccgatgacctcacatgttactcacgcttta

SEQ ID NO: 9532 - DNA, 35 bp, Artificial Sequence
  Synthetic oligonucleotide
gagggcgctttcccgtagttactgtcacctgtacc

SEQ ID NO: 9533 - DNA, 35 bp, Artificial Sequence
  Synthetic oligonucleotide
gattgcaacgaaccgcactccatcaattcttcatg

SEQ ID NO: 9534 - DNA, 35 bp, Artificial Sequence
  Synthetic oligonucleotide
tacacatagggggaggaagggggagatcagttcgc

SEQ ID NO: 9535 - DNA, 37 bp, Artificial Sequence
  Synthetic oligonucleotide
acaacctgcctcttcgtcgcctaagctactcactgga

SEQ ID NO: 9536 - DNA, 36 bp, Artificial Sequence
  Synthetic oligonucleotide
gccgcaagacgcctcgcccagtttctttcgtttgta

SEQ ID NO: 9537 - DNA, 35 bp, Artificial Sequence
  Synthetic oligonucleotide
gtcgcctcctcgcaagaccgccttcaaaccatgca

SEQ ID NO: 9538 - DNA, 35 bp, Artificial Sequence
  Synthetic oligonucleotide
agagccgcacgcccagtcttcggcttgcacacctt

SEQ ID NO: 9539 - DNA, 35 bp, Artificial Sequence
  Synthetic oligonucleotide
tgctgatccaaatctttgctaacttgactttccat

SEQ ID NO: 9540 - DNA, 36 bp, Artificial Sequence
  Synthetic oligonucleotide
tttgggagtggagaggagatgtcggcggtgaggaaa

SEQ ID NO: 9541 - DNA, 35 bp, Artificial Sequence
  Synthetic oligonucleotide
aggggcaaggggtacggaaaggggttaacggggtg

SEQ ID NO: 9542 - DNA, 35 bp, Artificial Sequence
  Synthetic oligonucleotide
ggaccttgcatccgacccgttatccgtatcactgt

SEQ ID NO: 9543 - DNA, 35 bp, Artificial Sequence
  Synthetic oligonucleotide
ttccgaacgtggcaaatgtccgtccccttactctt

SEQ ID NO: 9544 - DNA, 35 bp, Artificial Sequence
  Synthetic oligonucleotide
actcatgccccctcgccattgacacacttgagtat

SEQ ID NO: 9545 - DNA, 37 bp, Artificial Sequence
  Synthetic oligonucleotide
acccaaccctgagggttgagcccatcattatcccgga

SEQ ID NO: 9546 - DNA, 35 bp, Artificial Sequence
  Synthetic oligonucleotide
tgcaccccgaatccgtacccctcatccagctgtcg

SEQ ID NO: 9547 - DNA, 35 bp, Artificial Sequence
  Synthetic oligonucleotide
gtcgccgacgcttccgctttgcaccttagggccct

SEQ ID NO: 9548 - DNA, 36 bp, Artificial Sequence
  Synthetic oligonucleotide
tactgccctcgcgagtctttttttgccgattaccta

SEQ ID NO: 9549 - DNA, 35 bp, Artificial Sequence
  Synthetic oligonucleotide
ccaacaacagacgttgggtctcttcagtcccatac

SEQ ID NO: 9550 - DNA, 35 bp, Artificial Sequence
  Synthetic oligonucleotide
gtcgccatctgagaaccactcccccattctctgtt

SEQ ID NO: 9551 - DNA, 36 bp, Artificial Sequence
  Synthetic oligonucleotide
accacctcacaagcgtatgtcgctgttaccaatcaa

SEQ ID NO: 9552 - DNA, 35 bp, Artificial Sequence
  Synthetic oligonucleotide
agacgcccagccctgcccactatcaattcggagca

SEQ ID NO: 9553 - DNA, 37 bp, Artificial Sequence
  Synthetic oligonucleotide
gtgctgccatcgtggctattccgcgcaccacctccga

SEQ ID NO: 9554 - DNA, 35 bp, Artificial Sequence
  Synthetic oligonucleotide
tcgcccttgccctcctcgtgtttcctgctggatat

SEQ ID NO: 9555 - DNA, 35 bp, Artificial Sequence
  Synthetic oligonucleotide
gtgcacactccccgggctgccttgagctctaatac

SEQ ID NO: 9556 - DNA, 35 bp, Artificial Sequence
  Synthetic oligonucleotide
tatccaccgcactactgaaccctaaccagtcactt

SEQ ID NO: 9557 - DNA, 36 bp, Artificial Sequence
  Synthetic oligonucleotide
tcgctaccacgtttctcgcccacattccctatggca

SEQ ID NO: 9558 - DNA, 35 bp, Artificial Sequence
  Synthetic oligonucleotide
gccaacgacccgtcttctattacattgggctgcac

SEQ ID NO: 9559 - DNA, 35 bp, Artificial Sequence
  Synthetic oligonucleotide
acccacccctctgaatgagcgccccctctttcaat

SEQ ID NO: 9560 - DNA, 35 bp, Artificial Sequence
  Synthetic oligonucleotide
tcacctcacaagcgggcactgttcccgccttaaca

SEQ ID NO: 9561 - DNA, 35 bp, Artificial Sequence
  Synthetic oligonucleotide
tacagcctcccaaaaccaccctgccatgccatgga

SEQ ID NO: 9562 - DNA, 37 bp, Artificial Sequence
  Synthetic oligonucleotide
attccgcacggacacctctgtttcgcctcaaccgtga

SEQ ID NO: 9563 - DNA, 35 bp, Artificial Sequence
  Synthetic oligonucleotide
ttccacccccttccccgtccgatgcctcgtgtgtt

SEQ ID NO: 9564 - DNA, 36 bp, Artificial Sequence
  Synthetic oligonucleotide
attcaccccacatgctacgaacctcacatgacacca

SEQ ID NO: 9565 - DNA, 37 bp, Artificial Sequence
  Synthetic oligonucleotide
tttgcgcaggtccatctgcattggccactttcctcga

SEQ ID NO: 9566 - DNA, 38 bp, Artificial Sequence
  Synthetic oligonucleotide
gcataaccacacctgcactagtgtcggtccacacttga

SEQ ID NO: 9567 - DNA, 36 bp, Artificial Sequence
  Synthetic oligonucleotide
atcacatcacatcaacactactgcaagtttcactaa

SEQ ID NO: 9568 - DNA, 36 bp, Artificial Sequence
  Synthetic oligonucleotide
gctgatccgttcttgttatgccgtgcccatccccta

SEQ ID NO: 9569 - DNA, 35 bp, Artificial Sequence
  Synthetic oligonucleotide
taccttggccaagtggtactattgcccctaactcc

SEQ ID NO: 9570 - DNA, 35 bp, Artificial Sequence
  Synthetic oligonucleotide
tccatccccccctgatactggtaattacaaacacg

SEQ ID NO: 9571 - DNA, 36 bp, Artificial Sequence
  Synthetic oligonucleotide
gtgtgcagagtactgtgatgccgccttctctctgtt

SEQ ID NO: 9572 - DNA, 37 bp, Artificial Sequence
  Synthetic oligonucleotide
tgtccgtcaccgagtcttcccctgcctatttctgcga

SEQ ID NO: 9573 - DNA, 36 bp, Artificial Sequence
  Synthetic oligonucleotide
acgagccccgtcccctgtgaaaccgctgccccacca

SEQ ID NO: 9574 - DNA, 35 bp, Artificial Sequence
  Synthetic oligonucleotide
acaagaatgggggaagggtagcagaatggggaagg

SEQ ID NO: 9575 - DNA, 35 bp, Artificial Sequence
  Synthetic oligonucleotide
gccacatccaccgaatccaccatacattgtgagat

SEQ ID NO: 9576 - DNA, 37 bp, Artificial Sequence
  Synthetic oligonucleotide
tcacctcgcctgctcgtccctttaggtgcacctccga

SEQ ID NO: 9577 - DNA, 37 bp, Artificial Sequence
  Synthetic oligonucleotide
tcgccatcccacctcccatctgccgcaagccacttga

SEQ ID NO: 9578 - DNA, 35 bp, Artificial Sequence
  Synthetic oligonucleotide
gatgcaactctccatcttaggtcataggttacctt

SEQ ID NO: 9579 - DNA, 36 bp, Artificial Sequence
  Synthetic oligonucleotide
gtcagagcacccagtggtctgctacctttcccgtta

SEQ ID NO: 9580 - DNA, 35 bp, Artificial Sequence
  Synthetic oligonucleotide
ggtccacccattgctttatccctcgcacttgcagg

SEQ ID NO: 9581 - DNA, 35 bp, Artificial Sequence
  Synthetic oligonucleotide
attcgtgcccgcctcgtaatgttctcctttgccaa

SEQ ID NO: 9582 - DNA, 36 bp, Artificial Sequence
  Synthetic oligonucleotide
atcgccgtgcccccgccgtccaatcacatgccttga

SEQ ID NO: 9583 - DNA, 35 bp, Artificial Sequence
  Synthetic oligonucleotide
gctgcctccaacgctcctgaacgcttgcttttccg

SEQ ID NO: 9584 - DNA, 35 bp, Artificial Sequence
  Synthetic oligonucleotide
acctacacccgcccaggctgtgtcgatctatccca

SEQ ID NO: 9585 - DNA, 35 bp, Artificial Sequence
  Synthetic oligonucleotide
gcacaagcactatcgcaatacgccgcccccgacaa

SEQ ID NO: 9586 - DNA, 37 bp, Artificial Sequence
  Synthetic oligonucleotide
gaactgggggggatgggaagtaacgtatgcgggatga

SEQ ID NO: 9587 - DNA, 37 bp, Artificial Sequence
  Synthetic oligonucleotide
acatctccccctgaggcttcaagcctgcttataccga

SEQ ID NO: 9588 - DNA, 36 bp, Artificial Sequence
  Synthetic oligonucleotide
aaggacaagaggggaagacgggggaggtgaggagaa

SEQ ID NO: 9589 - DNA, 35 bp, Artificial Sequence
  Synthetic oligonucleotide
tgcgtgccaacatgtcccgcctatttgtactgttc

SEQ ID NO: 9590 - DNA, 35 bp, Artificial Sequence
  Synthetic oligonucleotide
agtgagtagggcgggaggggagtggctgggctaaa

SEQ ID NO: 9591 - DNA, 35 bp, Artificial Sequence
  Synthetic oligonucleotide
actcaccccgtctcatcccgcctggaccctgatag

SEQ ID NO: 9592 - DNA, 36 bp, Artificial Sequence
  Synthetic oligonucleotide
gaacacttcgccacaatgccaacccgcgatttacca

SEQ ID NO: 9593 - DNA, 35 bp, Artificial Sequence
  Synthetic oligonucleotide
accctcacgtggattccgcccttgtgcacgctttt

SEQ ID NO: 9594 - DNA, 35 bp, Artificial Sequence
  Synthetic oligonucleotide
tgtgcaccatctgaacgccccttttggtcacctaa

SEQ ID NO: 9595 - DNA, 35 bp, Artificial Sequence
  Synthetic oligonucleotide
ccatcgcacctccctttaatgcctgtccacatgcc

SEQ ID NO: 9596 - DNA, 35 bp, Artificial Sequence
  Synthetic oligonucleotide
tccagtccaggcttatggtcgttggcccttttcct

SEQ ID NO: 9597 - DNA, 35 bp, Artificial Sequence
  Synthetic oligonucleotide
tgaccgtgcccaacgtttgcgtctcgctcgtctct

SEQ ID NO: 9598 - DNA, 37 bp, Artificial Sequence
  Synthetic oligonucleotide
aacgagccacggggggaagggtgggatcaaagtcaga

SEQ ID NO: 9599 - DNA, 36 bp, Artificial Sequence
  Synthetic oligonucleotide
gcctaacgccgccggacctcagacttcctcctgcaa

SEQ ID NO: 9600 - DNA, 37 bp, Artificial Sequence
  Synthetic oligonucleotide
catcctactgccaattcacatgtttacgatgcctcga

SEQ ID NO: 9601 - DNA, 37 bp, Artificial Sequence
  Synthetic oligonucleotide
tgttgccctcccgattagccattgcgacctaacttga

SEQ ID NO: 9602 - DNA, 35 bp, Artificial Sequence
  Synthetic oligonucleotide
tcaagggcgcccaacggtgattcctcattttctac

SEQ ID NO: 9603 - DNA, 35 bp, Artificial Sequence
  Synthetic oligonucleotide
gttcgcatacgctgggcccttactagtagctcctc

SEQ ID NO: 9604 - DNA, 35 bp, Artificial Sequence
  Synthetic oligonucleotide
ttagcggcgcccgtatcctttctgctcctgttctt

SEQ ID NO: 9605 - DNA, 35 bp, Artificial Sequence
  Synthetic oligonucleotide
attccctgcacaaacctcccttctcaacggagtga

SEQ ID NO: 9606 - DNA, 34 bp, Artificial Sequence
  Synthetic oligonucleotide
gagtaaccccctgtcactgagctgtccccttacc

SEQ ID NO: 9607 - DNA, 35 bp, Artificial Sequence
  Synthetic oligonucleotide
gaacaaaagcgcaccactgtcaaactaggcctccc

SEQ ID NO: 9608 - DNA, 35 bp, Artificial Sequence
  Synthetic oligonucleotide
tacagctcaggtccacgcctttatccactctcgtc

SEQ ID NO: 9609 - DNA, 35 bp, Artificial Sequence
  Synthetic oligonucleotide
acgacgccgctaatctgcttccggggctgccttct

SEQ ID NO: 9610 - DNA, 36 bp, Artificial Sequence
  Synthetic oligonucleotide
tgccgggccgcacgccaccttgcgcctcccctctta

SEQ ID NO: 9611 - DNA, 35 bp, Artificial Sequence
  Synthetic oligonucleotide
ggtgcgtgagtagggtagggcggggggatgattga

SEQ ID NO: 9612 - DNA, 36 bp, Artificial Sequence
  Synthetic oligonucleotide
atccagcctcctatgcaccgcgctgatctttttcta

SEQ ID NO: 9613 - DNA, 35 bp, Artificial Sequence
  Synthetic oligonucleotide
gccttcgctccatcctctatcacaccaaatatggc

SEQ ID NO: 9614 - DNA, 35 bp, Artificial Sequence
  Synthetic oligonucleotide
ttccagtgcgctgccacttagtgcctccaacttgc

SEQ ID NO: 9615 - DNA, 35 bp, Artificial Sequence
  Synthetic oligonucleotide
tacacacgacccgcctgtcattgcccatgtacgca

SEQ ID NO: 9616 - DNA, 36 bp, Artificial Sequence
  Synthetic oligonucleotide
gccaccattagttgcgtttacgctcaccattcttga

SEQ ID NO: 9617 - DNA, 35 bp, Artificial Sequence
  Synthetic oligonucleotide
catccaaccatggaaacgttctaacaggctgacct

SEQ ID NO: 9618 - DNA, 35 bp, Artificial Sequence
  Synthetic oligonucleotide
tttacgtccgaccctgccctttgcgcgtccctgac

SEQ ID NO: 9619 - DNA, 35 bp, Artificial Sequence
  Synthetic oligonucleotide
tcattaccaccttatcctgtccatacgcgccttcg

SEQ ID NO: 9620 - DNA, 35 bp, Artificial Sequence
  Synthetic oligonucleotide
gttggcgggtgggtaggggaggcggaagggcggtg

SEQ ID NO: 9621 - DNA, 38 bp, Artificial Sequence
  Synthetic oligonucleotide
ggggagagagagggtgccaaggatgggcgagagggtga

SEQ ID NO: 9622 - DNA, 35 bp, Artificial Sequence
  Synthetic oligonucleotide
tccgatacacacaagtttctaccatgaaccgttcc

SEQ ID NO: 9623 - DNA, 35 bp, Artificial Sequence
  Synthetic oligonucleotide
gacacagctggagagatgtcacgtttcctgccccc

SEQ ID NO: 9624 - DNA, 37 bp, Artificial Sequence
  Synthetic oligonucleotide
gccgaacaatgagggggtggagtggcgaggttcggga

SEQ ID NO: 9625 - DNA, 35 bp, Artificial Sequence
  Synthetic oligonucleotide
acaaccgccacgctcctccttattgttggcaatcc

SEQ ID NO: 9626 - DNA, 38 bp, Artificial Sequence
  Synthetic oligonucleotide
aagtagggggagggcgaggtgagagttaggaggggtga

SEQ ID NO: 9627 - DNA, 34 bp, Artificial Sequence
  Synthetic oligonucleotide
tgaccaccaccttgagtcgagcttcattcacttc

SEQ ID NO: 9628 - DNA, 38 bp, Artificial Sequence
  Synthetic oligonucleotide
agcacccccgccttgtcttgttccgtgctaattcttga

SEQ ID NO: 9629 - DNA, 37 bp, Artificial Sequence
  Synthetic oligonucleotide
gcaacaagaacgaggaagggagggacgcaaataggga

SEQ ID NO: 9630 - DNA, 35 bp, Artificial Sequence
  Synthetic oligonucleotide
tgcactgtacatctctttgcagccacctaccctac

SEQ ID NO: 9631 - DNA, 35 bp, Artificial Sequence
  Synthetic oligonucleotide
accgaggcgatcccgatccgtacgttctgcttacc

SEQ ID NO: 9632 - DNA, 35 bp, Artificial Sequence
  Synthetic oligonucleotide
atctccctcaccgcgcctcatcttgcctcctgccc

SEQ ID NO: 9633 - DNA, 34 bp, Artificial Sequence
  Synthetic oligonucleotide
gattccgttccatctcaccgagaccccgctctcc

SEQ ID NO: 9634 - DNA, 35 bp, Artificial Sequence
  Synthetic oligonucleotide
agtgccttgccaactgctcctccactcacctgtcc

SEQ ID NO: 9635 - DNA, 35 bp, Artificial Sequence
  Synthetic oligonucleotide
acttcaaccagtcgcccacttcatacgtcccacgg

SEQ ID NO: 9636 - DNA, 37 bp, Artificial Sequence
  Synthetic oligonucleotide
gcacgctaccaccatggaaattatctgcagtatgcga

SEQ ID NO: 9637 - DNA, 35 bp, Artificial Sequence
  Synthetic oligonucleotide
gttgcctccagctgctctcggtcacctttgtcccc

SEQ ID NO: 9638 - DNA, 35 bp, Artificial Sequence
  Synthetic oligonucleotide
gtgtcctcccccattgtcctttttattaggttgcc

SEQ ID NO: 9639 - DNA, 35 bp, Artificial Sequence
  Synthetic oligonucleotide
ttccaccgcgcggtactgccacaacctgacacatg

SEQ ID NO: 9640 - DNA, 36 bp, Artificial Sequence
  Synthetic oligonucleotide
tcaccccactatcgtattggtccttcgctaactaca

SEQ ID NO: 9641 - DNA, 36 bp, Artificial Sequence
  Synthetic oligonucleotide
gggggtggggggggttcgggccgggactgacatcga

SEQ ID NO: 9642 - DNA, 35 bp, Artificial Sequence
  Synthetic oligonucleotide
gcgccaatcggccaaagttccagcccccatctcga

SEQ ID NO: 9643 - DNA, 37 bp, Artificial Sequence
  Synthetic oligonucleotide
gtccacgccacttcctccgcacacagtctacagtgga

SEQ ID NO: 9644 - DNA, 36 bp, Artificial Sequence
  Synthetic oligonucleotide
atacccgcaacttgtcccttacgtacactactgtca

SEQ ID NO: 9645 - DNA, 38 bp, Artificial Sequence
  Synthetic oligonucleotide
attctccgcctgacgcctcatattgcccatgttgttga

SEQ ID NO: 9646 - DNA, 35 bp, Artificial Sequence
  Synthetic oligonucleotide
tacctgccccgctacctcacacattaccctgtaga

SEQ ID NO: 9647 - DNA, 38 bp, Artificial Sequence
  Synthetic oligonucleotide
gtccgaaggacgcagccttcctttttcccccttcctga

SEQ ID NO: 9648 - DNA, 35 bp, Artificial Sequence
  Synthetic oligonucleotide
tctctccggcaccattgtttccgttttctgtttct

SEQ ID NO: 9649 - DNA, 37 bp, Artificial Sequence
  Synthetic oligonucleotide
gcaccatcagttttcttccttgttccatctaatcgga

SEQ ID NO: 9650 - DNA, 35 bp, Artificial Sequence
  Synthetic oligonucleotide
gcgctccgtagcattccaccaagcactaggtctcc

SEQ ID NO: 9651 - DNA, 35 bp, Artificial Sequence
  Synthetic oligonucleotide
acatcccgcgcaagtccatttcatcccatctggtc

SEQ ID NO: 9652 - DNA, 36 bp, Artificial Sequence
  Synthetic oligonucleotide
aacgccactaccggccctatccatgcactgttaaaa

SEQ ID NO: 9653 - DNA, 36 bp, Artificial Sequence
  Synthetic oligonucleotide
accccacctctgccctctttagactgaactattcga

SEQ ID NO: 9654 - DNA, 35 bp, Artificial Sequence
  Synthetic oligonucleotide
tccctgcccattttgtacatctcaatctcagttac

SEQ ID NO: 9655 - DNA, 35 bp, Artificial Sequence
  Synthetic oligonucleotide
tcctccatgacgcactccaccccagggtcaccctg

SEQ ID NO: 9656 - DNA, 35 bp, Artificial Sequence
  Synthetic oligonucleotide
aacagcccctcactccatcctgccagatgccttat

SEQ ID NO: 9657 - DNA, 35 bp, Artificial Sequence
  Synthetic oligonucleotide
ttcattccaccccaggcgcacagttccgcgcatct

SEQ ID NO: 9658 - DNA, 35 bp, Artificial Sequence
  Synthetic oligonucleotide
tgtccaggggaggggataacgcggggtccatgggg

SEQ ID NO: 9659 - DNA, 35 bp, Artificial Sequence
  Synthetic oligonucleotide
gacgcaaaaacggcggggggacacaggagcttgaa

SEQ ID NO: 9660 - DNA, 35 bp, Artificial Sequence
  Synthetic oligonucleotide
gtggccgccagccatcccataaacaccgtatccct

SEQ ID NO: 9661 - DNA, 35 bp, Artificial Sequence
  Synthetic oligonucleotide
taaacatggcggctaccgatcctgtccccgttaca

SEQ ID NO: 9662 - DNA, 36 bp, Artificial Sequence
  Synthetic oligonucleotide
agcccaccctgtcgtagtcgtctttagccccccgca

SEQ ID NO: 9663 - DNA, 37 bp, Artificial Sequence
  Synthetic oligonucleotide
ccaccgaaacttcgatgaagcctttcaccgcctccga

SEQ ID NO: 9664 - DNA, 36 bp, Artificial Sequence
  Synthetic oligonucleotide
ttagccagcagctgctaccgacgcaatacctgccta

SEQ ID NO: 9665 - DNA, 35 bp, Artificial Sequence
  Synthetic oligonucleotide
gcctctccacgtgctttactgcgctccaactgcac

SEQ ID NO: 9666 - DNA, 38 bp, Artificial Sequence
  Synthetic oligonucleotide
aacacgccccattgatcctgtcccagctcaccctttga

SEQ ID NO: 9667 - DNA, 35 bp, Artificial Sequence
  Synthetic oligonucleotide
gccaccctccactccacctgacctgaagaatgccc

SEQ ID NO: 9668 - DNA, 36 bp, Artificial Sequence
  Synthetic oligonucleotide
tcacacacgcacaccgagacccctgcctctacgcaa

SEQ ID NO: 9669 - DNA, 37 bp, Artificial Sequence
  Synthetic oligonucleotide
gagtgggagttggtaagggaggatgtaggggaacgga

SEQ ID NO: 9670 - DNA, 35 bp, Artificial Sequence
  Synthetic oligonucleotide
atccacggccgagatctttcgtttcattccgggcc

SEQ ID NO: 9671 - DNA, 35 bp, Artificial Sequence
  Synthetic oligonucleotide
tcttgtaggcacaccatcgcatcaccactggttca

SEQ ID NO: 9672 - DNA, 36 bp, Artificial Sequence
  Synthetic oligonucleotide
gcatcagtagtctcctcggcccaaacacactttcta

SEQ ID NO: 9673 - DNA, 35 bp, Artificial Sequence
  Synthetic oligonucleotide
agtccacccacacattcggggccttgacatggtta

SEQ ID NO: 9674 - DNA, 38 bp, Artificial Sequence
  Synthetic oligonucleotide
accacctcacaggtggccaaagaaatcactgttcctga

SEQ ID NO: 9675 - DNA, 35 bp, Artificial Sequence
  Synthetic oligonucleotide
gacccgccggagccgactatacttacgcccatgca

SEQ ID NO: 9676 - DNA, 35 bp, Artificial Sequence
  Synthetic oligonucleotide
agacgcaatcgatccatccagcttagggcttccac

SEQ ID NO: 9677 - DNA, 35 bp, Artificial Sequence
  Synthetic oligonucleotide
aaccactgcgccgaccctagcctcattactctcgt

SEQ ID NO: 9678 - DNA, 35 bp, Artificial Sequence
  Synthetic oligonucleotide
aaaggaggaggtggggataggggtggcgggcgggt

SEQ ID NO: 9679 - DNA, 35 bp, Artificial Sequence
  Synthetic oligonucleotide
tgcgccactcctacgtgactttcaccccaccagca

SEQ ID NO: 9680 - DNA, 35 bp, Artificial Sequence
  Synthetic oligonucleotide
acacacccatcgatccgagagggccatgtctcctt

SEQ ID NO: 9681 - DNA, 38 bp, Artificial Sequence
  Synthetic oligonucleotide
actcccgcctcataggccgtttcctgaactctcgttga

SEQ ID NO: 9682 - DNA, 35 bp, Artificial Sequence
  Synthetic oligonucleotide
actgtacaccccagtgctttcttggtcgctggacc

SEQ ID NO: 9683 - DNA, 35 bp, Artificial Sequence
  Synthetic oligonucleotide
tcagtaaccacacagtgctctttctccccattgtc

SEQ ID NO: 9684 - DNA, 38 bp, Artificial Sequence
  Synthetic oligonucleotide
aggacgagcacgtgtcacattatccgccccttgcctga

SEQ ID NO: 9685 - DNA, 36 bp, Artificial Sequence
  Synthetic oligonucleotide
acccagggccccatgcgcctctacttctgccacata

SEQ ID NO: 9686 - DNA, 35 bp, Artificial Sequence
  Synthetic oligonucleotide
tctcacaccgcacgttttggacgttccattatcac

SEQ ID NO: 9687 - DNA, 37 bp, Artificial Sequence
  Synthetic oligonucleotide
gtgccccctccaccccgtaatcatggacttccgagga

SEQ ID NO: 9688 - DNA, 36 bp, Artificial Sequence
  Synthetic oligonucleotide
gagcacaccgaacggttgctccatacaccctgccta

SEQ ID NO: 9689 - DNA, 36 bp, Artificial Sequence
  Synthetic oligonucleotide
gtgtcacaccagagcgaacggcttactacatcttta

SEQ ID NO: 9690 - DNA, 36 bp, Artificial Sequence
  Synthetic oligonucleotide
taagcctcacccactgctgccccgtcgacctccgta

SEQ ID NO: 9691 - DNA, 35 bp, Artificial Sequence
  Synthetic oligonucleotide
gccgctacatctaacgcattacgccgctggtcctc

SEQ ID NO: 9692 - DNA, 35 bp, Artificial Sequence
  Synthetic oligonucleotide
tcctggcctccgcatgttgcaaatttccctctctc

SEQ ID NO: 9693 - DNA, 35 bp, Artificial Sequence
  Synthetic oligonucleotide
gacacaccttggatggcatccgtaatacgctccac

SEQ ID NO: 9694 - DNA, 36 bp, Artificial Sequence
  Synthetic oligonucleotide
accacgcccgcctgcacttccacaaggactctttga

SEQ ID NO: 9695 - DNA, 35 bp, Artificial Sequence
  Synthetic oligonucleotide
tccgctctatcgcagctaagctttttccatcgtcc

SEQ ID NO: 9696 - DNA, 38 bp, Artificial Sequence
  Synthetic oligonucleotide
accgcacggtacgcgcctcacacctccatcacatttga

SEQ ID NO: 9697 - DNA, 36 bp, Artificial Sequence
  Synthetic oligonucleotide
taggacacgagggcacaatctgaatggggtgggaaa

SEQ ID NO: 9698 - DNA, 35 bp, Artificial Sequence
  Synthetic oligonucleotide
actaccgcccttcatgtcttggtgctcccttgaga

SEQ ID NO: 9699 - DNA, 38 bp, Artificial Sequence
  Synthetic oligonucleotide
ggagggacgggaaacagggaaaagggtctgagacatga

SEQ ID NO: 9700 - DNA, 36 bp, Artificial Sequence
  Synthetic oligonucleotide
acaccagccacaccgtacgccattttcatagaacca

SEQ ID NO: 9701 - DNA, 35 bp, Artificial Sequence
  Synthetic oligonucleotide
actcgtcctgcattccgcccaactcgttcacttcg

SEQ ID NO: 9702 - DNA, 36 bp, Artificial Sequence
  Synthetic oligonucleotide
gcgtgagcacgggttagggaggtttgggggcttgaa

SEQ ID NO: 9703 - DNA, 35 bp, Artificial Sequence
  Synthetic oligonucleotide
acgcccgtatatctaccgtgcaccagttcaccatc

SEQ ID NO: 9704 - DNA, 36 bp, Artificial Sequence
  Synthetic oligonucleotide
tgccactaccatgaatggatttggtcccccgtttta

SEQ ID NO: 9705 - DNA, 36 bp, Artificial Sequence
  Synthetic oligonucleotide
atacacgcacgctgggcgtcgaccacctcgctatca

SEQ ID NO: 9706 - DNA, 35 bp, Artificial Sequence
  Synthetic oligonucleotide
gacgggtactaagcaggagggagattggaaggaga

SEQ ID NO: 9707 - DNA, 38 bp, Artificial Sequence
  Synthetic oligonucleotide
tgttacgcccactgtgccccgccaccgtctttacgtga

SEQ ID NO: 9708 - DNA, 35 bp, Artificial Sequence
  Synthetic oligonucleotide
gctgtaccgttggcctctttgcaagactccacttc

SEQ ID NO: 9709 - DNA, 35 bp, Artificial Sequence
  Synthetic oligonucleotide
tagtgttgcctctccccgttggtgttttgtccctg

SEQ ID NO: 9710 - DNA, 35 bp, Artificial Sequence
  Synthetic oligonucleotide
actccgcccgacgggtgtccatgatcctcctattg

SEQ ID NO: 9711 - DNA, 35 bp, Artificial Sequence
  Synthetic oligonucleotide
gcaccgctgggctttaccacatcatttcaccttct

SEQ ID NO: 9712 - DNA, 35 bp, Artificial Sequence
  Synthetic oligonucleotide
accctgactctatggcacgatatccccctggccca

SEQ ID NO: 9713 - DNA, 35 bp, Artificial Sequence
  Synthetic oligonucleotide
gtccggtggtcagacgccgctccttcgtccatccc

SEQ ID NO: 9714 - DNA, 35 bp, Artificial Sequence
  Synthetic oligonucleotide
acgctaacccgcactctatccaggacaaaccagct

SEQ ID NO: 9715 - DNA, 37 bp, Artificial Sequence
  Synthetic oligonucleotide
taccgcggccccattctccccgtacgcacttttgtga

SEQ ID NO: 9716 - DNA, 35 bp, Artificial Sequence
  Synthetic oligonucleotide
atccgcatctcccacacggactacagaattgactt

SEQ ID NO: 9717 - DNA, 37 bp, Artificial Sequence
  Synthetic oligonucleotide
tcatcctgcccgtacgcaactgtcctcacactggcga

SEQ ID NO: 9718 - DNA, 35 bp, Artificial Sequence
  Synthetic oligonucleotide
ggggcggggggggcacgggacggaatagcgtttac

SEQ ID NO: 9719 - DNA, 38 bp, Artificial Sequence
  Synthetic oligonucleotide
atgctgagtgtgtagggtgtggggggggctggtgttga

SEQ ID NO: 9720 - DNA, 36 bp, Artificial Sequence
  Synthetic oligonucleotide
gcctgcctgcacttgtctcccttggcctatcttgaa

SEQ ID NO: 9721 - DNA, 36 bp, Artificial Sequence
  Synthetic oligonucleotide
tccgaccgcacccctcccagaatttgtccattgtca

SEQ ID NO: 9722 - DNA, 37 bp, Artificial Sequence
  Synthetic oligonucleotide
ttccacctcactggtgccttctcttttcagttacgga

SEQ ID NO: 9723 - DNA, 35 bp, Artificial Sequence
  Synthetic oligonucleotide
gactccaagtcccggttccttgccaacatagtccc

SEQ ID NO: 9724 - DNA, 35 bp, Artificial Sequence
  Synthetic oligonucleotide
tcagctggccccagatcaccctccgcactatcatg

SEQ ID NO: 9725 - DNA, 35 bp, Artificial Sequence
  Synthetic oligonucleotide
tcccatcatacctccgacaagtgctacgcgcactg

SEQ ID NO: 9726 - DNA, 36 bp, Artificial Sequence
  Synthetic oligonucleotide
gtgtcacggactactcttttgcctgttaattcacaa

SEQ ID NO: 9727 - DNA, 35 bp, Artificial Sequence
  Synthetic oligonucleotide
tccaccgcctgttctcccctcttagtgaatagacg

SEQ ID NO: 9728 - DNA, 33 bp, Artificial Sequence
  Synthetic oligonucleotide
gaccactcaagcctcgttaccctactttcgttc

SEQ ID NO: 9729 - DNA, 35 bp, Artificial Sequence
  Synthetic oligonucleotide
aacccgaactgactgtccaagccccattcgttttc

SEQ ID NO: 9730 - DNA, 35 bp, Artificial Sequence
  Synthetic oligonucleotide
gcatgtcgacccgcccgatcttcccgtgtcctgaa

SEQ ID NO: 9731 - DNA, 35 bp, Artificial Sequence
  Synthetic oligonucleotide
gcaccgaactcgttcggaaaactcacttggttccc

SEQ ID NO: 9732 - DNA, 35 bp, Artificial Sequence
  Synthetic oligonucleotide
tgccggccacactccggttctgtaatttcccgtcc

SEQ ID NO: 9733 - DNA, 35 bp, Artificial Sequence
  Synthetic oligonucleotide
accacacacatcacctgtctagcgttccgttacgc

SEQ ID NO: 9734 - DNA, 38 bp, Artificial Sequence
  Synthetic oligonucleotide
gccccccggccaatcttagaacgtacccatgcccgtga

SEQ ID NO: 9735 - DNA, 35 bp, Artificial Sequence
  Synthetic oligonucleotide
tccagagcgtaggtttttcgttcgtgccccaactt

SEQ ID NO: 9736 - DNA, 36 bp, Artificial Sequence
  Synthetic oligonucleotide
atagtccctgtccactgttttgctgctatggccctt

SEQ ID NO: 9737 - DNA, 38 bp, Artificial Sequence
  Synthetic oligonucleotide
atccaccctcatctggcttaatttgtctcttcgtgtga

SEQ ID NO: 9738 - DNA, 36 bp, Artificial Sequence
  Synthetic oligonucleotide
atcactgggggggcaagtggaggagtagggcggtaa

SEQ ID NO: 9739 - DNA, 36 bp, Artificial Sequence
  Synthetic oligonucleotide
tagtcccacgcaatgctgcgatttcatgcccccaca

SEQ ID NO: 9740 - DNA, 38 bp, Artificial Sequence
  Synthetic oligonucleotide
gtgatgggcgggaaggggcgtaggactgtaagggatga

SEQ ID NO: 9741 - DNA, 36 bp, Artificial Sequence
  Synthetic oligonucleotide
taggtcctcttccgactactatctgtcctgtttcta

SEQ ID NO: 9742 - DNA, 35 bp, Artificial Sequence
  Synthetic oligonucleotide
acagcgcctcccgtctctttacacttcactccgcg

SEQ ID NO: 9743 - DNA, 35 bp, Artificial Sequence
  Synthetic oligonucleotide
ggtcaacgatccgctatcccgttccaccctgctcg

SEQ ID NO: 9744 - DNA, 35 bp, Artificial Sequence
  Synthetic oligonucleotide
gccccaacccgtgccggaactagccttgactcttt

SEQ ID NO: 9745 - DNA, 36 bp, Artificial Sequence
  Synthetic oligonucleotide
atgccgtgccgccctgtcttcgcctttccagtggaa

SEQ ID NO: 9746 - DNA, 37 bp, Artificial Sequence
  Synthetic oligonucleotide
gtgaggcatgggatcgggtaggggaggggatcacaga

SEQ ID NO: 9747 - DNA, 35 bp, Artificial Sequence
  Synthetic oligonucleotide
ccctgctcacacgcttacccatgtatacaggtgtg

SEQ ID NO: 9748 - DNA, 35 bp, Artificial Sequence
  Synthetic oligonucleotide
accgacattcctttgccctaccagatttcaatctg

SEQ ID NO: 9749 - DNA, 35 bp, Artificial Sequence
  Synthetic oligonucleotide
attgggcggggttgggggcgggactaacagagaga

SEQ ID NO: 9750 - DNA, 35 bp, Artificial Sequence
  Synthetic oligonucleotide
tcccccctcgacgtcccaagtcctataacacgttt

SEQ ID NO: 9751 - DNA, 35 bp, Artificial Sequence
  Synthetic oligonucleotide
gacgccgcccggccttcaacccgacccaacgcaca

SEQ ID NO: 9752 - DNA, 36 bp, Artificial Sequence
  Synthetic oligonucleotide
agtacgcctgcacgccactccatactgatctgttcg

SEQ ID NO: 9753 - DNA, 34 bp, Artificial Sequence
  Synthetic oligonucleotide
gttcacgcatccatatcggtcgtttacctctcat

SEQ ID NO: 9754 - DNA, 35 bp, Artificial Sequence
  Synthetic oligonucleotide
tcccaactatcgcccttgtcgccttactgccccct

SEQ ID NO: 9755 - DNA, 35 bp, Artificial Sequence
  Synthetic oligonucleotide
gtactcccccaggagatttatatactgttcctgcc

SEQ ID NO: 9756 - DNA, 35 bp, Artificial Sequence
  Synthetic oligonucleotide
gaccaccgaacaccatcactgcgtttatcgtttgc

SEQ ID NO: 9757 - DNA, 35 bp, Artificial Sequence
  Synthetic oligonucleotide
actgcgagggtccatgagcccgttatgttcctccc

SEQ ID NO: 9758 - DNA, 35 bp, Artificial Sequence
  Synthetic oligonucleotide
taatgccactgccgctatagtccatgctcttctat

SEQ ID NO: 9759 - DNA, 36 bp, Artificial Sequence
  Synthetic oligonucleotide
gggagggtgggaaggtagcttggggcttaggagaaa

SEQ ID NO: 9760 - DNA, 35 bp, Artificial Sequence
  Synthetic oligonucleotide
tcatctgccgacgacctccaactggttttgcctcg

SEQ ID NO: 9761 - DNA, 35 bp, Artificial Sequence
  Synthetic oligonucleotide
gtcaacgacgcacgcccctcctacgtcaccactgg

SEQ ID NO: 9762 - DNA, 38 bp, Artificial Sequence
  Synthetic oligonucleotide
accgcgctagcactgcccttgtcgaaccatctctatga

SEQ ID NO: 9763 - DNA, 35 bp, Artificial Sequence
  Synthetic oligonucleotide
gtggacggacgttcttgctccccctcatgtttttg

SEQ ID NO: 9764 - DNA, 35 bp, Artificial Sequence
  Synthetic oligonucleotide
accacagcgctccattgaccgacgctaccaattca

SEQ ID NO: 9765 - DNA, 37 bp, Artificial Sequence
  Synthetic oligonucleotide
acgatcacctctcagatacggttcttcctcctgccga

SEQ ID NO: 9766 - DNA, 35 bp, Artificial Sequence
  Synthetic oligonucleotide
gacgcccaccgcctcgctcttgcacacattcctgc

SEQ ID NO: 9767 - DNA, 35 bp, Artificial Sequence
  Synthetic oligonucleotide
tgcccaactatagttcctgcccatctgatagatct

SEQ ID NO: 9768 - DNA, 37 bp, Artificial Sequence
  Synthetic oligonucleotide
actcacctcatgggatctcggtgttcctttccttcga

SEQ ID NO: 9769 - DNA, 38 bp, Artificial Sequence
  Synthetic oligonucleotide
taggtaggcccctgcacgacgcgtaaccattttgctga

SEQ ID NO: 9770 - DNA, 35 bp, Artificial Sequence
  Synthetic oligonucleotide
tgaaagatcgcggggaggaggaggaaggaaacaac

SEQ ID NO: 9771 - DNA, 35 bp, Artificial Sequence
  Synthetic oligonucleotide
agcctaccgcccctcccgcattcgccatcgaggcc

SEQ ID NO: 9772 - DNA, 35 bp, Artificial Sequence
  Synthetic oligonucleotide
gatgaaccacctgccaccactctccgtctcgtgcc

SEQ ID NO: 9773 - DNA, 36 bp, Artificial Sequence
  Synthetic oligonucleotide
gcagcctcccatgctctacctacttcggcctgtcca

SEQ ID NO: 9774 - DNA, 35 bp, Artificial Sequence
  Synthetic oligonucleotide
actcgtcccgaaataccagtgatgtctgctcccat

SEQ ID NO: 9775 - DNA, 38 bp, Artificial Sequence
  Synthetic oligonucleotide
tagcgaacagtgctttcgggtgggaggggagggactga

SEQ ID NO: 9776 - DNA, 35 bp, Artificial Sequence
  Synthetic oligonucleotide
gatgcactctccttttcgttcatatgaaaccttta

SEQ ID NO: 9777 - DNA, 35 bp, Artificial Sequence
  Synthetic oligonucleotide
ggatcctcccgtcccagccccctggatcactcacc

SEQ ID NO: 9778 - DNA, 35 bp, Artificial Sequence
  Synthetic oligonucleotide
tgtcacagtccatccgggcaaaccatccacatctg

SEQ ID NO: 9779 - DNA, 35 bp, Artificial Sequence
  Synthetic oligonucleotide
gtgtccgacatgtcctaaccgcctatcacgcgcct

SEQ ID NO: 9780 - DNA, 37 bp, Artificial Sequence
  Synthetic oligonucleotide
gtgcagaaggggacactggagggttaaggagggagga

SEQ ID NO: 9781 - DNA, 35 bp, Artificial Sequence
  Synthetic oligonucleotide
cactgtgccccgctatttggtgcaaacatcgagtt

SEQ ID NO: 9782 - DNA, 36 bp, Artificial Sequence
  Synthetic oligonucleotide
aaaccgcacctgcaatgagcctcgggcctttcttaa

SEQ ID NO: 9783 - DNA, 35 bp, Artificial Sequence
  Synthetic oligonucleotide
gcctttggccaatctgcatctagaactcatcctgt

SEQ ID NO: 9784 - DNA, 36 bp, Artificial Sequence
  Synthetic oligonucleotide
tagtgacagtcgctcactctgatctaactaacggta

SEQ ID NO: 9785 - DNA, 35 bp, Artificial Sequence
  Synthetic oligonucleotide
actgagcgccgacttcgccctctgtttgacttctc

SEQ ID NO: 9786 - DNA, 35 bp, Artificial Sequence
  Synthetic oligonucleotide
gaaccgcccaactggtatcgccgtatgaaaacaca

SEQ ID NO: 9787 - DNA, 35 bp, Artificial Sequence
  Synthetic oligonucleotide
gcccgatacctagccaaccactatccctgcttgtg

SEQ ID NO: 9788 - DNA, 35 bp, Artificial Sequence
  Synthetic oligonucleotide
gattgccccggcctggatcacgcgctcctctccaa

SEQ ID NO: 9789 - DNA, 35 bp, Artificial Sequence
  Synthetic oligonucleotide
acaagcacgccgttccagcccctcagttactccat

SEQ ID NO: 9790 - DNA, 36 bp, Artificial Sequence
  Synthetic oligonucleotide
gaccccggcccatctacaccatgcccagtgcaccaa

SEQ ID NO: 9791 - DNA, 35 bp, Artificial Sequence
  Synthetic oligonucleotide
gatgtcctctgcctaataccattgatcgaccctgc

SEQ ID NO: 9792 - DNA, 35 bp, Artificial Sequence
  Synthetic oligonucleotide
tccctacgccccctcacgacctcgatcgcataacg

SEQ ID NO: 9793 - DNA, 35 bp, Artificial Sequence
  Synthetic oligonucleotide
agccgccacactccgagttactatcctcccgcact

SEQ ID NO: 9794 - DNA, 35 bp, Artificial Sequence
  Synthetic oligonucleotide
gagccgaacagccgcctctcgttaccattccattt

SEQ ID NO: 9795 - DNA, 35 bp, Artificial Sequence
  Synthetic oligonucleotide
ttgacctagtgcagccgtaccctctcgttgctagt

SEQ ID NO: 9796 - DNA, 35 bp, Artificial Sequence
  Synthetic oligonucleotide
tcagccaccccgccaattccgatgaagttttccgc

SEQ ID NO: 9797 - DNA, 35 bp, Artificial Sequence
  Synthetic oligonucleotide
gccggggcgggatcatgggggggaaggggtggtcg

SEQ ID NO: 9798 - DNA, 35 bp, Artificial Sequence
  Synthetic oligonucleotide
actcctcgtcgggcctcaaattgtcgccgcttggt

SEQ ID NO: 9799 - DNA, 35 bp, Artificial Sequence
  Synthetic oligonucleotide
aacgtgacacccttcaccacgaatttcattatgtc

SEQ ID NO: 9800 - DNA, 37 bp, Artificial Sequence
  Synthetic oligonucleotide
tagttcgtgcctattgttaatcccatcctcttgcaga

SEQ ID NO: 9801 - DNA, 35 bp, Artificial Sequence
  Synthetic oligonucleotide
aatggccccgcctccgcattctgatctcgatcgct

SEQ ID NO: 9802 - DNA, 36 bp, Artificial Sequence
  Synthetic oligonucleotide
gctcccagccctttcccgtaataccagcttgctaga

SEQ ID NO: 9803 - DNA, 38 bp, Artificial Sequence
  Synthetic oligonucleotide
gggtgctggggggggttgggctggggaaagcgcgatga

SEQ ID NO: 9804 - DNA, 35 bp, Artificial Sequence
  Synthetic oligonucleotide
gcacgacacctcatgccaatctcctcgcctcaggt

SEQ ID NO: 9805 - DNA, 36 bp, Artificial Sequence
  Synthetic oligonucleotide
gttgcgtgctgcagggaaacgctccatcttatcgaa

SEQ ID NO: 9806 - DNA, 35 bp, Artificial Sequence
  Synthetic oligonucleotide
tccgactatgcaccgtacctctactccgtttgccg

SEQ ID NO: 9807 - DNA, 36 bp, Artificial Sequence
  Synthetic oligonucleotide
tacaccgcaacgggctaaacgttcattcgcctctta

SEQ ID NO: 9808 - DNA, 35 bp, Artificial Sequence
  Synthetic oligonucleotide
gatccctacgccgtgctattctcagtcccgtcgcc

SEQ ID NO: 9809 - DNA, 35 bp, Artificial Sequence
  Synthetic oligonucleotide
tacatggagcgggtgagagggggggacggcatctt

SEQ ID NO: 9810 - DNA, 35 bp, Artificial Sequence
  Synthetic oligonucleotide
tccaccgcctggcatgacccatgcgctcacttctt

SEQ ID NO: 9811 - DNA, 37 bp, Artificial Sequence
  Synthetic oligonucleotide
gtcatgtcgggggaaaaactggggtgtgccggatgga

SEQ ID NO: 9812 - DNA, 35 bp, Artificial Sequence
  Synthetic oligonucleotide
aacgcatgcccgtgccattctctgatcttctccgc

SEQ ID NO: 9813 - DNA, 38 bp, Artificial Sequence
  Synthetic oligonucleotide
tccacccacgatcttgcctgacctacacattaacatga

SEQ ID NO: 9814 - DNA, 35 bp, Artificial Sequence
  Synthetic oligonucleotide
aactagcgcccctcatgtcttgtcactatactacc

SEQ ID NO: 9815 - DNA, 35 bp, Artificial Sequence
  Synthetic oligonucleotide
gcgccttgccgcctaagcccccccattccgctggc

SEQ ID NO: 9816 - DNA, 38 bp, Artificial Sequence
  Synthetic oligonucleotide
gagagcccaaggtgtagtgtgctcccctcccccgctga

SEQ ID NO: 9817 - DNA, 35 bp, Artificial Sequence
  Synthetic oligonucleotide
gattccgcatcccccatgccactccggagttctct

SEQ ID NO: 9818 - DNA, 36 bp, Artificial Sequence
  Synthetic oligonucleotide
aaacctgcccgttctgccaccctcggatgcaccgca

SEQ ID NO: 9819 - DNA, 37 bp, Artificial Sequence
  Synthetic oligonucleotide
ttggtgccgcccaccgcgtggctttatttttccccga

SEQ ID NO: 9820 - DNA, 35 bp, Artificial Sequence
  Synthetic oligonucleotide
tactgccatccgatccggtcccgctacaatctatg

SEQ ID NO: 9821 - DNA, 36 bp, Artificial Sequence
  Synthetic oligonucleotide
tgcatgtgggggtggtggctagggtggggaagggtc

SEQ ID NO: 9822 - DNA, 36 bp, Artificial Sequence
  Synthetic oligonucleotide
gcacctgatcactctctttggtctgcattacatgca

SEQ ID NO: 9823 - DNA, 35 bp, Artificial Sequence
  Synthetic oligonucleotide
aacacgttgcttaacagagcccttcacctcgccta

SEQ ID NO: 9824 - DNA, 35 bp, Artificial Sequence
  Synthetic oligonucleotide
atacgcacgtgctgatgccccccacgctatttttc

SEQ ID NO: 9825 - DNA, 38 bp, Artificial Sequence
  Synthetic oligonucleotide
accgacgcccgaatgacccgttgcgatctaccccttga

SEQ ID NO: 9826 - DNA, 35 bp, Artificial Sequence
  Synthetic oligonucleotide
tcacagtagcactgaggcctttgttgttccacccg

SEQ ID NO: 9827 - DNA, 35 bp, Artificial Sequence
  Synthetic oligonucleotide
tcctaggcacgattgccctggtgatccattttcct

SEQ ID NO: 9828 - DNA, 37 bp, Artificial Sequence
  Synthetic oligonucleotide
tcgaagtcatggagggggaatggtggaatggcgggga

SEQ ID NO: 9829 - DNA, 35 bp, Artificial Sequence
  Synthetic oligonucleotide
aactcgcatcaccaacctgttactaacgtatccac

SEQ ID NO: 9830 - DNA, 35 bp, Artificial Sequence
  Synthetic oligonucleotide
ttcgtgctcggtcccaccctttcgaccacgtactc

SEQ ID NO: 9831 - DNA, 38 bp, Artificial Sequence
  Synthetic oligonucleotide
tcatgagggggtgaggtatgggggtccaagagggatga

SEQ ID NO: 9832 - DNA, 35 bp, Artificial Sequence
  Synthetic oligonucleotide
gctccagggcacagtccatctcgcgctttacacct

SEQ ID NO: 9833 - DNA, 38 bp, Artificial Sequence
  Synthetic oligonucleotide
ttgacgaagttcgatcggcacttataccacccccttga

SEQ ID NO: 9834 - DNA, 35 bp, Artificial Sequence
  Synthetic oligonucleotide
tgtccagccggtacatctcgtctcaaacagccctc

SEQ ID NO: 9835 - DNA, 35 bp, Artificial Sequence
  Synthetic oligonucleotide
gacgtcctcgtagttttcctctgggcctctctctt

SEQ ID NO: 9836 - DNA, 35 bp, Artificial Sequence
  Synthetic oligonucleotide
ttacgaagcccactatcgattggtcatcctccaca

SEQ ID NO: 9837 - DNA, 38 bp, Artificial Sequence
  Synthetic oligonucleotide
tcacccactcccttgtgtatccctccctcacagcgtga

SEQ ID NO: 9838 - DNA, 35 bp, Artificial Sequence
  Synthetic oligonucleotide
tcaatccctgggtcccgcccgctcactccgtatcc

SEQ ID NO: 9839 - DNA, 36 bp, Artificial Sequence
  Synthetic oligonucleotide
aaacatcctcccgtgtgcaactccatcaggccccca

SEQ ID NO: 9840 - DNA, 35 bp, Artificial Sequence
  Synthetic oligonucleotide
accatccagcccatcccttagggaacatgactccc

SEQ ID NO: 9841 - DNA, 38 bp, Artificial Sequence
  Synthetic oligonucleotide
gacctcccacgccatgtaaattgctacggcccacctga

SEQ ID NO: 9842 - DNA, 36 bp, Artificial Sequence
  Synthetic oligonucleotide
acctccagccattggtttccgttactacccgtgggc

SEQ ID NO: 9843 - DNA, 35 bp, Artificial Sequence
  Synthetic oligonucleotide
acacccccgcaataggttttgtcgctctcgattat

SEQ ID NO: 9844 - DNA, 38 bp, Artificial Sequence
  Synthetic oligonucleotide
tccgcctgcctcccacctagtccccctccggcgtgtga

SEQ ID NO: 9845 - DNA, 35 bp, Artificial Sequence
  Synthetic oligonucleotide
tcccacaacctactctctggagacacttctcttta

SEQ ID NO: 9846 - DNA, 36 bp, Artificial Sequence
  Synthetic oligonucleotide
gaatgagggcgggaaggcgtgagggcatggaaggca

SEQ ID NO: 9847 - DNA, 35 bp, Artificial Sequence
  Synthetic oligonucleotide
acccctgcccccagctcaaagccggacgcccttta

SEQ ID NO: 9848 - DNA, 35 bp, Artificial Sequence
  Synthetic oligonucleotide
acaccccgtatgccttcgactccggtaatagtttc

SEQ ID NO: 9849 - DNA, 35 bp, Artificial Sequence
  Synthetic oligonucleotide
tgaccaccctagctgacatacttcgagcccattat

SEQ ID NO: 9850 - DNA, 35 bp, Artificial Sequence
  Synthetic oligonucleotide
gccaccagatatggtcttcttcttctcccacccca

SEQ ID NO: 9851 - DNA, 35 bp, Artificial Sequence
  Synthetic oligonucleotide
acacaagctccctgggccattttctcgttttcacc

SEQ ID NO: 9852 - DNA, 36 bp, Artificial Sequence
  Synthetic oligonucleotide
agacccatcatcccacgctagagcccctcatggcaa

SEQ ID NO: 9853 - DNA, 36 bp, Artificial Sequence
  Synthetic oligonucleotide
acaaccctgtccgtagtccttaaatctgtcactgca

SEQ ID NO: 9854 - DNA, 36 bp, Artificial Sequence
  Synthetic oligonucleotide
gagtacctccatccggccctaattgcccctctctga

SEQ ID NO: 9855 - DNA, 35 bp, Artificial Sequence
  Synthetic oligonucleotide
ttttgtgcccccggtgtatcgcttccaacctgccc

SEQ ID NO: 9856 - DNA, 35 bp, Artificial Sequence
  Synthetic oligonucleotide
tcatcaatccctgcacgactggcttactcgtttcc

SEQ ID NO: 9857 - DNA, 35 bp, Artificial Sequence
  Synthetic oligonucleotide
tgaagcgaacgcgttactccgcacattaccttgcc

SEQ ID NO: 9858 - DNA, 37 bp, Artificial Sequence
  Synthetic oligonucleotide
acaatgaggggggtaggaatgggatgtgccattggga

SEQ ID NO: 9859 - DNA, 36 bp, Artificial Sequence
  Synthetic oligonucleotide
acatgacgagggggagattaaaggagttggaggtga

SEQ ID NO: 9860 - DNA, 35 bp, Artificial Sequence
  Synthetic oligonucleotide
tcaccgtcaggggtgtctgtctatcctgccctcct

SEQ ID NO: 9861 - DNA, 35 bp, Artificial Sequence
  Synthetic oligonucleotide
tcatgcccacctgcacaatcagaccttccccgaga

SEQ ID NO: 9862 - DNA, 35 bp, Artificial Sequence
  Synthetic oligonucleotide
tcgctccacttctgcctcacctgtacccgacttgc

SEQ ID NO: 9863 - DNA, 35 bp, Artificial Sequence
  Synthetic oligonucleotide
tgtaccgaaccacggggatccgactacaacccacc

SEQ ID NO: 9864 - DNA, 35 bp, Artificial Sequence
  Synthetic oligonucleotide
acccgtctcctcttgctgcccaacgtgagcccttc

SEQ ID NO: 9865 - DNA, 35 bp, Artificial Sequence
  Synthetic oligonucleotide
aaaagccagcaccacgctctgctgttctactctct

SEQ ID NO: 9866 - DNA, 38 bp, Artificial Sequence
  Synthetic oligonucleotide
acaccgcctcaattccgaatcagcgcggaccatcttga

SEQ ID NO: 9867 - DNA, 35 bp, Artificial Sequence
  Synthetic oligonucleotide
actccacctgaactggtgcatactacatgaccctg

SEQ ID NO: 9868 - DNA, 35 bp, Artificial Sequence
  Synthetic oligonucleotide
atctgggtcagttcttatgccgcccacgttccccc

SEQ ID NO: 9869 - DNA, 35 bp, Artificial Sequence
  Synthetic oligonucleotide
gcttgggttcgtcgcgcccccacttgcctcatcct

SEQ ID NO: 9870 - DNA, 35 bp, Artificial Sequence
  Synthetic oligonucleotide
ggtgaaccccccccgtcatgtcctgacccttcacc

SEQ ID NO: 9871 - DNA, 35 bp, Artificial Sequence
  Synthetic oligonucleotide
aacgggaagggaaaggcaagggcttgaaaaggggg

SEQ ID NO: 9872 - DNA, 35 bp, Artificial Sequence
  Synthetic oligonucleotide
gtacatcctctgctcctgtgttacgctcgccctta

SEQ ID NO: 9873 - DNA, 35 bp, Artificial Sequence
  Synthetic oligonucleotide
gacaccttaggacctgtctaaaaaccctgttcccg

SEQ ID NO: 9874 - DNA, 37 bp, Artificial Sequence
  Synthetic oligonucleotide
gccatccccacactatctgtacgcgtaaaatacccga

SEQ ID NO: 9875 - DNA, 35 bp, Artificial Sequence
  Synthetic oligonucleotide
tgttatccacctgtcccttctctgtagctagccca

SEQ ID NO: 9876 - DNA, 35 bp, Artificial Sequence
  Synthetic oligonucleotide
tccagacctcggttagctgatcctccgctgttgcc

SEQ ID NO: 9877 - DNA, 35 bp, Artificial Sequence
  Synthetic oligonucleotide
tctaccgtagtcacagcccctgcactcccatatcg

SEQ ID NO: 9878 - DNA, 36 bp, Artificial Sequence
  Synthetic oligonucleotide
tttgtccccgggccgtatcatcccacgctctcgcaa

SEQ ID NO: 9879 - DNA, 36 bp, Artificial Sequence
  Synthetic oligonucleotide
gtgccccctggatgaattctccacatcgcctctcca

SEQ ID NO: 9880 - DNA, 37 bp, Artificial Sequence
  Synthetic oligonucleotide
ggacccctcctctacgtgcttagtgctacccgttcga

SEQ ID NO: 9881 - DNA, 35 bp, Artificial Sequence
  Synthetic oligonucleotide
gtgcttgcaccatgttatccattcctgccggtccc

SEQ ID NO: 9882 - DNA, 35 bp, Artificial Sequence
  Synthetic oligonucleotide
gtaccccgccatactcctcgtgtcgttgacctttt

SEQ ID NO: 9883 - DNA, 35 bp, Artificial Sequence
  Synthetic oligonucleotide
tcctcagaacccgacccgttcctcgcgccctggcc

SEQ ID NO: 9884 - DNA, 34 bp, Artificial Sequence
  Synthetic oligonucleotide
ttccgcgcccccctcagccgctatatcccattaa

SEQ ID NO: 9885 - DNA, 35 bp, Artificial Sequence
  Synthetic oligonucleotide
acttcacttagtcgcgcacaccctcacatccccca

SEQ ID NO: 9886 - DNA, 36 bp, Artificial Sequence
  Synthetic oligonucleotide
gtgacctgcatcgaccctgttcgacctcttccccca

SEQ ID NO: 9887 - DNA, 37 bp, Artificial Sequence
  Synthetic oligonucleotide
tgacgagggggacagcagggaacggattggggaagga

SEQ ID NO: 9888 - DNA, 35 bp, Artificial Sequence
  Synthetic oligonucleotide
gccagtgccgtcctcctacctgaccctttcgttcg

SEQ ID NO: 9889 - DNA, 37 bp, Artificial Sequence
  Synthetic oligonucleotide
tacctatcaaccgcatgcaacgtaccttcccatagga

SEQ ID NO: 9890 - DNA, 36 bp, Artificial Sequence
  Synthetic oligonucleotide
tcctcgcacatgcacatgaactatccacgcagttta

SEQ ID NO: 9891 - DNA, 35 bp, Artificial Sequence
  Synthetic oligonucleotide
ggcccggagtggccgagggggaagggggcatgggg

SEQ ID NO: 9892 - DNA, 37 bp, Artificial Sequence
  Synthetic oligonucleotide
tcaggctacaatagcctgcctcgctaacctctccgga

SEQ ID NO: 9893 - DNA, 36 bp, Artificial Sequence
  Synthetic oligonucleotide
atcacccgtcccccgctattacatgaggttccctta

SEQ ID NO: 9894 - DNA, 35 bp, Artificial Sequence
  Synthetic oligonucleotide
accagaggtgagggaaggtggagggggcggacagc

SEQ ID NO: 9895 - DNA, 35 bp, Artificial Sequence
  Synthetic oligonucleotide
tacagatgcccgtctcttcattgctacttccgcgc

SEQ ID NO: 9896 - DNA, 35 bp, Artificial Sequence
  Synthetic oligonucleotide
gtccaccccatcctctgtcttactaaatagatatg

SEQ ID NO: 9897 - DNA, 35 bp, Artificial Sequence
  Synthetic oligonucleotide
tcccctgattcgactcgtgcctatcacatctgttt

SEQ ID NO: 9898 - DNA, 35 bp, Artificial Sequence
  Synthetic oligonucleotide
tcgatccactgctttcttttaatgtactcgcctct

SEQ ID NO: 9899 - DNA, 36 bp, Artificial Sequence
  Synthetic oligonucleotide
tacgtactcgctcagtcattacgcacacttcgcaca

SEQ ID NO: 9900 - DNA, 32 bp, Artificial Sequence
  Synthetic oligonucleotide
gaccaatcgccccccatgaaccacacgggagt

SEQ ID NO: 9901 - DNA, 38 bp, Artificial Sequence
  Synthetic oligonucleotide
tcaccgcccagtttccattcgtgcatccagctccgtga

SEQ ID NO: 9902 - DNA, 36 bp, Artificial Sequence
  Synthetic oligonucleotide
gcccaccctctctccaagtataactctagcagagta

SEQ ID NO: 9903 - DNA, 38 bp, Artificial Sequence
  Synthetic oligonucleotide
taccccgcctccgctttgcccaccgtagttaaccctga

SEQ ID NO: 9904 - DNA, 37 bp, Artificial Sequence
  Synthetic oligonucleotide
aaccgcccggtcactcctactacagcacatctgcgga

SEQ ID NO: 9905 - DNA, 38 bp, Artificial Sequence
  Synthetic oligonucleotide
gatgccaagcacccccatgtttcatcgtcctaccttga

SEQ ID NO: 9906 - DNA, 35 bp, Artificial Sequence
  Synthetic oligonucleotide
atctgcacgccggcattcacgacctaccccgctaa

SEQ ID NO: 9907 - DNA, 35 bp, Artificial Sequence
  Synthetic oligonucleotide
gagagccgccgtgagttcgggggagggggaggata

SEQ ID NO: 9908 - DNA, 35 bp, Artificial Sequence
  Synthetic oligonucleotide
atccacaccccggatctgttggtacacgacccaac

SEQ ID NO: 9909 - DNA, 35 bp, Artificial Sequence
  Synthetic oligonucleotide
tccaccacctcttcatatagatctccggtacttgc

SEQ ID NO: 9910 - DNA, 35 bp, Artificial Sequence
  Synthetic oligonucleotide
tacactacaccctgggacctgcccccctgctctcg

SEQ ID NO: 9911 - DNA, 37 bp, Artificial Sequence
  Synthetic oligonucleotide
ttaaacgcgccctcgatccatgctacccccccttgga

SEQ ID NO: 9912 - DNA, 35 bp, Artificial Sequence
  Synthetic oligonucleotide
tacgcaactgtttggcaccttcgtttctcccgcgc

SEQ ID NO: 9913 - DNA, 38 bp, Artificial Sequence
  Synthetic oligonucleotide
acctgcgcagagcagcaccacacacaatcgcagcttga

SEQ ID NO: 9914 - DNA, 36 bp, Artificial Sequence
  Synthetic oligonucleotide
acactaacgtccaccgatcagccctccgctcacgaa

SEQ ID NO: 9915 - DNA, 36 bp, Artificial Sequence
  Synthetic oligonucleotide
tgcacacgccccctgtcgccatccattcactgttca

SEQ ID NO: 9916 - DNA, 38 bp, Artificial Sequence
  Synthetic oligonucleotide
gtgagaagaggtgtgggtgcgtgtggaagggggtgtga

SEQ ID NO: 9917 - DNA, 35 bp, Artificial Sequence
  Synthetic oligonucleotide
gccgcccgtaccacccgtctttctctcacgagacc

SEQ ID NO: 9918 - DNA, 35 bp, Artificial Sequence
  Synthetic oligonucleotide
tgcatcagaatcgaaccatgctctttttaccttcg

SEQ ID NO: 9919 - DNA, 36 bp, Artificial Sequence
  Synthetic oligonucleotide
tccacctcactcacataggttgtcacctgtacctga

SEQ ID NO: 9920 - DNA, 35 bp, Artificial Sequence
  Synthetic oligonucleotide
gtgccctctcgatctggaaagattccccctcaccc

SEQ ID NO: 9921 - DNA, 35 bp, Artificial Sequence
  Synthetic oligonucleotide
gtgttcactccgcccactctcttctagacgttatg

SEQ ID NO: 9922 - DNA, 38 bp, Artificial Sequence
  Synthetic oligonucleotide
tcagtaaccgccatcagtcgtaccacctcttctagtga

SEQ ID NO: 9923 - DNA, 35 bp, Artificial Sequence
  Synthetic oligonucleotide
tcaaaccgccgcttgttcttttgtcccgactcaaa

SEQ ID NO: 9924 - DNA, 37 bp, Artificial Sequence
  Synthetic oligonucleotide
acccgacgcccccatcactgccctttctcgcgcggga

SEQ ID NO: 9925 - DNA, 34 bp, Artificial Sequence
  Synthetic oligonucleotide
tatcccttcccttcacatgatcttgacacgggta

SEQ ID NO: 9926 - DNA, 35 bp, Artificial Sequence
  Synthetic oligonucleotide
tcagaagctgccaccatgcacgcgggccttacttt

SEQ ID NO: 9927 - DNA, 37 bp, Artificial Sequence
  Synthetic oligonucleotide
gcatgctctgttgcccgccgatcttcctcctgcacga

SEQ ID NO: 9928 - DNA, 37 bp, Artificial Sequence
  Synthetic oligonucleotide
atccccagcccagtttacaaacaatgccgccctgtga

SEQ ID NO: 9929 - DNA, 36 bp, Artificial Sequence
  Synthetic oligonucleotide
gaaatgtagggtggggttgagcgggaagttgaggta

SEQ ID NO: 9930 - DNA, 35 bp, Artificial Sequence
  Synthetic oligonucleotide
tgatcacgcgatactacggcttccgcgacacacac

SEQ ID NO: 9931 - DNA, 35 bp, Artificial Sequence
  Synthetic oligonucleotide
tcctgacgtgctccagtaactgcctatctcctgtc

SEQ ID NO: 9932 - DNA, 36 bp, Artificial Sequence
  Synthetic oligonucleotide
tcccactgcctctcgcacgagtactgttacaaatca

SEQ ID NO: 9933 - DNA, 37 bp, Artificial Sequence
  Synthetic oligonucleotide
aaacgcgcggttaaaaggttaggtggtggaggaggga

SEQ ID NO: 9934 - DNA, 35 bp, Artificial Sequence
  Synthetic oligonucleotide
tgcaccaacaccactataggacgccccatgagtca

SEQ ID NO: 9935 - DNA, 35 bp, Artificial Sequence
  Synthetic oligonucleotide
gcgcccgccccgacggaaatacgcacaccaattcc

SEQ ID NO: 9936 - DNA, 37 bp, Artificial Sequence
  Synthetic oligonucleotide
tgtgaggtagggagggctgtagttgggaaggggggga

SEQ ID NO: 9937 - DNA, 35 bp, Artificial Sequence
  Synthetic oligonucleotide
aagagacccgccccgtatcgcaaagcgacagctta

SEQ ID NO: 9938 - DNA, 35 bp, Artificial Sequence
  Synthetic oligonucleotide
tcagaccatcctccctttttttatgtaagcacata

SEQ ID NO: 9939 - DNA, 35 bp, Artificial Sequence
  Synthetic oligonucleotide
gtcgccgactctcgtattagccctctccgctttcc

SEQ ID NO: 9940 - DNA, 35 bp, Artificial Sequence
  Synthetic oligonucleotide
ggaatcgcccctcccccgccagctgctgctcgcct

SEQ ID NO: 9941 - DNA, 36 bp, Artificial Sequence
  Synthetic oligonucleotide
gcaccactcttgcagacctctttagactcactccaa

SEQ ID NO: 9942 - DNA, 36 bp, Artificial Sequence
  Synthetic oligonucleotide
ggatgtaatgggtggagggaccggggatggtgtgca

SEQ ID NO: 9943 - DNA, 37 bp, Artificial Sequence
  Synthetic oligonucleotide
gccccgtacgctccctctctgtctataacacccccga

SEQ ID NO: 9944 - DNA, 36 bp, Artificial Sequence
  Synthetic oligonucleotide
accaccgaagtggtgggtcagccctaccttgcttta

SEQ ID NO: 9945 - DNA, 36 bp, Artificial Sequence
  Synthetic oligonucleotide
gaacgtagcgccaacttctcccatggtccttatgca

SEQ ID NO: 9946 - DNA, 37 bp, Artificial Sequence
  Synthetic oligonucleotide
gtgtatgcgccgcctctgttccgttgccgattgtcga

SEQ ID NO: 9947 - DNA, 35 bp, Artificial Sequence
  Synthetic oligonucleotide
accatcggtcaccatctgtcccacgtccaacgact

SEQ ID NO: 9948 - DNA, 35 bp, Artificial Sequence
  Synthetic oligonucleotide
aacactgtgcctctgctttagcacaaccacccttt

SEQ ID NO: 9949 - DNA, 35 bp, Artificial Sequence
  Synthetic oligonucleotide
tacggatgcagctgcctaacttctctgcttcactt

SEQ ID NO: 9950 - DNA, 35 bp, Artificial Sequence
  Synthetic oligonucleotide
tacacaccctgcctcttggcacaccactatgtacc

SEQ ID NO: 9951 - DNA, 38 bp, Artificial Sequence
  Synthetic oligonucleotide
gtgagcctcacctggaccaacttttgcctcaactatga

SEQ ID NO: 9952 - DNA, 35 bp, Artificial Sequence
  Synthetic oligonucleotide
tagaccatctatacatcatagcccagtgatccctc

SEQ ID NO: 9953 - DNA, 36 bp, Artificial Sequence
  Synthetic oligonucleotide
gctacgtggtggaatggggggggcgggtggttgcaa

SEQ ID NO: 9954 - DNA, 36 bp, Artificial Sequence
  Synthetic oligonucleotide
gctaacgccaatctcgcgatctgtcatccctctcca

SEQ ID NO: 9955 - DNA, 35 bp, Artificial Sequence
  Synthetic oligonucleotide
atggttcggcgcgaatcccgtttatccacgctccc

SEQ ID NO: 9956 - DNA, 35 bp, Artificial Sequence
  Synthetic oligonucleotide
tccgccaccagaacactgcgttcctaagcctatgc

SEQ ID NO: 9957 - DNA, 38 bp, Artificial Sequence
  Synthetic oligonucleotide
tgtcgcacgcccttgcataatcctactcctgtacctga

SEQ ID NO: 9958 - DNA, 36 bp, Artificial Sequence
  Synthetic oligonucleotide
gtggcaaccacccatctcttccagactcgccgacta

SEQ ID NO: 9959 - DNA, 36 bp, Artificial Sequence
  Synthetic oligonucleotide
atgtgcccgccacgcagcctccatccgctatgccca

SEQ ID NO: 9960 - DNA, 35 bp, Artificial Sequence
  Synthetic oligonucleotide
tgccgtcctccgccctcgtgccaaaacgcctttca

SEQ ID NO: 9961 - DNA, 35 bp, Artificial Sequence
  Synthetic oligonucleotide
tgccccatctggccacatccgcctaatgttctttc

SEQ ID NO: 9962 - DNA, 38 bp, Artificial Sequence
  Synthetic oligonucleotide
gcatccgcactgcaacactccgcctcaaccaagggtga

SEQ ID NO: 9963 - DNA, 35 bp, Artificial Sequence
  Synthetic oligonucleotide
tctcctccagaaccccgaacgagcccctcatacgc

SEQ ID NO: 9964 - DNA, 36 bp, Artificial Sequence
  Synthetic oligonucleotide
tgcaatggcctgcctctgtcaacatccaccttctaa

SEQ ID NO: 9965 - DNA, 35 bp, Artificial Sequence
  Synthetic oligonucleotide
agtcccacaagccgcacactagcccgtttttttcg

SEQ ID NO: 9966 - DNA, 35 bp, Artificial Sequence
  Synthetic oligonucleotide
ttgactcactcacttgctgcctataaaatcaccat

SEQ ID NO: 9967 - DNA, 35 bp, Artificial Sequence
  Synthetic oligonucleotide
ttgatgtgcccaacctgatatgcctctacttccct

SEQ ID NO: 9968 - DNA, 36 bp, Artificial Sequence
  Synthetic oligonucleotide
gagccacgggccgtagtacgcacatttaccaccaca

SEQ ID NO: 9969 - DNA, 35 bp, Artificial Sequence
  Synthetic oligonucleotide
acacccctccgtggcttaatgaccgctacacggga

SEQ ID NO: 9970 - DNA, 35 bp, Artificial Sequence
  Synthetic oligonucleotide
tccaccgtgccgcctgcctcttgaagttcaaacta

SEQ ID NO: 9971 - DNA, 36 bp, Artificial Sequence
  Synthetic oligonucleotide
aactcccgctataccggtcctggtggcccactccca

SEQ ID NO: 9972 - DNA, 35 bp, Artificial Sequence
  Synthetic oligonucleotide
gccctcttacgatagtggccggttccacttcctcc

SEQ ID NO: 9973 - DNA, 37 bp, Artificial Sequence
  Synthetic oligonucleotide
gctgcccaaaggtcctcgaccccgtgccctatttcga

SEQ ID NO: 9974 - DNA, 37 bp, Artificial Sequence
  Synthetic oligonucleotide
ggtcgacacacccggcactgcgcctcacctttcaaga

SEQ ID NO: 9975 - DNA, 35 bp, Artificial Sequence
  Synthetic oligonucleotide
gacatagtcatcgaatatgccgttccctctccgcc

SEQ ID NO: 9976 - DNA, 38 bp, Artificial Sequence
  Synthetic oligonucleotide
acaaggaagggggggggtgtgacgtggggaagggatga

SEQ ID NO: 9977 - DNA, 36 bp, Artificial Sequence
  Synthetic oligonucleotide
gttaaccaccgtcctgccttcctgcacgaaccgtga

SEQ ID NO: 9978 - DNA, 35 bp, Artificial Sequence
  Synthetic oligonucleotide
tactccccgcccgcagtaccaatatgcccgcgaag

SEQ ID NO: 9979 - DNA, 35 bp, Artificial Sequence
  Synthetic oligonucleotide
tcccaaaccgcaggactcacatcacattcccgtat

SEQ ID NO: 9980 - DNA, 35 bp, Artificial Sequence
  Synthetic oligonucleotide
agagctcatgccccgatacgccgctctgccaccac

SEQ ID NO: 9981 - DNA, 36 bp, Artificial Sequence
  Synthetic oligonucleotide
acacctgaccggcgatagtagactactctgccacca

SEQ ID NO: 9982 - DNA, 36 bp, Artificial Sequence
  Synthetic oligonucleotide
tcgatgtgccgaactgcgtaatctttgcttgtacca

SEQ ID NO: 9983 - DNA, 35 bp, Artificial Sequence
  Synthetic oligonucleotide
gacccgcacctacccatcttcagttgttgctccca

SEQ ID NO: 9984 - DNA, 35 bp, Artificial Sequence
  Synthetic oligonucleotide
attaccactggcacattgacccaccctttggcttc

SEQ ID NO: 9985 - DNA, 35 bp, Artificial Sequence
  Synthetic oligonucleotide
gaaggacaaacggccacccgacccgaacacatacg

SEQ ID NO: 9986 - DNA, 35 bp, Artificial Sequence
  Synthetic oligonucleotide
actcctgcgctgtcacttagcctcatgacttgcca

SEQ ID NO: 9987 - DNA, 35 bp, Artificial Sequence
  Synthetic oligonucleotide
accccacagactattcaatttgaccccgcctcgct

SEQ ID NO: 9988 - DNA, 36 bp, Artificial Sequence
  Synthetic oligonucleotide
tcatcgtgtcagtctcgaccacccaagctgattcca

SEQ ID NO: 9989 - DNA, 36 bp, Artificial Sequence
  Synthetic oligonucleotide
gctatcacccggcaccataggcaccctgaccacgca

SEQ ID NO: 9990 - DNA, 35 bp, Artificial Sequence
  Synthetic oligonucleotide
tcagccaccttgttgttggttagtcccaccgcacc

SEQ ID NO: 9991 - DNA, 35 bp, Artificial Sequence
  Synthetic oligonucleotide
ttcgataccgccttgtctgtcttgttgccatttcc

SEQ ID NO: 9992 - DNA, 35 bp, Artificial Sequence
  Synthetic oligonucleotide
tactcactgaccccctctgcctacgcacgagatct

SEQ ID NO: 9993 - DNA, 35 bp, Artificial Sequence
  Synthetic oligonucleotide
gacgcctggctactacatgtgccaccccttgaaac

SEQ ID NO: 9994 - DNA, 35 bp, Artificial Sequence
  Synthetic oligonucleotide
aaccacccatgccctacttagtccgtcccataacg

SEQ ID NO: 9995 - DNA, 35 bp, Artificial Sequence
  Synthetic oligonucleotide
gacagtggggctagtggggagtgggtagtacgttt

SEQ ID NO: 9996 - DNA, 37 bp, Artificial Sequence
  Synthetic oligonucleotide
gacaaccggaacatccactgccctcatcagaccacga

SEQ ID NO: 9997 - DNA, 38 bp, Artificial Sequence
  Synthetic oligonucleotide
ggacacccactcaatatactcctacgcactgtccgtga

SEQ ID NO: 9998 - DNA, 36 bp, Artificial Sequence
  Synthetic oligonucleotide
atccgtgccccttacacgttttttggatcaacacca

SEQ ID NO: 9999 - DNA, 38 bp, Artificial Sequence
  Synthetic oligonucleotide
taggggatgacaggggtcgaaaaaggcgggtggtgtga

SEQ ID NO: 10000 - DNA, 36 bp, Artificial Sequence
  Synthetic oligonucleotide
acataatcgcagacgtaatgcaccttcccatcacaa

SEQ ID NO: 10001 - DNA, 37 bp, Artificial Sequence
  Synthetic oligonucleotide
atgccaccattgttccgcgcgacgcaccacccaccga

SEQ ID NO: 10002 - DNA, 35 bp, Artificial Sequence
  Synthetic oligonucleotide
atcccctgcgcaattaatcacatcccgcgccgttc

SEQ ID NO: 10003 - DNA, 35 bp, Artificial Sequence
  Synthetic oligonucleotide
agctgtagcgctcccctggttatgcctcacccttc

SEQ ID NO: 10004 - DNA, 35 bp, Artificial Sequence
  Synthetic oligonucleotide
accaacacgacgccccctggccttctcttgtacct

SEQ ID NO: 10005 - DNA, 36 bp, Artificial Sequence
  Synthetic oligonucleotide
aaccctccccctgtctgaccatgagttctgtttgca

SEQ ID NO: 10006 - DNA, 37 bp, Artificial Sequence
  Synthetic oligonucleotide
taaccgccggcgcgcttccactcttcatcatgccgga

SEQ ID NO: 10007 - DNA, 38 bp, Artificial Sequence
  Synthetic oligonucleotide
tgcccaacgaagcgtgtacgtctcgcccccactcttga

SEQ ID NO: 10008 - DNA, 35 bp, Artificial Sequence
  Synthetic oligonucleotide
tcatgccagctgcccttctaggaattacatctctg

SEQ ID NO: 10009 - DNA, 36 bp, Artificial Sequence
  Synthetic oligonucleotide
aatccatcatgacagtctcgcaccatccctctgtga

SEQ ID NO: 10010 - DNA, 35 bp, Artificial Sequence
  Synthetic oligonucleotide
atccgtcgaccttctagcatgtttacgcccttcgc

SEQ ID NO: 10011 - DNA, 36 bp, Artificial Sequence
  Synthetic oligonucleotide
tagcgcacctcacccccctcgagcacgtcctctgca

SEQ ID NO: 10012 - DNA, 36 bp, Artificial Sequence
  Synthetic oligonucleotide
gcatccccaccttcctacggcgacgtttacgtacta

SEQ ID NO: 10013 - DNA, 35 bp, Artificial Sequence
  Synthetic oligonucleotide
tcatcattcactccgggttctaagcttgctcttgt

SEQ ID NO: 10014 - DNA, 35 bp, Artificial Sequence
  Synthetic oligonucleotide
gaacacgttaccctgcctggggcctagttccactt

SEQ ID NO: 10015 - DNA, 35 bp, Artificial Sequence
  Synthetic oligonucleotide
gggagggtacgcaggcggggaaagaagttgagggg

SEQ ID NO: 10016 - DNA, 36 bp, Artificial Sequence
  Synthetic oligonucleotide
tgcccttgccgcccgggcaatctacgaatcacttta

SEQ ID NO: 10017 - DNA, 35 bp, Artificial Sequence
  Synthetic oligonucleotide
gtccaccagccgtttccaagcgctatgtactctct

SEQ ID NO: 10018 - DNA, 35 bp, Artificial Sequence
  Synthetic oligonucleotide
gtgatgatccattgtctgctgtacccttccgccca

SEQ ID NO: 10019 - DNA, 38 bp, Artificial Sequence
  Synthetic oligonucleotide
tccaccctcttatgctttacgacactcgtcgacactga

SEQ ID NO: 10020 - DNA, 35 bp, Artificial Sequence
  Synthetic oligonucleotide
tcgaacaccacttccgccgtaagtaggtcccaccc

SEQ ID NO: 10021 - DNA, 35 bp, Artificial Sequence
  Synthetic oligonucleotide
actaacgaaccaagttctcccgtgacaccctgtcc

SEQ ID NO: 10022 - DNA, 35 bp, Artificial Sequence
  Synthetic oligonucleotide
gaagcatggtggaaacggggggaaaggccagtgcg

SEQ ID NO: 10023 - DNA, 35 bp, Artificial Sequence
  Synthetic oligonucleotide
accccgcccactcgctcttacaggtacattggtgg

SEQ ID NO: 10024 - DNA, 35 bp, Artificial Sequence
  Synthetic oligonucleotide
gtgcaatcccctggtagagtccacctttgtttcct

SEQ ID NO: 10025 - DNA, 35 bp, Artificial Sequence
  Synthetic oligonucleotide
attacgcaagccttgaagccccgccatcctaccga

SEQ ID NO: 10026 - DNA, 38 bp, Artificial Sequence
  Synthetic oligonucleotide
atcgaccacggcacaccgctagaattcacctcgtttga

SEQ ID NO: 10027 - DNA, 38 bp, Artificial Sequence
  Synthetic oligonucleotide
tgtgggtaggtacggcggagaggatcggtggagggtga

SEQ ID NO: 10028 - DNA, 37 bp, Artificial Sequence
  Synthetic oligonucleotide
acacgggggggagggcaatctagggacatgtgaacga

SEQ ID NO: 10029 - DNA, 37 bp, Artificial Sequence
  Synthetic oligonucleotide
tgcttgcaacattactgccgcattccgcttccaccga

SEQ ID NO: 10030 - DNA, 37 bp, Artificial Sequence
  Synthetic oligonucleotide
gatcaaggggacagtgggcgggcgggagaacaattga

SEQ ID NO: 10031 - DNA, 38 bp, Artificial Sequence
  Synthetic oligonucleotide
tccagagtcctcatctgcgcctcgtgttctaccattga

SEQ ID NO: 10032 - DNA, 35 bp, Artificial Sequence
  Synthetic oligonucleotide
gtcaccccccatcgcctaactgtaactctcccgcg

SEQ ID NO: 10033 - DNA, 36 bp, Artificial Sequence
  Synthetic oligonucleotide
agccacgcattgtatcgtcgtttcatccataacaca

SEQ ID NO: 10034 - DNA, 35 bp, Artificial Sequence
  Synthetic oligonucleotide
acctctccacctacagttcgtacttcgactctccc

SEQ ID NO: 10035 - DNA, 37 bp, Artificial Sequence
  Synthetic oligonucleotide
tgagcctacgccaccacattgtcttccaccccaacga

SEQ ID NO: 10036 - DNA, 35 bp, Artificial Sequence
  Synthetic oligonucleotide
gcgacctgacccctgccataatcatgggctccacc

SEQ ID NO: 10037 - DNA, 35 bp, Artificial Sequence
  Synthetic oligonucleotide
gtctgagccgggccataccaccaagcgcttcccca

SEQ ID NO: 10038 - DNA, 35 bp, Artificial Sequence
  Synthetic oligonucleotide
tgacccttacacctgcctacgtaggagactcccac

SEQ ID NO: 10039 - DNA, 35 bp, Artificial Sequence
  Synthetic oligonucleotide
agacgtcacaacggccccccaccccctgactgacc

SEQ ID NO: 10040 - DNA, 35 bp, Artificial Sequence
  Synthetic oligonucleotide
gtatccccctccatgtcattaggccccagaaccgt

SEQ ID NO: 10041 - DNA, 35 bp, Artificial Sequence
  Synthetic oligonucleotide
gtgacacgctaccctcattcattccgcgacccctg

SEQ ID NO: 10042 - DNA, 37 bp, Artificial Sequence
  Synthetic oligonucleotide
gtgcgaaccaggacggagagggggcggatggagttga

SEQ ID NO: 10043 - DNA, 35 bp, Artificial Sequence
  Synthetic oligonucleotide
taccttgcgcaagcgacccgtcctaccatacgcgt

SEQ ID NO: 10044 - DNA, 36 bp, Artificial Sequence
  Synthetic oligonucleotide
gtgcccgcccccttattagtcctccggtgaacttca

SEQ ID NO: 10045 - DNA, 36 bp, Artificial Sequence
  Synthetic oligonucleotide
acgaccacaccgtctatgtcacttctgcgtccttca

SEQ ID NO: 10046 - DNA, 35 bp, Artificial Sequence
  Synthetic oligonucleotide
acttgcccatcctgaaagcaacaccgatcgctact

SEQ ID NO: 10047 - DNA, 36 bp, Artificial Sequence
  Synthetic oligonucleotide
tcaaccccacgcactgctgtcactccatgtttccga

SEQ ID NO: 10048 - DNA, 35 bp, Artificial Sequence
  Synthetic oligonucleotide
gcagaacccgactgctgctccatacgcgttccctc

SEQ ID NO: 10049 - DNA, 36 bp, Artificial Sequence
  Synthetic oligonucleotide
tccaaatccggctcccctgccaccgacccagtgaaa

SEQ ID NO: 10050 - DNA, 35 bp, Artificial Sequence
  Synthetic oligonucleotide
acacacgcccgcttaaagcctgatccaattgaaca

SEQ ID NO: 10051 - DNA, 36 bp, Artificial Sequence
  Synthetic oligonucleotide
tgagtgagtaggggaaatggacatgggggagtaaca

SEQ ID NO: 10052 - DNA, 34 bp, Artificial Sequence
  Synthetic oligonucleotide
gcacgtttgactctgctcgattccacgcttacca

SEQ ID NO: 10053 - DNA, 38 bp, Artificial Sequence
  Synthetic oligonucleotide
acccgtgccctgcccacccgagagttccttcgggatga

SEQ ID NO: 10054 - DNA, 35 bp, Artificial Sequence
  Synthetic oligonucleotide
gcatcacgcactcgccgtgacatagctcccgcttc

SEQ ID NO: 10055 - DNA, 36 bp, Artificial Sequence
  Synthetic oligonucleotide
gtccaccctcgctggtattgcctggattcctgaaca

SEQ ID NO: 10056 - DNA, 37 bp, Artificial Sequence
  Synthetic oligonucleotide
tgcatcctctgctacaagccatcaacgcatccattga

SEQ ID NO: 10057 - DNA, 35 bp, Artificial Sequence
  Synthetic oligonucleotide
tgaattcccccaggcctcacaagtaccgttctcac

SEQ ID NO: 10058 - DNA, 35 bp, Artificial Sequence
  Synthetic oligonucleotide
gtgcccgggcacgctctagccctcgtctttattcc

SEQ ID NO: 10059 - DNA, 36 bp, Artificial Sequence
  Synthetic oligonucleotide
atgtgcaccacccctctatgcgagctctacttcgaa

SEQ ID NO: 10060 - DNA, 35 bp, Artificial Sequence
  Synthetic oligonucleotide
actccacacagtgcgtgcatccacatccaactttg

SEQ ID NO: 10061 - DNA, 36 bp, Artificial Sequence
  Synthetic oligonucleotide
gcccaccgacgacgtattttcaggttacatcaccca

SEQ ID NO: 10062 - DNA, 35 bp, Artificial Sequence
  Synthetic oligonucleotide
acactcacatcccgtttagctgcccatgtttacgc

SEQ ID NO: 10063 - DNA, 36 bp, Artificial Sequence
  Synthetic oligonucleotide
gactacctccacaaacagtgtcgcgggatgtgccca

SEQ ID NO: 10064 - DNA, 35 bp, Artificial Sequence
  Synthetic oligonucleotide
tatgacatctgagcgctaatcagcactggcccccc

SEQ ID NO: 10065 - DNA, 35 bp, Artificial Sequence
  Synthetic oligonucleotide
tccagtcgtgtgctggcccgcgatccttcctctct

SEQ ID NO: 10066 - DNA, 36 bp, Artificial Sequence
  Synthetic oligonucleotide
actgaggaagggagggaggtcgtggactgaaggtaa

SEQ ID NO: 10067 - DNA, 37 bp, Artificial Sequence
  Synthetic oligonucleotide
atggggatgtcaaaacgggaaggaaatggggctgaga

SEQ ID NO: 10068 - DNA, 37 bp, Artificial Sequence
  Synthetic oligonucleotide
accaccaccggccagcattgggaaaaaattggttcga

SEQ ID NO: 10069 - DNA, 35 bp, Artificial Sequence
  Synthetic oligonucleotide
gtactcatccattggaccgccgcacctggtctcat

SEQ ID NO: 10070 - DNA, 35 bp, Artificial Sequence
  Synthetic oligonucleotide
ttggtccgtctttcgtcaagctcccctgcctttgt

SEQ ID NO: 10071 - DNA, 35 bp, Artificial Sequence
  Synthetic oligonucleotide
tacatctgtcgcatcttacgccctgcgttaccctg

SEQ ID NO: 10072 - DNA, 35 bp, Artificial Sequence
  Synthetic oligonucleotide
taccgtgctgccacattcgctgccacgccttcctt

SEQ ID NO: 10073 - DNA, 38 bp, Artificial Sequence
  Synthetic oligonucleotide
tagcccaccacacgactgacaaattccgagcctaatga

SEQ ID NO: 10074 - DNA, 38 bp, Artificial Sequence
  Synthetic oligonucleotide
gtgtagccccgatcgcaatttgttctgcctatcactga

SEQ ID NO: 10075 - DNA, 35 bp, Artificial Sequence
  Synthetic oligonucleotide
gatcgccaccggcctcacagactgacctccccccc

SEQ ID NO: 10076 - DNA, 36 bp, Artificial Sequence
  Synthetic oligonucleotide
gtagggtgaaggggttgcattagtggtcggggaaaa

SEQ ID NO: 10077 - DNA, 35 bp, Artificial Sequence
  Synthetic oligonucleotide
aagttacgcgcgccatccacctattcttcacatga

SEQ ID NO: 10078 - DNA, 35 bp, Artificial Sequence
  Synthetic oligonucleotide
ttggttcgcagggttgttcttctggcccttccttt

SEQ ID NO: 10079 - DNA, 35 bp, Artificial Sequence
  Synthetic oligonucleotide
accacccttccgtatgctactgtctgggacttaaa

SEQ ID NO: 10080 - DNA, 36 bp, Artificial Sequence
  Synthetic oligonucleotide
ggttgggggaagagaggggaaatgggacttggggaa

SEQ ID NO: 10081 - DNA, 37 bp, Artificial Sequence
  Synthetic oligonucleotide
gtctgcccaggcgctcgtccgtaccatccccatttga

SEQ ID NO: 10082 - DNA, 35 bp, Artificial Sequence
  Synthetic oligonucleotide
aggtccaccactgctatgaatcccgctgttcacca

SEQ ID NO: 10083 - DNA, 35 bp, Artificial Sequence
  Synthetic oligonucleotide
gctcgccgagctctacttaggcctccttcttcgta

SEQ ID NO: 10084 - DNA, 35 bp, Artificial Sequence
  Synthetic oligonucleotide
gggtcccccacacactgtccttcctcggctacgcc

SEQ ID NO: 10085 - DNA, 35 bp, Artificial Sequence
  Synthetic oligonucleotide
tgcctgagcaacttacctgccccccgctgtttccg

SEQ ID NO: 10086 - DNA, 35 bp, Artificial Sequence
  Synthetic oligonucleotide
acccgaggtgacctaatgcccgacgtcccaccccg

SEQ ID NO: 10087 - DNA, 37 bp, Artificial Sequence
  Synthetic oligonucleotide
actagccctgccgggttgctacatccatctcactcga

SEQ ID NO: 10088 - DNA, 35 bp, Artificial Sequence
  Synthetic oligonucleotide
acaaggggcgtagtagaagggcggggatgggcgag

SEQ ID NO: 10089 - DNA, 37 bp, Artificial Sequence
  Synthetic oligonucleotide
gtagaggggatctggtgggtgccatgggtggggagga

SEQ ID NO: 10090 - DNA, 37 bp, Artificial Sequence
  Synthetic oligonucleotide
tgataccccgtgctcactgttaccgccgaaccttgga

SEQ ID NO: 10091 - DNA, 35 bp, Artificial Sequence
  Synthetic oligonucleotide
gcaacctggccacatttgcgtgtcgcgctcctcac

SEQ ID NO: 10092 - DNA, 35 bp, Artificial Sequence
  Synthetic oligonucleotide
gtacacctcacgctttaggccctcctataacctac

SEQ ID NO: 10093 - DNA, 35 bp, Artificial Sequence
  Synthetic oligonucleotide
gccctctgcccccatcagttttaatgctatgtcac

SEQ ID NO: 10094 - DNA, 37 bp, Artificial Sequence
  Synthetic oligonucleotide
attccatcgccctcctgttagctcgcactacctgtga

SEQ ID NO: 10095 - DNA, 36 bp, Artificial Sequence
  Synthetic oligonucleotide
ttcccgccgtcctacgagttagcatccacccttcaa

SEQ ID NO: 10096 - DNA, 36 bp, Artificial Sequence
  Synthetic oligonucleotide
actccctgcaccatgcgggcctcatctcatacatga

SEQ ID NO: 10097 - DNA, 38 bp, Artificial Sequence
  Synthetic oligonucleotide
gcgatggtccaggtagcctttttgaccgccctccctga

SEQ ID NO: 10098 - DNA, 35 bp, Artificial Sequence
  Synthetic oligonucleotide
tacccacgcaccgcctccccatgagctacactatc

SEQ ID NO: 10099 - DNA, 36 bp, Artificial Sequence
  Synthetic oligonucleotide
tcgagattaggtgggtacgggtgggcaaatggaaaa

SEQ ID NO: 10100 - DNA, 36 bp, Artificial Sequence
  Synthetic oligonucleotide
tgtcacccccctttcgtatcacgttgcctaagttta

SEQ ID NO: 10101 - DNA, 35 bp, Artificial Sequence
  Synthetic oligonucleotide
attgctcaacagcgtccctgcccctcttgtccgct

SEQ ID NO: 10102 - DNA, 36 bp, Artificial Sequence
  Synthetic oligonucleotide
tgtcccgcccgcaccatgctttcgaaccgcctgtga

SEQ ID NO: 10103 - DNA, 35 bp, Artificial Sequence
  Synthetic oligonucleotide
gatgcatgccccctccgcaccgtgccttgatctgc

SEQ ID NO: 10104 - DNA, 36 bp, Artificial Sequence
  Synthetic oligonucleotide
aaggacccctcccgtacctctacttctctgagacga

SEQ ID NO: 10105 - DNA, 38 bp, Artificial Sequence
  Synthetic oligonucleotide
gcagggtggggggggatgctgaccaaatgggaggttga

SEQ ID NO: 10106 - DNA, 35 bp, Artificial Sequence
  Synthetic oligonucleotide
gccattgcgcccgctcttccctatcgcctttcaag

SEQ ID NO: 10107 - DNA, 35 bp, Artificial Sequence
  Synthetic oligonucleotide
gaaagggagggactggggagattcgagagtggtac

SEQ ID NO: 10108 - DNA, 35 bp, Artificial Sequence
  Synthetic oligonucleotide
gcccccgccgctcctatcatcagcccaccagtcct

SEQ ID NO: 10109 - DNA, 35 bp, Artificial Sequence
  Synthetic oligonucleotide
gatgcaggcgctgtatgtcgaccattccgtctctc

SEQ ID NO: 10110 - DNA, 37 bp, Artificial Sequence
  Synthetic oligonucleotide
gagaatggcggagggggtaggctggaaggtaggagga

SEQ ID NO: 10111 - DNA, 35 bp, Artificial Sequence
  Synthetic oligonucleotide
gttcaacctcccgttcgtccaacttgcccgttccg

SEQ ID NO: 10112 - DNA, 34 bp, Artificial Sequence
  Synthetic oligonucleotide
tacgacgctgtcccatgttactgtctcctctgtg

SEQ ID NO: 10113 - DNA, 35 bp, Artificial Sequence
  Synthetic oligonucleotide
aacacttgccactcatcgttcggagctcgcatcct

SEQ ID NO: 10114 - DNA, 37 bp, Artificial Sequence
  Synthetic oligonucleotide
gccccgccactaaccgccccatgtaccctgtcgtaga

SEQ ID NO: 10115 - DNA, 35 bp, Artificial Sequence
  Synthetic oligonucleotide
acatgactggtgtcatgttcccttatttgttcttc

SEQ ID NO: 10116 - DNA, 35 bp, Artificial Sequence
  Synthetic oligonucleotide
tagctcagccccgccgtcactgtttaacttccctt

SEQ ID NO: 10117 - DNA, 35 bp, Artificial Sequence
  Synthetic oligonucleotide
atagaacgcactgcaaataggcataaccccaaccg

SEQ ID NO: 10118 - DNA, 35 bp, Artificial Sequence
  Synthetic oligonucleotide
ggacccctgacactgatctttttaacccacattga

SEQ ID NO: 10119 - DNA, 38 bp, Artificial Sequence
  Synthetic oligonucleotide
ttcagccacccccctctgcgttacttctggcctcgtga

SEQ ID NO: 10120 - DNA, 37 bp, Artificial Sequence
  Synthetic oligonucleotide
tctggtcctctgccctgctgtttccttgccctatcga

SEQ ID NO: 10121 - DNA, 35 bp, Artificial Sequence
  Synthetic oligonucleotide
tccatcgcgagctattcggggaccactctatcatc

SEQ ID NO: 10122 - DNA, 35 bp, Artificial Sequence
  Synthetic oligonucleotide
gcacgtacctcttcgcgttctcccacgtccttgtc

SEQ ID NO: 10123 - DNA, 35 bp, Artificial Sequence
  Synthetic oligonucleotide
tatccatgttgcaccgatacctatgctgtgccttt

SEQ ID NO: 10124 - DNA, 35 bp, Artificial Sequence
  Synthetic oligonucleotide
tacgcactccacttgcagacgtctgcgattccccc

SEQ ID NO: 10125 - DNA, 35 bp, Artificial Sequence
  Synthetic oligonucleotide
tgacattccatcgctgggcctcacgatccatccgc

SEQ ID NO: 10126 - DNA, 35 bp, Artificial Sequence
  Synthetic oligonucleotide
ggaagggagggtgtgaagcaaaggtgggaagcgag

SEQ ID NO: 10127 - DNA, 35 bp, Artificial Sequence
  Synthetic oligonucleotide
ttacgactcgaacgcgtttaacagcccctccccta

SEQ ID NO: 10128 - DNA, 35 bp, Artificial Sequence
  Synthetic oligonucleotide
tctccgcctggttttgcctgtttctcatcgccccg

SEQ ID NO: 10129 - DNA, 36 bp, Artificial Sequence
  Synthetic oligonucleotide
gttgacccgcctgacatttttatcgtaccatatcca

SEQ ID NO: 10130 - DNA, 35 bp, Artificial Sequence
  Synthetic oligonucleotide
gaccccctccctggtgcatttcaataatcttgact

SEQ ID NO: 10131 - DNA, 34 bp, Artificial Sequence
  Synthetic oligonucleotide
gcacgagctcctccatcttgtatcgttgcccgct

SEQ ID NO: 10132 - DNA, 36 bp, Artificial Sequence
  Synthetic oligonucleotide
taacgcgaatactgccattgtcctaccctagtccca

SEQ ID NO: 10133 - DNA, 36 bp, Artificial Sequence
  Synthetic oligonucleotide
tcaccggtccgaagccttgcgttctccattatgcca

SEQ ID NO: 10134 - DNA, 37 bp, Artificial Sequence
  Synthetic oligonucleotide
tgcccaccccagcaccatgctccatcatactctgaga

SEQ ID NO: 10135 - DNA, 37 bp, Artificial Sequence
  Synthetic oligonucleotide
gattcgacatccgccccgtggtactttcactcactga

SEQ ID NO: 10136 - DNA, 35 bp, Artificial Sequence
  Synthetic oligonucleotide
tctgaaacccgcatgcatgaccgtctccaccttct

SEQ ID NO: 10137 - DNA, 37 bp, Artificial Sequence
  Synthetic oligonucleotide
gggaggtgcgagtaggaaagggtggtgagtggctaga

SEQ ID NO: 10138 - DNA, 35 bp, Artificial Sequence
  Synthetic oligonucleotide
gccacgtaacttgtacgctcactgattttacccta

SEQ ID NO: 10139 - DNA, 35 bp, Artificial Sequence
  Synthetic oligonucleotide
ttgtccaccgtactggcattccgttaacttcgtcc

SEQ ID NO: 10140 - DNA, 36 bp, Artificial Sequence
  Synthetic oligonucleotide
gttgagtgccagcaagtttaccacccccgcctacca

SEQ ID NO: 10141 - DNA, 35 bp, Artificial Sequence
  Synthetic oligonucleotide
gtcccaccaacctggtcctatgccccccccttgta

SEQ ID NO: 10142 - DNA, 35 bp, Artificial Sequence
  Synthetic oligonucleotide
actgtcgcctcctaaccctcacactgcacgctctc

SEQ ID NO: 10143 - DNA, 32 bp, Artificial Sequence
  Synthetic oligonucleotide
tacagcaaccttccgttcattttcttcaccga

SEQ ID NO: 10144 - DNA, 36 bp, Artificial Sequence
  Synthetic oligonucleotide
aacgcctactccactgctatactggtccggttcata

SEQ ID NO: 10145 - DNA, 35 bp, Artificial Sequence
  Synthetic oligonucleotide
aaccacgctgtgcagtgattctcaccatcttgtcc

SEQ ID NO: 10146 - DNA, 38 bp, Artificial Sequence
  Synthetic oligonucleotide
tgtatcccccacacttcgaactggccatggtccgttga

SEQ ID NO: 10147 - DNA, 36 bp, Artificial Sequence
  Synthetic oligonucleotide
tgatcctcatccatccgttccatcagacaccctcta

SEQ ID NO: 10148 - DNA, 35 bp, Artificial Sequence
  Synthetic oligonucleotide
gacccgcatgcaggtgcgtccctcccatgtaccgt

SEQ ID NO: 10149 - DNA, 36 bp, Artificial Sequence
  Synthetic oligonucleotide
gtggtgctcagttagcggccaatccatcgtacacca

SEQ ID NO: 10150 - DNA, 35 bp, Artificial Sequence
  Synthetic oligonucleotide
gaccacacgcatcttgcttgcctgagctctatact

SEQ ID NO: 10151 - DNA, 36 bp, Artificial Sequence
  Synthetic oligonucleotide
ttgggcctcctctttggtatccccgacttcctctca

SEQ ID NO: 10152 - DNA, 37 bp, Artificial Sequence
  Synthetic oligonucleotide
gacaaaggagcggggttgagggcttcgttgggggtga

SEQ ID NO: 10153 - DNA, 35 bp, Artificial Sequence
  Synthetic oligonucleotide
gactcaacccccgctgagacgccccccccgtagcc

SEQ ID NO: 10154 - DNA, 36 bp, Artificial Sequence
  Synthetic oligonucleotide
gcgacacttagcctgcgtactcatacaaccatgtca

SEQ ID NO: 10155 - DNA, 38 bp, Artificial Sequence
  Synthetic oligonucleotide
ggaggagagggggggcaagggaacacgtgaggtaatga

SEQ ID NO: 10156 - DNA, 36 bp, Artificial Sequence
  Synthetic oligonucleotide
tgtgcctactttgccaccacgtacaccgattcttga

SEQ ID NO: 10157 - DNA, 35 bp, Artificial Sequence
  Synthetic oligonucleotide
gagtgcatcccggtccccttcccaggtacttcccc

SEQ ID NO: 10158 - DNA, 35 bp, Artificial Sequence
  Synthetic oligonucleotide
ttcgaccccttgtcactttactgttgggtttccct

SEQ ID NO: 10159 - DNA, 36 bp, Artificial Sequence
  Synthetic oligonucleotide
gagggggggaagggaatacgtaatggggctggagaa

SEQ ID NO: 10160 - DNA, 36 bp, Artificial Sequence
  Synthetic oligonucleotide
gtaaccccatgatctgtccacacccctcgtgactca

SEQ ID NO: 10161 - DNA, 37 bp, Artificial Sequence
  Synthetic oligonucleotide
tcagtgcaacgcagcaagcactccgccccgacctcga

SEQ ID NO: 10162 - DNA, 37 bp, Artificial Sequence
  Synthetic oligonucleotide
accatgggcaccctctttcctacacctcgctctccga

SEQ ID NO: 10163 - DNA, 36 bp, Artificial Sequence
  Synthetic oligonucleotide
tacccgcccttccgctttgttacttaacggttccca

SEQ ID NO: 10164 - DNA, 35 bp, Artificial Sequence
  Synthetic oligonucleotide
accacctcagacatccagcacgttgtcgtctctgc

SEQ ID NO: 10165 - DNA, 35 bp, Artificial Sequence
  Synthetic oligonucleotide
tcagaccgagcacctacgcagccttgggacctccc

SEQ ID NO: 10166 - DNA, 35 bp, Artificial Sequence
  Synthetic oligonucleotide
tgcacctgggactgggcctccctaccaacacttct

SEQ ID NO: 10167 - DNA, 36 bp, Artificial Sequence
  Synthetic oligonucleotide
tcccctcccctctccggtaccttagaggacgtatca

SEQ ID NO: 10168 - DNA, 35 bp, Artificial Sequence
  Synthetic oligonucleotide
atagaagggtgcgagtgggggaggggtggacggca

SEQ ID NO: 10169 - DNA, 35 bp, Artificial Sequence
  Synthetic oligonucleotide
gaatcgcggagggggaaaaagtggcaatggatggt

SEQ ID NO: 10170 - DNA, 37 bp, Artificial Sequence
  Synthetic oligonucleotide
acctgccgtgtaacacatctttttaaccatgccatga

SEQ ID NO: 10171 - DNA, 37 bp, Artificial Sequence
  Synthetic oligonucleotide
gcccgacgctgccgatctctctccatctagctattga

SEQ ID NO: 10172 - DNA, 37 bp, Artificial Sequence
  Synthetic oligonucleotide
gatagtgggtagtggcgtgggtgggagggtcggcgga

SEQ ID NO: 10173 - DNA, 35 bp, Artificial Sequence
  Synthetic oligonucleotide
accctgcaaactctctaaatggcccagcaccatgc

SEQ ID NO: 10174 - DNA, 36 bp, Artificial Sequence
  Synthetic oligonucleotide
aacgcaccctccgtgcctgtcacagaaatcatcgaa

SEQ ID NO: 10175 - DNA, 38 bp, Artificial Sequence
  Synthetic oligonucleotide
atcacacagccaatgttttggcgttccatcttacttga

SEQ ID NO: 10176 - DNA, 35 bp, Artificial Sequence
  Synthetic oligonucleotide
gacctgactgccatggcactagactcctcttcgaa

SEQ ID NO: 10177 - DNA, 35 bp, Artificial Sequence
  Synthetic oligonucleotide
gcccaccgtctttggccccgctccgccaacgcgac

SEQ ID NO: 10178 - DNA, 35 bp, Artificial Sequence
  Synthetic oligonucleotide
gaaccggtcacctcgcttactgcctgaatttttgc

SEQ ID NO: 10179 - DNA, 35 bp, Artificial Sequence
  Synthetic oligonucleotide
gtacgccgctctgaccgtttttgtcttcctctagg

SEQ ID NO: 10180 - DNA, 35 bp, Artificial Sequence
  Synthetic oligonucleotide
acaccaacttgcacccgatatttgttctattgcca

SEQ ID NO: 10181 - DNA, 35 bp, Artificial Sequence
  Synthetic oligonucleotide
ttcacgcaaccttgcccacctgtgtggtccgcctc

SEQ ID NO: 10182 - DNA, 36 bp, Artificial Sequence
  Synthetic oligonucleotide
gcttagccctcacattacgatctgcacgacgcacca

SEQ ID NO: 10183 - DNA, 36 bp, Artificial Sequence
  Synthetic oligonucleotide
gacaccccaaaccttatacatcagggcaccggtcca

SEQ ID NO: 10184 - DNA, 35 bp, Artificial Sequence
  Synthetic oligonucleotide
accgatgggtcctcgttcgtacacgtttccacctc

SEQ ID NO: 10185 - DNA, 37 bp, Artificial Sequence
  Synthetic oligonucleotide
gccatagctcgcggggacggaaagggagggcttggga

SEQ ID NO: 10186 - DNA, 37 bp, Artificial Sequence
  Synthetic oligonucleotide
gagccacccgtctcagcgtgagttgcttccttcctga

SEQ ID NO: 10187 - DNA, 37 bp, Artificial Sequence
  Synthetic oligonucleotide
aacgcacgggagggggagaccttcgggtgtggtgtga

SEQ ID NO: 10188 - DNA, 35 bp, Artificial Sequence
  Synthetic oligonucleotide
aaccgcctcgtcccctccattcccaggctggcacc

SEQ ID NO: 10189 - DNA, 35 bp, Artificial Sequence
  Synthetic oligonucleotide
tctgtcaccccacttataccctgtcgctattcggc

SEQ ID NO: 10190 - DNA, 35 bp, Artificial Sequence
  Synthetic oligonucleotide
tcaccaccaggcgccatggcatatggccgcacact

SEQ ID NO: 10191 - DNA, 35 bp, Artificial Sequence
  Synthetic oligonucleotide
gccccatctatgcgcactggaataccactacacct

SEQ ID NO: 10192 - DNA, 35 bp, Artificial Sequence
  Synthetic oligonucleotide
acccgtgcccccttcgcgctattcaattcgttgct

SEQ ID NO: 10193 - DNA, 35 bp, Artificial Sequence
  Synthetic oligonucleotide
tacacctccagcctttggcaccactgcgattttag

SEQ ID NO: 10194 - DNA, 37 bp, Artificial Sequence
  Synthetic oligonucleotide
tcagcacatccgtgtcgcgccctcactcttcccacga

SEQ ID NO: 10195 - DNA, 35 bp, Artificial Sequence
  Synthetic oligonucleotide
tcttagcaaccgatccttcccacgcgacctgctta

SEQ ID NO: 10196 - DNA, 35 bp, Artificial Sequence
  Synthetic oligonucleotide
gttccgaaccggcatccctcccgtagtccgttgcc

SEQ ID NO: 10197 - DNA, 35 bp, Artificial Sequence
  Synthetic oligonucleotide
gtaacattcgcaccttgccccccgccgctgttgca

SEQ ID NO: 10198 - DNA, 35 bp, Artificial Sequence
  Synthetic oligonucleotide
acttacacctccactctgtgctccttgcttacgtt

SEQ ID NO: 10199 - DNA, 36 bp, Artificial Sequence
  Synthetic oligonucleotide
gttgccgccacacacacgcctacacaagacactaga

SEQ ID NO: 10200 - DNA, 35 bp, Artificial Sequence
  Synthetic oligonucleotide
tgtccgaatcctgacttatgcccttggcttcctgc

SEQ ID NO: 10201 - DNA, 36 bp, Artificial Sequence
  Synthetic oligonucleotide
taccatccagtgggccaatagcctacaccattatga

SEQ ID NO: 10202 - DNA, 37 bp, Artificial Sequence
  Synthetic oligonucleotide
tcatgcgggcagatccgctacaaccaaaccccccaga

SEQ ID NO: 10203 - DNA, 35 bp, Artificial Sequence
  Synthetic oligonucleotide
agttgtccgaccattgtcaagccgccctgttcctc

SEQ ID NO: 10204 - DNA, 35 bp, Artificial Sequence
  Synthetic oligonucleotide
atgccaaccaccgaagtcccatcagatgctccaat

SEQ ID NO: 10205 - DNA, 38 bp, Artificial Sequence
  Synthetic oligonucleotide
tcacccagctgcacaccgagtctccatcccacttgtga

SEQ ID NO: 10206 - DNA, 36 bp, Artificial Sequence
  Synthetic oligonucleotide
gtgccaaccagactgaacgtcaccacgcccacccca

SEQ ID NO: 10207 - DNA, 38 bp, Artificial Sequence
  Synthetic oligonucleotide
gatctaccaacccacgtgtcttactgcacttgccgtga

SEQ ID NO: 10208 - DNA, 35 bp, Artificial Sequence
  Synthetic oligonucleotide
tccgccatctcatcttgtgtcattccatcccagcc

SEQ ID NO: 10209 - DNA, 33 bp, Artificial Sequence
  Synthetic oligonucleotide
gacctacatgagcccgttacgactgcccaccac

SEQ ID NO: 10210 - DNA, 37 bp, Artificial Sequence
  Synthetic oligonucleotide
aaggggagtcgtaaggggggggcgggacaagaactga

SEQ ID NO: 10211 - DNA, 35 bp, Artificial Sequence
  Synthetic oligonucleotide
gtatgacaggtggaaggagggggcggacgtgggag

SEQ ID NO: 10212 - DNA, 35 bp, Artificial Sequence
  Synthetic oligonucleotide
agaccatacgctcaatgcactacctgtctccccct

SEQ ID NO: 10213 - DNA, 36 bp, Artificial Sequence
  Synthetic oligonucleotide
gcccaccaatgagtgccccgtgcctttcactttcaa

SEQ ID NO: 10214 - DNA, 38 bp, Artificial Sequence
  Synthetic oligonucleotide
tttggcacagagcggaaatagggggctagggggggtga

SEQ ID NO: 10215 - DNA, 35 bp, Artificial Sequence
  Synthetic oligonucleotide
ttcacgctcccactcgtactacggcctatacttgt

SEQ ID NO: 10216 - DNA, 36 bp, Artificial Sequence
  Synthetic oligonucleotide
gccgactcgccttgctggctcattgaatcatgtcca

SEQ ID NO: 10217 - DNA, 35 bp, Artificial Sequence
  Synthetic oligonucleotide
gtccacctgccatgggctcctctaactccgctcca

SEQ ID NO: 10218 - DNA, 35 bp, Artificial Sequence
  Synthetic oligonucleotide
acaacgtgctgatctacttgggtccggcctttcct

SEQ ID NO: 10219 - DNA, 35 bp, Artificial Sequence
  Synthetic oligonucleotide
actgactctagtacgcccgccaaccacgccttgcc

SEQ ID NO: 10220 - DNA, 35 bp, Artificial Sequence
  Synthetic oligonucleotide
taccgccgcccctagctggccatcgactctcaccg

SEQ ID NO: 10221 - DNA, 35 bp, Artificial Sequence
  Synthetic oligonucleotide
ttcgttgcacgaaatcggcctctaccccccaacac

SEQ ID NO: 10222 - DNA, 35 bp, Artificial Sequence
  Synthetic oligonucleotide
attgacaccagcggatctctgcctccgagtcccat

SEQ ID NO: 10223 - DNA, 35 bp, Artificial Sequence
  Synthetic oligonucleotide
atccatcgcacccctcctctttatttcccatgtgg

SEQ ID NO: 10224 - DNA, 36 bp, Artificial Sequence
  Synthetic oligonucleotide
aagcccaacgcccgctgtcggtccctcgtactctta

SEQ ID NO: 10225 - DNA, 35 bp, Artificial Sequence
  Synthetic oligonucleotide
gtccaccatgcttacccagtctcgctcaggttcgc

SEQ ID NO: 10226 - DNA, 35 bp, Artificial Sequence
  Synthetic oligonucleotide
gactgacggacgcaacctctccatggaacacttct

SEQ ID NO: 10227 - DNA, 37 bp, Artificial Sequence
  Synthetic oligonucleotide
gatgagggtgacaggggctgagcaggggaaagggaga

SEQ ID NO: 10228 - DNA, 37 bp, Artificial Sequence
  Synthetic oligonucleotide
tcacgccttggtgcctatctcttgtttctccctggga

SEQ ID NO: 10229 - DNA, 38 bp, Artificial Sequence
  Synthetic oligonucleotide
tcccccccctctactgtcttaagccatgtcgtccttga

SEQ ID NO: 10230 - DNA, 35 bp, Artificial Sequence
  Synthetic oligonucleotide
gccaccaactgctgtccgctcgttttatgccatac

SEQ ID NO: 10231 - DNA, 35 bp, Artificial Sequence
  Synthetic oligonucleotide
tggactccgacatacgcccccacacccgctctggt

SEQ ID NO: 10232 - DNA, 37 bp, Artificial Sequence
  Synthetic oligonucleotide
gtaccaccctcacttctatcacagtatatctgctaga

SEQ ID NO: 10233 - DNA, 35 bp, Artificial Sequence
  Synthetic oligonucleotide
acctcgtccacttctatttccgagtactatccctc

SEQ ID NO: 10234 - DNA, 36 bp, Artificial Sequence
  Synthetic oligonucleotide
tcaccctcacctcggtcctccttgaaggacacatga

SEQ ID NO: 10235 - DNA, 38 bp, Artificial Sequence
  Synthetic oligonucleotide
attgccggtccatgtgtccacctccccctacctgctga

SEQ ID NO: 10236 - DNA, 35 bp, Artificial Sequence
  Synthetic oligonucleotide
atgcacccgtacctgcatagaccaatgacctcgac

SEQ ID NO: 10237 - DNA, 35 bp, Artificial Sequence
  Synthetic oligonucleotide
aaccaatgccagtgtccgtctttgggcctctctct

SEQ ID NO: 10238 - DNA, 35 bp, Artificial Sequence
  Synthetic oligonucleotide
atgccccctctaccagtactgaaccgaacagctgg

SEQ ID NO: 10239 - DNA, 35 bp, Artificial Sequence
  Synthetic oligonucleotide
gaacaaccgaagctctgcatataccgtgcctttct

SEQ ID NO: 10240 - DNA, 35 bp, Artificial Sequence
  Synthetic oligonucleotide
acccacatccttggcttacgaatagtacttcgtgt

SEQ ID NO: 10241 - DNA, 35 bp, Artificial Sequence
  Synthetic oligonucleotide
tacgccatctcggcttatactgtacactccggtcc

SEQ ID NO: 10242 - DNA, 36 bp, Artificial Sequence
  Synthetic oligonucleotide
gtggctcaccgcgtacccatgccgtttttcctgtca

SEQ ID NO: 10243 - DNA, 35 bp, Artificial Sequence
  Synthetic oligonucleotide
acatcacacgtatcgcttgtatttcttcaccacca

SEQ ID NO: 10244 - DNA, 36 bp, Artificial Sequence
  Synthetic oligonucleotide
accacctgtccgtttgccataccgattttcacctga

SEQ ID NO: 10245 - DNA, 35 bp, Artificial Sequence
  Synthetic oligonucleotide
tgcgaccgccccactaccgcataaatgatcgatac

SEQ ID NO: 10246 - DNA, 35 bp, Artificial Sequence
  Synthetic oligonucleotide
gacaccgcctcattaccctatgcggtagtaacatc

SEQ ID NO: 10247 - DNA, 35 bp, Artificial Sequence
  Synthetic oligonucleotide
gaccatgctacttgtttccgcgatccacatcataa

SEQ ID NO: 10248 - DNA, 35 bp, Artificial Sequence
  Synthetic oligonucleotide
tccatttcgccaatccctctccggagcctgcattt

SEQ ID NO: 10249 - DNA, 38 bp, Artificial Sequence
  Synthetic oligonucleotide
tgaagggtgggggacgggtgggaatggcgcaatgttga

SEQ ID NO: 10250 - DNA, 35 bp, Artificial Sequence
  Synthetic oligonucleotide
accgcccgaattccaagtatcaatggggggccctc

SEQ ID NO: 10251 - DNA, 34 bp, Artificial Sequence
  Synthetic oligonucleotide
gactacgacagtatgtcttcattatgtctgtcac

SEQ ID NO: 10252 - DNA, 36 bp, Artificial Sequence
  Synthetic oligonucleotide
gtcttgtcctgcaccacgaacgctcggttattacca

SEQ ID NO: 10253 - DNA, 36 bp, Artificial Sequence
  Synthetic oligonucleotide
acctaccaccgcagccagtcacaaggccttttatta

SEQ ID NO: 10254 - DNA, 36 bp, Artificial Sequence
  Synthetic oligonucleotide
accacccggccatactgggccccacctcaccaaatc

SEQ ID NO: 10255 - DNA, 36 bp, Artificial Sequence
  Synthetic oligonucleotide
gacccattactccccctgctttctggttgccgacca

SEQ ID NO: 10256 - DNA, 37 bp, Artificial Sequence
  Synthetic oligonucleotide
agaaagggaagggagtggagtggagtgagtgtcatga

SEQ ID NO: 10257 - DNA, 35 bp, Artificial Sequence
  Synthetic oligonucleotide
tccccgttcctgaccttaccatcaccccggactgt

SEQ ID NO: 10258 - DNA, 35 bp, Artificial Sequence
  Synthetic oligonucleotide
taaatcgcaccccgcgcctggcataccatccctca

SEQ ID NO: 10259 - DNA, 35 bp, Artificial Sequence
  Synthetic oligonucleotide
gcgaatagccgccacatcatctttctacattggcc

SEQ ID NO: 10260 - DNA, 35 bp, Artificial Sequence
  Synthetic oligonucleotide
agcaacccccgctcaagacatgcttctgccccacg

SEQ ID NO: 10261 - DNA, 35 bp, Artificial Sequence
  Synthetic oligonucleotide
tgccactctacggtaacatccacagctcgctgcaa

SEQ ID NO: 10262 - DNA, 36 bp, Artificial Sequence
  Synthetic oligonucleotide
gggaagggggggtgagtaggagtaaggtgatgataa

SEQ ID NO: 10263 - DNA, 38 bp, Artificial Sequence
  Synthetic oligonucleotide
acccacaacgagtgcacacttcacatcaatacaggtga

SEQ ID NO: 10264 - DNA, 35 bp, Artificial Sequence
  Synthetic oligonucleotide
atcgaacctcctcgacacggattcccttactccgt

SEQ ID NO: 10265 - DNA, 37 bp, Artificial Sequence
  Synthetic oligonucleotide
aaccgggcacagtgcaagggtgggggacgctcaggga

SEQ ID NO: 10266 - DNA, 36 bp, Artificial Sequence
  Synthetic oligonucleotide
atgaccgaagcctcacgcgtttccccagccctcgca

SEQ ID NO: 10267 - DNA, 38 bp, Artificial Sequence
  Synthetic oligonucleotide
tccccgcacctggcttgtgctgtgttcgtgttgcttga

SEQ ID NO: 10268 - DNA, 35 bp, Artificial Sequence
  Synthetic oligonucleotide
ggtgacacccgaggagccccttattgttccaaccc

SEQ ID NO: 10269 - DNA, 36 bp, Artificial Sequence
  Synthetic oligonucleotide
acgcacgtttgtctgtgacctgcctagtcctctcca

SEQ ID NO: 10270 - DNA, 37 bp, Artificial Sequence
  Synthetic oligonucleotide
ggacgtggggggacatgcggggtagggacggagggga

SEQ ID NO: 10271 - DNA, 37 bp, Artificial Sequence
  Synthetic oligonucleotide
gtgacccgcctgccctttacgccatcgagactgtgga

SEQ ID NO: 10272 - DNA, 35 bp, Artificial Sequence
  Synthetic oligonucleotide
aacctacccgcagatccaccgactatccttcatgc

SEQ ID NO: 10273 - DNA, 37 bp, Artificial Sequence
  Synthetic oligonucleotide
tttgcccctaccctctgagtctaatcaacgttttcga

SEQ ID NO: 10274 - DNA, 35 bp, Artificial Sequence
  Synthetic oligonucleotide
tcctgacccaccacttgaaacacaagccgcacggc

SEQ ID NO: 10275 - DNA, 38 bp, Artificial Sequence
  Synthetic oligonucleotide
taattcaccctcaaccctgttattcatgccgtggctga

SEQ ID NO: 10276 - DNA, 35 bp, Artificial Sequence
  Synthetic oligonucleotide
gtcccaccaattcgtgccagatacgcgcactgctc

SEQ ID NO: 10277 - DNA, 35 bp, Artificial Sequence
  Synthetic oligonucleotide
acagaacagggagggggtgaacacggaaatgcatg

SEQ ID NO: 10278 - DNA, 35 bp, Artificial Sequence
  Synthetic oligonucleotide
aacatcctagcgcgcgtgcttgcgaacattcccat

SEQ ID NO: 10279 - DNA, 35 bp, Artificial Sequence
  Synthetic oligonucleotide
aatagcggccgtccgtttgcttccatgtcacatct

SEQ ID NO: 10280 - DNA, 35 bp, Artificial Sequence
  Synthetic oligonucleotide
gttgtacgcatcaacgacccgctcacacctcctgt

SEQ ID NO: 10281 - DNA, 36 bp, Artificial Sequence
  Synthetic oligonucleotide
gcgaagggtgggagggggtggggcatgtgctaggta

SEQ ID NO: 10282 - DNA, 35 bp, Artificial Sequence
  Synthetic oligonucleotide
atccgacgtccacgtctacttcgagttccattcat

SEQ ID NO: 10283 - DNA, 35 bp, Artificial Sequence
  Synthetic oligonucleotide
aactagcgcacacaactcacgatcaccgatgctta

SEQ ID NO: 10284 - DNA, 35 bp, Artificial Sequence
  Synthetic oligonucleotide
gccacaacattggtttcacagctccagccatcgac

SEQ ID NO: 10285 - DNA, 35 bp, Artificial Sequence
  Synthetic oligonucleotide
atgccgataccactccgatttgcaacttgctgtac

SEQ ID NO: 10286 - DNA, 35 bp, Artificial Sequence
  Synthetic oligonucleotide
tcatgcctcacccactgacttgcgtaccctcccag

SEQ ID NO: 10287 - DNA, 37 bp, Artificial Sequence
  Synthetic oligonucleotide
ctcgacgtgccctgcccccagacaagtcccgccagga

SEQ ID NO: 10288 - DNA, 35 bp, Artificial Sequence
  Synthetic oligonucleotide
gtacgccgctggtttctgctatactctcgcccata

SEQ ID NO: 10289 - DNA, 35 bp, Artificial Sequence
  Synthetic oligonucleotide
tacgccccctcacggctgtcgtaataggcctttcc

SEQ ID NO: 10290 - DNA, 35 bp, Artificial Sequence
  Synthetic oligonucleotide
acccctccgccgggcttctacacggtctttcacct

SEQ ID NO: 10291 - DNA, 35 bp, Artificial Sequence
  Synthetic oligonucleotide
gcccaggcgcactgcccgaccaaccgcactgggtt

SEQ ID NO: 10292 - DNA, 37 bp, Artificial Sequence
  Synthetic oligonucleotide
gccgtcgcacgccataccatcacaccgcctttagtga

SEQ ID NO: 10293 - DNA, 35 bp, Artificial Sequence
  Synthetic oligonucleotide
aacccatgcgccgtacctttctacgttatactttc

SEQ ID NO: 10294 - DNA, 35 bp, Artificial Sequence
  Synthetic oligonucleotide
tccccttgcctgacctacatcccttgatcgctgaa

SEQ ID NO: 10295 - DNA, 35 bp, Artificial Sequence
  Synthetic oligonucleotide
tctacccccatcctcggttttctcatggagatcac

SEQ ID NO: 10296 - DNA, 35 bp, Artificial Sequence
  Synthetic oligonucleotide
gggacacacgtactcatccgcacgtccctgtaccc

SEQ ID NO: 10297 - DNA, 35 bp, Artificial Sequence
  Synthetic oligonucleotide
acgctcgcagtctcctgggacccgttttcctccgt

SEQ ID NO: 10298 - DNA, 35 bp, Artificial Sequence
  Synthetic oligonucleotide
atctccacctgctaccccgaagggatatgtcactc

SEQ ID NO: 10299 - DNA, 35 bp, Artificial Sequence
  Synthetic oligonucleotide
gcctacgatcggttggcggtaatacctctgctcct

SEQ ID NO: 10300 - DNA, 35 bp, Artificial Sequence
  Synthetic oligonucleotide
tctcccccagagccctagggacccgagctaacctt

SEQ ID NO: 10301 - DNA, 35 bp, Artificial Sequence
  Synthetic oligonucleotide
atgttacgaccgagtctacacttgctactaccctt

SEQ ID NO: 10302 - DNA, 35 bp, Artificial Sequence
  Synthetic oligonucleotide
tctcggaccccccacccgccgcggcctttcacgga

SEQ ID NO: 10303 - DNA, 38 bp, Artificial Sequence
  Synthetic oligonucleotide
ggaccccgcccacccgttatagcaggcccaatttctga

SEQ ID NO: 10304 - DNA, 35 bp, Artificial Sequence
  Synthetic oligonucleotide
acctcctccgcagtacgtccacaggtcctgttccc

SEQ ID NO: 10305 - DNA, 35 bp, Artificial Sequence
  Synthetic oligonucleotide
aagcgtaggggtcgtacgctatccatcctgtcttc

SEQ ID NO: 10306 - DNA, 35 bp, Artificial Sequence
  Synthetic oligonucleotide
accgcactcacgcgatcgaacgccccgtatctcca

SEQ ID NO: 10307 - DNA, 35 bp, Artificial Sequence
  Synthetic oligonucleotide
gtccatcccaggccgtgtaccttttgcgtaatacc

SEQ ID NO: 10308 - DNA, 35 bp, Artificial Sequence
  Synthetic oligonucleotide
gcctcctcaatcccccagtaccatccatagctggc

SEQ ID NO: 10309 - DNA, 35 bp, Artificial Sequence
  Synthetic oligonucleotide
ttcgcctgctcctgcctcccctaatcggcattgcg

SEQ ID NO: 10310 - DNA, 35 bp, Artificial Sequence
  Synthetic oligonucleotide
ggtcccctctcttgtctaacgcccggtccacttcg

SEQ ID NO: 10311 - DNA, 35 bp, Artificial Sequence
  Synthetic oligonucleotide
atggtcgacgccccattctactggttttgccgcct

SEQ ID NO: 10312 - DNA, 36 bp, Artificial Sequence
  Synthetic oligonucleotide
agatcccactgacctcgctgacccatctgtgcacca

SEQ ID NO: 10313 - DNA, 37 bp, Artificial Sequence
  Synthetic oligonucleotide
acattcctgtccggccgacaatcctttgctcactcga

SEQ ID NO: 10314 - DNA, 35 bp, Artificial Sequence
  Synthetic oligonucleotide
tagagcgctccatcgtcgtctcccttccaaagcaa

SEQ ID NO: 10315 - DNA, 35 bp, Artificial Sequence
  Synthetic oligonucleotide
gctcgccattgcgcgttttacccccttcgcaaccc

SEQ ID NO: 10316 - DNA, 35 bp, Artificial Sequence
  Synthetic oligonucleotide
tgacgtcaccgcatagcacattctgtcttacccgt

SEQ ID NO: 10317 - DNA, 37 bp, Artificial Sequence
  Synthetic oligonucleotide
tcgcacccatcacatgtccccattcggttcatccaga

SEQ ID NO: 10318 - DNA, 35 bp, Artificial Sequence
  Synthetic oligonucleotide
ttacgttccgcctcccgagggatttggacccctac

SEQ ID NO: 10319 - DNA, 36 bp, Artificial Sequence
  Synthetic oligonucleotide
gcccaccacgcgatggttttaccacctcttaagtta

SEQ ID NO: 10320 - DNA, 35 bp, Artificial Sequence
  Synthetic oligonucleotide
gtcccatcacccgctattctagtcctcgaattccg

SEQ ID NO: 10321 - DNA, 35 bp, Artificial Sequence
  Synthetic oligonucleotide
tagccccccccgataatatgtacatcgcactaact

SEQ ID NO: 10322 - DNA, 36 bp, Artificial Sequence
  Synthetic oligonucleotide
tttcgaacacctgccgctcgaccctttacttcatta

SEQ ID NO: 10323 - DNA, 35 bp, Artificial Sequence
  Synthetic oligonucleotide
tctcacagatcacgcgcttaccccggcactcatcc

SEQ ID NO: 10324 - DNA, 37 bp, Artificial Sequence
  Synthetic oligonucleotide
gatggccccacctgcaacccttccccactttgtgcga

SEQ ID NO: 10325 - DNA, 37 bp, Artificial Sequence
  Synthetic oligonucleotide
ttcgcgctgcccctctcgtgccactattttgacctga

SEQ ID NO: 10326 - DNA, 36 bp, Artificial Sequence
  Synthetic oligonucleotide
gccatccacctgagtctggtcattctgttcttgtta

SEQ ID NO: 10327 - DNA, 36 bp, Artificial Sequence
  Synthetic oligonucleotide
gatgtcctgtcccatgtcgttctatctcacttttga

SEQ ID NO: 10328 - DNA, 35 bp, Artificial Sequence
  Synthetic oligonucleotide
tctcctccgcgccgcccttggctccatccctgtag

SEQ ID NO: 10329 - DNA, 37 bp, Artificial Sequence
  Synthetic oligonucleotide
ggagggtggacgaagggggggttatgaactcgaggga

SEQ ID NO: 10330 - DNA, 35 bp, Artificial Sequence
  Synthetic oligonucleotide
gccacatccggtccgtgcattacgtgcgctttata

SEQ ID NO: 10331 - DNA, 35 bp, Artificial Sequence
  Synthetic oligonucleotide
gccgactcactcgaacggttctcgagacccgccac

SEQ ID NO: 10332 - DNA, 35 bp, Artificial Sequence
  Synthetic oligonucleotide
acgatccaaacgttatccgccgttaatctgtcctc

SEQ ID NO: 10333 - DNA, 35 bp, Artificial Sequence
  Synthetic oligonucleotide
ttgcacagggggtggaggtaggaacggagatcacg

SEQ ID NO: 10334 - DNA, 36 bp, Artificial Sequence
  Synthetic oligonucleotide
gcacacctcctatgatcataggactatttctgccaa

SEQ ID NO: 10335 - DNA, 38 bp, Artificial Sequence
  Synthetic oligonucleotide
gccccgcgcggcaccaccatttccgtcccattggctga

SEQ ID NO: 10336 - DNA, 35 bp, Artificial Sequence
  Synthetic oligonucleotide
acctccccaccaacacgcgcccgaccctgggtacg

SEQ ID NO: 10337 - DNA, 36 bp, Artificial Sequence
  Synthetic oligonucleotide
attcaacccgctgcctttctcgtagttcctacacaa

SEQ ID NO: 10338 - DNA, 35 bp, Artificial Sequence
  Synthetic oligonucleotide
tcaggtacggtcggaacgccaaccccctcttacca

SEQ ID NO: 10339 - DNA, 37 bp, Artificial Sequence
  Synthetic oligonucleotide
aaagagggtcggggacgggtgggtagtgctctgtaga

SEQ ID NO: 10340 - DNA, 35 bp, Artificial Sequence
  Synthetic oligonucleotide
tcatccatgccttatatatttcttgacctctggct

SEQ ID NO: 10341 - DNA, 35 bp, Artificial Sequence
  Synthetic oligonucleotide
agaaaagggggtgcagtcgaattaggaggttgggg

SEQ ID NO: 10342 - DNA, 35 bp, Artificial Sequence
  Synthetic oligonucleotide
acgacgcaactgcccgcctgttcacataacgaaca

SEQ ID NO: 10343 - DNA, 35 bp, Artificial Sequence
  Synthetic oligonucleotide
accccacaaaccttcccgctgtcttataggctagc

SEQ ID NO: 10344 - DNA, 35 bp, Artificial Sequence
  Synthetic oligonucleotide
tgaaattggggagggcatgtggggggagtgtggga

SEQ ID NO: 10345 - DNA, 35 bp, Artificial Sequence
  Synthetic oligonucleotide
ctcgacacctggccctgttttgccacccacttctg

SEQ ID NO: 10346 - DNA, 38 bp, Artificial Sequence
  Synthetic oligonucleotide
gtgtgtagctcaccctcgttatcgaatttctgccttga

SEQ ID NO: 10347 - DNA, 38 bp, Artificial Sequence
  Synthetic oligonucleotide
tgatcgtaccatctgcgcctctgactccagccatttga

SEQ ID NO: 10348 - DNA, 35 bp, Artificial Sequence
  Synthetic oligonucleotide
agtgcgacacctcacttgggttcttccgtgccgac

SEQ ID NO: 10349 - DNA, 35 bp, Artificial Sequence
  Synthetic oligonucleotide
tctgtcgcctccaccaaccacttattcggcaaagc

SEQ ID NO: 10350 - DNA, 35 bp, Artificial Sequence
  Synthetic oligonucleotide
tcggcttcacgtcacggttctttcgcccccttcct

SEQ ID NO: 10351 - DNA, 36 bp, Artificial Sequence
  Synthetic oligonucleotide
ttgagccgctcaagcctttctttgccatttgtaaca

SEQ ID NO: 10352 - DNA, 35 bp, Artificial Sequence
  Synthetic oligonucleotide
gccgtcattggtccattgtgcgcgtacccgttctc

SEQ ID NO: 10353 - DNA, 35 bp, Artificial Sequence
  Synthetic oligonucleotide
gttgatcccagtagggtttggtcgccccttgcttt

SEQ ID NO: 10354 - DNA, 38 bp, Artificial Sequence
  Synthetic oligonucleotide
gccgcaggccgaccagctagcatcttacgacccaatga

SEQ ID NO: 10355 - DNA, 38 bp, Artificial Sequence
  Synthetic oligonucleotide
tacagccgcctgggatctcgcgacctccttctatctga

SEQ ID NO: 10356 - DNA, 36 bp, Artificial Sequence
  Synthetic oligonucleotide
gacagtcgtatacattgatcgcactggcccttctta

SEQ ID NO: 10357 - DNA, 35 bp, Artificial Sequence
  Synthetic oligonucleotide
atggtggctttatcgcccgtgccctgccccattcc

SEQ ID NO: 10358 - DNA, 36 bp, Artificial Sequence
  Synthetic oligonucleotide
gccccccacactgcactacaacctcggttatgcaaa

SEQ ID NO: 10359 - DNA, 38 bp, Artificial Sequence
  Synthetic oligonucleotide
gggacgggtaagggggggaaggtagtgcaggtgaatga

SEQ ID NO: 10360 - DNA, 35 bp, Artificial Sequence
  Synthetic oligonucleotide
tcactgctcaagggtaccgcttcatctcccctctg

SEQ ID NO: 10361 - DNA, 36 bp, Artificial Sequence
  Synthetic oligonucleotide
gcgaaagcacgggagaagagacgtggtgacgttgaa

SEQ ID NO: 10362 - DNA, 35 bp, Artificial Sequence
  Synthetic oligonucleotide
atatgccccgcgagcacgagctcacaacttttaca

SEQ ID NO: 10363 - DNA, 36 bp, Artificial Sequence
  Synthetic oligonucleotide
accgccctacccacctgtgtcgtgccacgtactgca

SEQ ID NO: 10364 - DNA, 37 bp, Artificial Sequence
  Synthetic oligonucleotide
tatcaccctcaatcgtcccgttaactacaccatacga

SEQ ID NO: 10365 - DNA, 37 bp, Artificial Sequence
  Synthetic oligonucleotide
aactcgccaacacgtgtatacctgcccccctcgatga

SEQ ID NO: 10366 - DNA, 37 bp, Artificial Sequence
  Synthetic oligonucleotide
atctcgcacggttcctttaacgccctgcctttcttga

SEQ ID NO: 10367 - DNA, 35 bp, Artificial Sequence
  Synthetic oligonucleotide
tgccccaccttccaaagtttttcgaatgacccacg

SEQ ID NO: 10368 - DNA, 35 bp, Artificial Sequence
  Synthetic oligonucleotide
tgacccagtccatcatccttaacgcgcaactcgtt

SEQ ID NO: 10369 - DNA, 35 bp, Artificial Sequence
  Synthetic oligonucleotide
tcccccgccacacactccctttagcatacctggca

SEQ ID NO: 10370 - DNA, 37 bp, Artificial Sequence
  Synthetic oligonucleotide
gacaccgacctcccagctagctctgctaccaacctga

SEQ ID NO: 10371 - DNA, 35 bp, Artificial Sequence
  Synthetic oligonucleotide
acgtacatgcgcaaccgcccgcctaaccatgtgac

SEQ ID NO: 10372 - DNA, 36 bp, Artificial Sequence
  Synthetic oligonucleotide
gctctccagccgattgcaacacgtcgtcttcaccca

SEQ ID NO: 10373 - DNA, 36 bp, Artificial Sequence
  Synthetic oligonucleotide
gtcaagccgccgcctgcctttccgagttcccgaaaa

SEQ ID NO: 10374 - DNA, 36 bp, Artificial Sequence
  Synthetic oligonucleotide
ttactccagctgtacctgtctatgcacccatccgca

SEQ ID NO: 10375 - DNA, 38 bp, Artificial Sequence
  Synthetic oligonucleotide
tagaccccctgacgctgtctcatcttagttcatcttga

SEQ ID NO: 10376 - DNA, 37 bp, Artificial Sequence
  Synthetic oligonucleotide
tcacagccccgtccaccccttctcgtcgctgattcga

SEQ ID NO: 10377 - DNA, 37 bp, Artificial Sequence
  Synthetic oligonucleotide
ggactcgctctgctgccccatcttcctcgtcccctga

SEQ ID NO: 10378 - DNA, 35 bp, Artificial Sequence
  Synthetic oligonucleotide
tcgacccccatgtgccccgcagtcccgtgttgtcc

SEQ ID NO: 10379 - DNA, 35 bp, Artificial Sequence
  Synthetic oligonucleotide
tctacccagaccttgacgctccacgttcccgctga

SEQ ID NO: 10380 - DNA, 35 bp, Artificial Sequence
  Synthetic oligonucleotide
tgccacaggcgcaatctgcatttacctcatacgct

SEQ ID NO: 10381 - DNA, 36 bp, Artificial Sequence
  Synthetic oligonucleotide
tgagcccatgcccggcctccccctatagttgccaca

SEQ ID NO: 10382 - DNA, 37 bp, Artificial Sequence
  Synthetic oligonucleotide
gtcgataggggaagcaggggtaatgacggtgggttga

SEQ ID NO: 10383 - DNA, 36 bp, Artificial Sequence
  Synthetic oligonucleotide
tctatgtcccctccactcgtccctgggtctacgtac

SEQ ID NO: 10384 - DNA, 35 bp, Artificial Sequence
  Synthetic oligonucleotide
actcattggcacgtgtaccttcgttactgctttcc

SEQ ID NO: 10385 - DNA, 36 bp, Artificial Sequence
  Synthetic oligonucleotide
gtgaaggaaattgtgtgggggaggggaggcggtgaa

SEQ ID NO: 10386 - DNA, 36 bp, Artificial Sequence
  Synthetic oligonucleotide
gccagtgtccccgacgcttgtcgaccttgtccatca

SEQ ID NO: 10387 - DNA, 38 bp, Artificial Sequence
  Synthetic oligonucleotide
agacctgtcccatactgtaatgctctccacccatttga

SEQ ID NO: 10388 - DNA, 36 bp, Artificial Sequence
  Synthetic oligonucleotide
gtagctcatccgcctagcacaatggccctccccgta

SEQ ID NO: 10389 - DNA, 35 bp, Artificial Sequence
  Synthetic oligonucleotide
atgcaccctagctcatcgccgtactccttctgaag

SEQ ID NO: 10390 - DNA, 35 bp, Artificial Sequence
  Synthetic oligonucleotide
tgactcctgtgagtcgttttctagcatcctcttac

SEQ ID NO: 10391 - DNA, 36 bp, Artificial Sequence
  Synthetic oligonucleotide
agcctccgcccccatccatctttgtgtgcaccgaca

SEQ ID NO: 10392 - DNA, 35 bp, Artificial Sequence
  Synthetic oligonucleotide
actgagagccaatctatgctttgttgcacaccgcc

SEQ ID NO: 10393 - DNA, 35 bp, Artificial Sequence
  Synthetic oligonucleotide
aacgcgagagaaagggggcgtgcttgggagaaggt

SEQ ID NO: 10394 - DNA, 36 bp, Artificial Sequence
  Synthetic oligonucleotide
aacccgcctcatggtccaccatcacaccatgattca

SEQ ID NO: 10395 - DNA, 35 bp, Artificial Sequence
  Synthetic oligonucleotide
gtgctcgctacgggccgcaccatccactacatgta

SEQ ID NO: 10396 - DNA, 37 bp, Artificial Sequence
  Synthetic oligonucleotide
atccccctccatgttcggaccgctgtagcaatagcga

SEQ ID NO: 10397 - DNA, 36 bp, Artificial Sequence
  Synthetic oligonucleotide
ttctcacccccaacatcgctagctgccattgttcta

SEQ ID NO: 10398 - DNA, 35 bp, Artificial Sequence
  Synthetic oligonucleotide
aatcgcgtcatccgtgctcactcttttcctttgtc

SEQ ID NO: 10399 - DNA, 34 bp, Artificial Sequence
  Synthetic oligonucleotide
acatcttccgccactctcttgactttaccaggga

SEQ ID NO: 10400 - DNA, 35 bp, Artificial Sequence
  Synthetic oligonucleotide
tcacgacaccgcattattctgcctgcctgtcctag

SEQ ID NO: 10401 - DNA, 35 bp, Artificial Sequence
  Synthetic oligonucleotide
tactggtgagtgggcttgacttgagagggtgggtg

SEQ ID NO: 10402 - DNA, 34 bp, Artificial Sequence
  Synthetic oligonucleotide
atccctaccccagatacttttatcgcgccccgtt

SEQ ID NO: 10403 - DNA, 35 bp, Artificial Sequence
  Synthetic oligonucleotide
gatctcccgtcgcatttactatgtgccgcattttt

SEQ ID NO: 10404 - DNA, 35 bp, Artificial Sequence
  Synthetic oligonucleotide
tcgcaatacacgccttatcagtctcacgcctccgc

SEQ ID NO: 10405 - DNA, 35 bp, Artificial Sequence
  Synthetic oligonucleotide
atcaccgcgtactgcgcgctccactcagacctggc

SEQ ID NO: 10406 - DNA, 36 bp, Artificial Sequence
  Synthetic oligonucleotide
tcacgccgcacaatgtggtccgtgcttttttttcga

SEQ ID NO: 10407 - DNA, 38 bp, Artificial Sequence
  Synthetic oligonucleotide
tcacgtaatgctgtcctatccaccactcccgtacgtga

SEQ ID NO: 10408 - DNA, 37 bp, Artificial Sequence
  Synthetic oligonucleotide
tgatcgacgagcaatgcctgaaagcaccacattttga

SEQ ID NO: 10409 - DNA, 35 bp, Artificial Sequence
  Synthetic oligonucleotide
tttcacccccggcagtctttactcgtcttgccctt

SEQ ID NO: 10410 - DNA, 35 bp, Artificial Sequence
  Synthetic oligonucleotide
acttctatccgtggcccgtgagtcgtcacgctacc

SEQ ID NO: 10411 - DNA, 35 bp, Artificial Sequence
  Synthetic oligonucleotide
tcgaacatcccggtacaactgtcaagaccccacgc

SEQ ID NO: 10412 - DNA, 37 bp, Artificial Sequence
  Synthetic oligonucleotide
actcccatcgccctgttataccaccttttgcttgaga

SEQ ID NO: 10413 - DNA, 35 bp, Artificial Sequence
  Synthetic oligonucleotide
tcaatgggcgggagttaatgggagggggatagcta

SEQ ID NO: 10414 - DNA, 35 bp, Artificial Sequence
  Synthetic oligonucleotide
agtcaaccccatggaatattcacgcacttgtcacc

SEQ ID NO: 10415 - DNA, 35 bp, Artificial Sequence
  Synthetic oligonucleotide
tgagcctcatagccattacatgtaccctccttcct

SEQ ID NO: 10416 - DNA, 36 bp, Artificial Sequence
  Synthetic oligonucleotide
gtacgccaagccgtttatgccgcccccatatcctga

SEQ ID NO: 10417 - DNA, 37 bp, Artificial Sequence
  Synthetic oligonucleotide
agcgagggaggagggaggaaaaggattaaggcatgga

SEQ ID NO: 10418 - DNA, 36 bp, Artificial Sequence
  Synthetic oligonucleotide
tcacactccatcttttagcctgcccatcgtgattga

SEQ ID NO: 10419 - DNA, 35 bp, Artificial Sequence
  Synthetic oligonucleotide
taccatcattccgctgtatgacccgcccttacgta

SEQ ID NO: 10420 - DNA, 35 bp, Artificial Sequence
  Synthetic oligonucleotide
tgacaccctcctcgggaaatctcttggctgtacgc

SEQ ID NO: 10421 - DNA, 35 bp, Artificial Sequence
  Synthetic oligonucleotide
tgactgccccggtggctgtaactcttcccattatc

SEQ ID NO: 10422 - DNA, 35 bp, Artificial Sequence
  Synthetic oligonucleotide
gtgtagccaccctgctcctgagtctgctgcgcccc

SEQ ID NO: 10423 - DNA, 35 bp, Artificial Sequence
  Synthetic oligonucleotide
gtcactccttgcccgtgcattaataccttcgatac

SEQ ID NO: 10424 - DNA, 36 bp, Artificial Sequence
  Synthetic oligonucleotide
gcacgggcgggaagggggaaagggtacggctcggca

SEQ ID NO: 10425 - DNA, 35 bp, Artificial Sequence
  Synthetic oligonucleotide
tctaaacggcatctcccgcgctcgccatacacgtc

SEQ ID NO: 10426 - DNA, 38 bp, Artificial Sequence
  Synthetic oligonucleotide
gaacgcgtaattgggccattcgttacaccttcccttga

SEQ ID NO: 10427 - DNA, 35 bp, Artificial Sequence
  Synthetic oligonucleotide
gcccctcgccccacgttctttatgctggcattaaa

SEQ ID NO: 10428 - DNA, 36 bp, Artificial Sequence
  Synthetic oligonucleotide
tcgcacccagcccccgccgcaggtatctaccatcca

SEQ ID NO: 10429 - DNA, 37 bp, Artificial Sequence
  Synthetic oligonucleotide
acggaggaaaaaggggtgagggtgatatggctgggga

SEQ ID NO: 10430 - DNA, 35 bp, Artificial Sequence
  Synthetic oligonucleotide
attccacccgatcgcaccatctgatctcaccatga

SEQ ID NO: 10431 - DNA, 35 bp, Artificial Sequence
  Synthetic oligonucleotide
accactactggtcgctgcaaccccgcaccccacac

SEQ ID NO: 10432 - DNA, 35 bp, Artificial Sequence
  Synthetic oligonucleotide
ttcacaccgaggcacgcatcttgctccttgttgtc

SEQ ID NO: 10433 - DNA, 36 bp, Artificial Sequence
  Synthetic oligonucleotide
acgctaccacatattcgccccacgggtctcctgaca

SEQ ID NO: 10434 - DNA, 35 bp, Artificial Sequence
  Synthetic oligonucleotide
acacttccatcctactatgcgaccacgaacgtacg

SEQ ID NO: 10435 - DNA, 35 bp, Artificial Sequence
  Synthetic oligonucleotide
tcaccccgtacacataatacgtgtgcctatacctt

SEQ ID NO: 10436 - DNA, 35 bp, Artificial Sequence
  Synthetic oligonucleotide
accgcaccatcccccatcgcataagtaacgtagtt

SEQ ID NO: 10437 - DNA, 36 bp, Artificial Sequence
  Synthetic oligonucleotide
atcgggagagggggagcagggaagggaagatgggga

SEQ ID NO: 10438 - DNA, 34 bp, Artificial Sequence
  Synthetic oligonucleotide
agcacgacggtcacattgcctactgaatacctgt

SEQ ID NO: 10439 - DNA, 37 bp, Artificial Sequence
  Synthetic oligonucleotide
gagtggtggtgagagacaatggggatggtgcgatgga

SEQ ID NO: 10440 - DNA, 37 bp, Artificial Sequence
  Synthetic oligonucleotide
gtatcgccgccccctctcgcattgtagcaaacattga

SEQ ID NO: 10441 - DNA, 35 bp, Artificial Sequence
  Synthetic oligonucleotide
aagatcacctcacactttactgggaccatccaacg

SEQ ID NO: 10442 - DNA, 35 bp, Artificial Sequence
  Synthetic oligonucleotide
gttgacgccataagcttcccctccgtattcacatc

SEQ ID NO: 10443 - DNA, 35 bp, Artificial Sequence
  Synthetic oligonucleotide
tgctccaagtgccacccgactgtttcttacccgcg

SEQ ID NO: 10444 - DNA, 35 bp, Artificial Sequence
  Synthetic oligonucleotide
gactgggcgaatgttcatggcggtttcccttatct

SEQ ID NO: 10445 - DNA, 35 bp, Artificial Sequence
  Synthetic oligonucleotide
gaccagcccctcccacgccgtgacgtatgcacaaa

SEQ ID NO: 10446 - DNA, 37 bp, Artificial Sequence
  Synthetic oligonucleotide
acccccgactactctcgctccacccgaaatggaccga

SEQ ID NO: 10447 - DNA, 38 bp, Artificial Sequence
  Synthetic oligonucleotide
gacacactcacttcgatccaacccagcctgcgcttgga

SEQ ID NO: 10448 - DNA, 36 bp, Artificial Sequence
  Synthetic oligonucleotide
gtagtcaagggaagggtgggcgcatggggcaggtca

SEQ ID NO: 10449 - DNA, 35 bp, Artificial Sequence
  Synthetic oligonucleotide
gaagccccgtacccgccccggccgactattaagtc

SEQ ID NO: 10450 - DNA, 36 bp, Artificial Sequence
  Synthetic oligonucleotide
tgtcctccgacgctcccgttttctgcgcccacccca

SEQ ID NO: 10451 - DNA, 37 bp, Artificial Sequence
  Synthetic oligonucleotide
ggtggggagacaagaggtgagggcttagggggaggga

SEQ ID NO: 10452 - DNA, 36 bp, Artificial Sequence
  Synthetic oligonucleotide
gttcagcccggacaattctgctgttaactcccttgc

SEQ ID NO: 10453 - DNA, 36 bp, Artificial Sequence
  Synthetic oligonucleotide
tcacatctcattactggcctatctctgctgttgaaa

SEQ ID NO: 10454 - DNA, 36 bp, Artificial Sequence
  Synthetic oligonucleotide
tgacctcccctccgcatgggccctattgagggtaca

SEQ ID NO: 10455 - DNA, 37 bp, Artificial Sequence
  Synthetic oligonucleotide
gacaccaccttggtggatcttttaacacttcctccga

SEQ ID NO: 10456 - DNA, 36 bp, Artificial Sequence
  Synthetic oligonucleotide
ttgagtagcacagttagcaccccgccgtttccttga

SEQ ID NO: 10457 - DNA, 36 bp, Artificial Sequence
  Synthetic oligonucleotide
acctgcctccatacgtccccgtgggatacgccctca

SEQ ID NO: 10458 - DNA, 35 bp, Artificial Sequence
  Synthetic oligonucleotide
gacttacgtagcgtttttgcccccgcgttgccgtt

SEQ ID NO: 10459 - DNA, 36 bp, Artificial Sequence
  Synthetic oligonucleotide
tgtcctcagccaaccgcccttccgccacttgataga

SEQ ID NO: 10460 - DNA, 35 bp, Artificial Sequence
  Synthetic oligonucleotide
accacctcgttgccatgccccatccttccattgga

SEQ ID NO: 10461 - DNA, 38 bp, Artificial Sequence
  Synthetic oligonucleotide
gagcacacgcgccacagcatacttcctgattccactga

SEQ ID NO: 10462 - DNA, 35 bp, Artificial Sequence
  Synthetic oligonucleotide
aacatacacactcaccccatactcgtcatcggacg

SEQ ID NO: 10463 - DNA, 36 bp, Artificial Sequence
  Synthetic oligonucleotide
aacacacctcccatggctccgatcagtagccgcgaa

SEQ ID NO: 10464 - DNA, 35 bp, Artificial Sequence
  Synthetic oligonucleotide
atacacccacaccacgactcctgtccgtactttga

SEQ ID NO: 10465 - DNA, 36 bp, Artificial Sequence
  Synthetic oligonucleotide
aacgagccccggtaggcccacgcacaacgccctgaa

SEQ ID NO: 10466 - DNA, 37 bp, Artificial Sequence
  Synthetic oligonucleotide
ggggtgaagagggagaactaaagacagttggcgcaga

SEQ ID NO: 10467 - DNA, 38 bp, Artificial Sequence
  Synthetic oligonucleotide
tcagtagccatcctgcacttcgttgaccatccaattga

SEQ ID NO: 10468 - DNA, 37 bp, Artificial Sequence
  Synthetic oligonucleotide
accatagtgggacgcggaaggagggacggggagggga

SEQ ID NO: 10469 - DNA, 35 bp, Artificial Sequence
  Synthetic oligonucleotide
ttcccgcgtgtccaccgttgatcatcctttttccg

SEQ ID NO: 10470 - DNA, 36 bp, Artificial Sequence
  Synthetic oligonucleotide
gcaccagggcctgatctgcgctttttttcgcccaca

SEQ ID NO: 10471 - DNA, 37 bp, Artificial Sequence
  Synthetic oligonucleotide
gggtacgggagggggggatgacgagggaacagttgga

SEQ ID NO: 10472 - DNA, 38 bp, Artificial Sequence
  Synthetic oligonucleotide
tctatcgcccgtcgcaccatctgttcgccttctcttga

SEQ ID NO: 10473 - DNA, 35 bp, Artificial Sequence
  Synthetic oligonucleotide
gcctgcccacagtttcgaactccactgcctcaaac

SEQ ID NO: 10474 - DNA, 37 bp, Artificial Sequence
  Synthetic oligonucleotide
ttagccgcagctggttatcccccgtatgtttccccga

SEQ ID NO: 10475 - DNA, 35 bp, Artificial Sequence
  Synthetic oligonucleotide
tacccgattcgcaccttcgacttgcacttgcaccc

SEQ ID NO: 10476 - DNA, 35 bp, Artificial Sequence
  Synthetic oligonucleotide
tcactcacgttgtaccaccatctacactagcatgt

SEQ ID NO: 10477 - DNA, 38 bp, Artificial Sequence
  Synthetic oligonucleotide
gcacgcctccattagcctgtgatccaacgtgccattga

SEQ ID NO: 10478 - DNA, 38 bp, Artificial Sequence
  Synthetic oligonucleotide
cctgcctcacgcaacacctatggcctgtttcaccttga

SEQ ID NO: 10479 - DNA, 36 bp, Artificial Sequence
  Synthetic oligonucleotide
gaaccatcctatgccccgttaccgaacggttataaa

SEQ ID NO: 10480 - DNA, 35 bp, Artificial Sequence
  Synthetic oligonucleotide
gtgcacctcgtggtcaacctcctaatatttcctgc

SEQ ID NO: 10481 - DNA, 35 bp, Artificial Sequence
  Synthetic oligonucleotide
taaccccaccgttaccagtttccggtatagcccca

SEQ ID NO: 10482 - DNA, 35 bp, Artificial Sequence
  Synthetic oligonucleotide
gttcgtcccgccccgctcaagctccattcgctgtt

SEQ ID NO: 10483 - DNA, 35 bp, Artificial Sequence
  Synthetic oligonucleotide
tcaggccacattccaccgtatcccgtctccttttc

SEQ ID NO: 10484 - DNA, 35 bp, Artificial Sequence
  Synthetic oligonucleotide
agccaatacctccgccccctattctcctgggagag

SEQ ID NO: 10485 - DNA, 37 bp, Artificial Sequence
  Synthetic oligonucleotide
aacgggatggtggggtggacttatgaggctgagttga

SEQ ID NO: 10486 - DNA, 36 bp, Artificial Sequence
  Synthetic oligonucleotide
gccactctggttgattcccggggcactaacacacta

SEQ ID NO: 10487 - DNA, 35 bp, Artificial Sequence
  Synthetic oligonucleotide
tgatcccgtgggatcctcctgatttcctgctactc

SEQ ID NO: 10488 - DNA, 35 bp, Artificial Sequence
  Synthetic oligonucleotide
ttacaccgcacgagcgcacctagcggtctcccctc

SEQ ID NO: 10489 - DNA, 37 bp, Artificial Sequence
  Synthetic oligonucleotide
tcagcgctgccagctacactctgccctctcatgtcga

SEQ ID NO: 10490 - DNA, 35 bp, Artificial Sequence
  Synthetic oligonucleotide
atcaccttgccctggtatctccgtaacactcaatc

SEQ ID NO: 10491 - DNA, 35 bp, Artificial Sequence
  Synthetic oligonucleotide
acacaccatccgacgttccactcccagtcgacata

SEQ ID NO: 10492 - DNA, 35 bp, Artificial Sequence
  Synthetic oligonucleotide
gactcatccctgttgccccgccccaatgcaatcac

SEQ ID NO: 10493 - DNA, 35 bp, Artificial Sequence
  Synthetic oligonucleotide
atcgcactgccaactgttctagcccggttcgtact

SEQ ID NO: 10494 - DNA, 35 bp, Artificial Sequence
  Synthetic oligonucleotide
tgctcaagtcggttccctggcgcttggttttctct

SEQ ID NO: 10495 - DNA, 35 bp, Artificial Sequence
  Synthetic oligonucleotide
atgcttgcgtaccattcgttcaccactgtcattac

SEQ ID NO: 10496 - DNA, 34 bp, Artificial Sequence
  Synthetic oligonucleotide
gcaaacccagcgatcccgactctttgctacaacc

SEQ ID NO: 10497 - DNA, 35 bp, Artificial Sequence
  Synthetic oligonucleotide
tttgcaacctgcctcgggatcgcatacccactttc

SEQ ID NO: 10498 - DNA, 36 bp, Artificial Sequence
  Synthetic oligonucleotide
tgacggagagaggggggacatcgtgtggttgggtga

SEQ ID NO: 10499 - DNA, 35 bp, Artificial Sequence
  Synthetic oligonucleotide
gttacctccatttaatgcctaccgccccatgttcg

SEQ ID NO: 10500 - DNA, 35 bp, Artificial Sequence
  Synthetic oligonucleotide
gcaaccggttcaacttgtccttccagcttgttcct

SEQ ID NO: 10501 - DNA, 37 bp, Artificial Sequence
  Synthetic oligonucleotide
agaacacggtagggggagaggaggcacggggctggga

SEQ ID NO: 10502 - DNA, 35 bp, Artificial Sequence
  Synthetic oligonucleotide
tagggggaggggcggtaatagcaagggagaagttc

SEQ ID NO: 10503 - DNA, 36 bp, Artificial Sequence
  Synthetic oligonucleotide
aacttgcactgcctgggattacgccgacttcgcaca

SEQ ID NO: 10504 - DNA, 35 bp, Artificial Sequence
  Synthetic oligonucleotide
tacccacatgggaacataacaatcgacttgctctt

SEQ ID NO: 10505 - DNA, 35 bp, Artificial Sequence
  Synthetic oligonucleotide
gatgaccaccggccgtctcgcccgtgcccccgaac

SEQ ID NO: 10506 - DNA, 35 bp, Artificial Sequence
  Synthetic oligonucleotide
tcttccgacccaaccgtttttattgccgtgcaacg

SEQ ID NO: 10507 - DNA, 36 bp, Artificial Sequence
  Synthetic oligonucleotide
ggtcacataaagtcgtatgaattgccacccccccca

SEQ ID NO: 10508 - DNA, 37 bp, Artificial Sequence
  Synthetic oligonucleotide
tatacctctgctgcctatagttgcctctcctctggga

SEQ ID NO: 10509 - DNA, 36 bp, Artificial Sequence
  Synthetic oligonucleotide
actacctcgtaatgcgatataccccgccaactatca

SEQ ID NO: 10510 - DNA, 38 bp, Artificial Sequence
  Synthetic oligonucleotide
gtccacccctctcgcgtgatctcattttggcattttga

SEQ ID NO: 10511 - DNA, 36 bp, Artificial Sequence
  Synthetic oligonucleotide
atgtcaaccactgccctgttttccactaacctacta

SEQ ID NO: 10512 - DNA, 35 bp, Artificial Sequence
  Synthetic oligonucleotide
atcacgcccggtatcccagtccgtatcttcttccg

SEQ ID NO: 10513 - DNA, 35 bp, Artificial Sequence
  Synthetic oligonucleotide
gggaaccacccagtttcgccttccacccctattgg

SEQ ID NO: 10514 - DNA, 37 bp, Artificial Sequence
  Synthetic oligonucleotide
acaccctgccggatgtatcaccatcctttctacccga

SEQ ID NO: 10515 - DNA, 35 bp, Artificial Sequence
  Synthetic oligonucleotide
gacatggcgcctctcgctttaacccttttgtgatc

SEQ ID NO: 10516 - DNA, 35 bp, Artificial Sequence
  Synthetic oligonucleotide
ggacgcccgcctctttttctggtgtttttccgtgg

SEQ ID NO: 10517 - DNA, 35 bp, Artificial Sequence
  Synthetic oligonucleotide
atccctgccttgacctctgaatggaacctctattg

SEQ ID NO: 10518 - DNA, 35 bp, Artificial Sequence
  Synthetic oligonucleotide
tgactcaccgccaaaactgctcattacattgactg

SEQ ID NO: 10519 - DNA, 36 bp, Artificial Sequence
  Synthetic oligonucleotide
gtgcaacccggcctccaccacccagctgtagaaaaa

SEQ ID NO: 10520 - DNA, 36 bp, Artificial Sequence
  Synthetic oligonucleotide
tcacaatcatcacctgctcctggccgaatcccctga

SEQ ID NO: 10521 - DNA, 36 bp, Artificial Sequence
  Synthetic oligonucleotide
tcacaccgcacagccccgggtctatttactccttta

SEQ ID NO: 10522 - DNA, 35 bp, Artificial Sequence
  Synthetic oligonucleotide
aaccatgggccgggatcggttggaggaagggaggg

SEQ ID NO: 10523 - DNA, 32 bp, Artificial Sequence
  Synthetic oligonucleotide
tccgaagctcccgccgttgttcccgtacgcct

SEQ ID NO: 10524 - DNA, 35 bp, Artificial Sequence
  Synthetic oligonucleotide
actcacatccatcgagtgaattcccgccctacgaa

SEQ ID NO: 10525 - DNA, 35 bp, Artificial Sequence
  Synthetic oligonucleotide
acctcactcacacaatatggcacatgaacctggaa

SEQ ID NO: 10526 - DNA, 38 bp, Artificial Sequence
  Synthetic oligonucleotide
gctgttcaccatcggtcttttgcgatcccttcctttga

SEQ ID NO: 10527 - DNA, 35 bp, Artificial Sequence
  Synthetic oligonucleotide
gccccatcctcccgcgcacccgattatgtcgtgcc

SEQ ID NO: 10528 - DNA, 37 bp, Artificial Sequence
  Synthetic oligonucleotide
gaacgccccgcccaatgatccaagcattcaaacccga

SEQ ID NO: 10529 - DNA, 37 bp, Artificial Sequence
  Synthetic oligonucleotide
gagagctcgggcataaaggatgggaaggaggaacgga

SEQ ID NO: 10530 - DNA, 37 bp, Artificial Sequence
  Synthetic oligonucleotide
gcgacctgccccgcgatggtcttcttctcccactgga

SEQ ID NO: 10531 - DNA, 35 bp, Artificial Sequence
  Synthetic oligonucleotide
actcactctgacgaaactatctgcacctttctgga

SEQ ID NO: 10532 - DNA, 38 bp, Artificial Sequence
  Synthetic oligonucleotide
gtgcggactaaatagtggggagggtgggcgccgggtga

SEQ ID NO: 10533 - DNA, 36 bp, Artificial Sequence
  Synthetic oligonucleotide
tacctgcacacgtgtctctgcccatcagcgcactta

SEQ ID NO: 10534 - DNA, 36 bp, Artificial Sequence
  Synthetic oligonucleotide
gtcaaagcagggggggatgatgggcctcggggtaca

SEQ ID NO: 10535 - DNA, 37 bp, Artificial Sequence
  Synthetic oligonucleotide
tctcaccagcgtaggttaccatctccatctcctccga

SEQ ID NO: 10536 - DNA, 36 bp, Artificial Sequence
  Synthetic oligonucleotide
ggtggggggtggggcatgccggagttggtggaaata

SEQ ID NO: 10537 - DNA, 35 bp, Artificial Sequence
  Synthetic oligonucleotide
actaccctcgtccttggagtttactctactggccc

SEQ ID NO: 10538 - DNA, 36 bp, Artificial Sequence
  Synthetic oligonucleotide
atccacacttgcctacccacttgtgatcttagacga

SEQ ID NO: 10539 - DNA, 38 bp, Artificial Sequence
  Synthetic oligonucleotide
tgcccacaactgagtctcgtactttcgcacatgcatga

SEQ ID NO: 10540 - DNA, 37 bp, Artificial Sequence
  Synthetic oligonucleotide
tgcgacgccaaacgcggctatacccattcttctacga

SEQ ID NO: 10541 - DNA, 37 bp, Artificial Sequence
  Synthetic oligonucleotide
gtccacgaccactgagccccggcctatttgctgccca

SEQ ID NO: 10542 - DNA, 35 bp, Artificial Sequence
  Synthetic oligonucleotide
tacatgatgcactattgcgggtcttagcttagcct

SEQ ID NO: 10543 - DNA, 37 bp, Artificial Sequence
  Synthetic oligonucleotide
gccacgacagctatcttatgccctatcactctcacga

SEQ ID NO: 10544 - DNA, 37 bp, Artificial Sequence
  Synthetic oligonucleotide
tcagcccacctccgatctgcacggctacagttctgga

SEQ ID NO: 10545 - DNA, 37 bp, Artificial Sequence
  Synthetic oligonucleotide
gaggatggcgggagcgggtggtggggggggcaagaga

SEQ ID NO: 10546 - DNA, 35 bp, Artificial Sequence
  Synthetic oligonucleotide
gagatgaaaagcaggggaaaaaggagatcgcgttg

SEQ ID NO: 10547 - DNA, 38 bp, Artificial Sequence
  Synthetic oligonucleotide
gatggcgggtagggttctgaggcggggtgggctggtga

SEQ ID NO: 10548 - DNA, 35 bp, Artificial Sequence
  Synthetic oligonucleotide
ttacgcgtgctcacccattattgtcgtgcttaacc

SEQ ID NO: 10549 - DNA, 35 bp, Artificial Sequence
  Synthetic oligonucleotide
ggagagccgcctgagccattaccccctgtgcacca

SEQ ID NO: 10550 - DNA, 35 bp, Artificial Sequence
  Synthetic oligonucleotide
tgcgatcaacctcagcgttactcaccccttcggtc

SEQ ID NO: 10551 - DNA, 38 bp, Artificial Sequence
  Synthetic oligonucleotide
taagagtgcgggcaggtggagggagggggttgacgtga

SEQ ID NO: 10552 - DNA, 35 bp, Artificial Sequence
  Synthetic oligonucleotide
aacgaggcggggggaatcttaagatagggcaggtc

SEQ ID NO: 10553 - DNA, 35 bp, Artificial Sequence
  Synthetic oligonucleotide
gaaccgtgcaaagggttcacgcagtaaggtggagg

SEQ ID NO: 10554 - DNA, 35 bp, Artificial Sequence
  Synthetic oligonucleotide
ttcgagccgtccatcgttcacctctcaccttgcac

SEQ ID NO: 10555 - DNA, 35 bp, Artificial Sequence
  Synthetic oligonucleotide
ttacctccacgtagacagctggtacatctttttgg

SEQ ID NO: 10556 - DNA, 35 bp, Artificial Sequence
  Synthetic oligonucleotide
gtccacatgcctcctcgcccgaccgatacaattgt

SEQ ID NO: 10557 - DNA, 36 bp, Artificial Sequence
  Synthetic oligonucleotide
ccgatgagtcgcgacagctcgtactcccgctttcca

SEQ ID NO: 10558 - DNA, 37 bp, Artificial Sequence
  Synthetic oligonucleotide
acctaacccagaactgtgcctgcccaacactttatga

SEQ ID NO: 10559 - DNA, 38 bp, Artificial Sequence
  Synthetic oligonucleotide
tgaacccgaattcctctgccactgcgcctgtcccttga

SEQ ID NO: 10560 - DNA, 35 bp, Artificial Sequence
  Synthetic oligonucleotide
acaccggtcccacaatgcactcggacaacctacta

SEQ ID NO: 10561 - DNA, 36 bp, Artificial Sequence
  Synthetic oligonucleotide
accacgcctcccacatcgtagcctggccaaaaacca

SEQ ID NO: 10562 - DNA, 35 bp, Artificial Sequence
  Synthetic oligonucleotide
gacctaccgatcaagctgaccgcgcacctccatac

SEQ ID NO: 10563 - DNA, 35 bp, Artificial Sequence
  Synthetic oligonucleotide
tccatccgccggactatgcaaatccaacgttgttt

SEQ ID NO: 10564 - DNA, 38 bp, Artificial Sequence
  Synthetic oligonucleotide
acccacctcaagcccgttggccaatgttttcatcctga

SEQ ID NO: 10565 - DNA, 38 bp, Artificial Sequence
  Synthetic oligonucleotide
atcaccacagtgcccctgagtgctcgccgttcctttga

SEQ ID NO: 10566 - DNA, 38 bp, Artificial Sequence
  Synthetic oligonucleotide
atccgactcccccactgtgtcccactgttcatacctga

SEQ ID NO: 10567 - DNA, 35 bp, Artificial Sequence
  Synthetic oligonucleotide
tacgagtccagctttaccacacctgacctacttgc

SEQ ID NO: 10568 - DNA, 35 bp, Artificial Sequence
  Synthetic oligonucleotide
gcactctacccgccagtctgcctcttcacttcgtc

SEQ ID NO: 10569 - DNA, 35 bp, Artificial Sequence
  Synthetic oligonucleotide
gcgacgcactgccacaatggccctcttgactcacg

SEQ ID NO: 10570 - DNA, 35 bp, Artificial Sequence
  Synthetic oligonucleotide
tcactgatccgccttatgcaagtttaaacccctcc

SEQ ID NO: 10571 - DNA, 35 bp, Artificial Sequence
  Synthetic oligonucleotide
gatgccattggaaagggtgggagatgggacaaggg

SEQ ID NO: 10572 - DNA, 36 bp, Artificial Sequence
  Synthetic oligonucleotide
taagcccccctccgctgcttcattgcctcttttaca

SEQ ID NO: 10573 - DNA, 35 bp, Artificial Sequence
  Synthetic oligonucleotide
agtccatccgcagcctttcgtcaatacctcgccag

SEQ ID NO: 10574 - DNA, 35 bp, Artificial Sequence
  Synthetic oligonucleotide
tgctccgtacagctctcacagcacaaactatcatt

SEQ ID NO: 10575 - DNA, 36 bp, Artificial Sequence
  Synthetic oligonucleotide
gcactgccggttctctctcgcctgttctatgcttaa

SEQ ID NO: 10576 - DNA, 35 bp, Artificial Sequence
  Synthetic oligonucleotide
tcagcgacccccctgtttgccgttacctggtctca

SEQ ID NO: 10577 - DNA, 36 bp, Artificial Sequence
  Synthetic oligonucleotide
tcacaccttcactgggccatctgccggtgccactta

SEQ ID NO: 10578 - DNA, 35 bp, Artificial Sequence
  Synthetic oligonucleotide
atgagggtcggcgcacgatcacatccactccccgt

SEQ ID NO: 10579 - DNA, 37 bp, Artificial Sequence
  Synthetic oligonucleotide
gctaaggcggatggggggggcgcggggcggggaaaga

SEQ ID NO: 10580 - DNA, 37 bp, Artificial Sequence
  Synthetic oligonucleotide
gggtgggagtgaggaaagatgggaggatgaatgtaga

SEQ ID NO: 10581 - DNA, 35 bp, Artificial Sequence
  Synthetic oligonucleotide
tcgcctaccgctcctgtccattaatcatcatagca

SEQ ID NO: 10582 - DNA, 37 bp, Artificial Sequence
  Synthetic oligonucleotide
ttgtcccgccacccaacccccgcgtcgtaaccgggga

SEQ ID NO: 10583 - DNA, 35 bp, Artificial Sequence
  Synthetic oligonucleotide
acaagacgccaccactacatgcacacccattcaca

SEQ ID NO: 10584 - DNA, 37 bp, Artificial Sequence
  Synthetic oligonucleotide
acccaccccccaactgcccgtgttgtctctcccttga

SEQ ID NO: 10585 - DNA, 36 bp, Artificial Sequence
  Synthetic oligonucleotide
gccactataggtgcgcccctcgaccatctggaaatc

SEQ ID NO: 10586 - DNA, 35 bp, Artificial Sequence
  Synthetic oligonucleotide
atcctcacaggctcccctcgcttgattgacacatc

SEQ ID NO: 10587 - DNA, 37 bp, Artificial Sequence
  Synthetic oligonucleotide
acgatcgagggggattgggagggataacggggcacga

SEQ ID NO: 10588 - DNA, 35 bp, Artificial Sequence
  Synthetic oligonucleotide
gagtgcccgacgactactgaacgtttgccatcact

SEQ ID NO: 10589 - DNA, 35 bp, Artificial Sequence
  Synthetic oligonucleotide
acccatgtccactctgaagaaccggttccctttgg

SEQ ID NO: 10590 - DNA, 38 bp, Artificial Sequence
  Synthetic oligonucleotide
cagcattaccgcactgagcactccctttccacggttga

SEQ ID NO: 10591 - DNA, 38 bp, Artificial Sequence
  Synthetic oligonucleotide
ccacaccctccgcttttttatagtctcaacattgttga

SEQ ID NO: 10592 - DNA, 35 bp, Artificial Sequence
  Synthetic oligonucleotide
tccgacaagacttaccacctgccctcccgcgcgcc

SEQ ID NO: 10593 - DNA, 35 bp, Artificial Sequence
  Synthetic oligonucleotide
tccccgcgccgcagccctagattcctttcccgtct

SEQ ID NO: 10594 - DNA, 36 bp, Artificial Sequence
  Synthetic oligonucleotide
gttcacccgccttcatgccccgtagtggttacagta

SEQ ID NO: 10595 - DNA, 38 bp, Artificial Sequence
  Synthetic oligonucleotide
tcactgtcccatccgataggccgatatatctaccatga

SEQ ID NO: 10596 - DNA, 38 bp, Artificial Sequence
  Synthetic oligonucleotide
gtatcgcacaaggggaggtggggaggcggacttgctga

SEQ ID NO: 10597 - DNA, 37 bp, Artificial Sequence
  Synthetic oligonucleotide
atcctcccgtcctgctcccctgtcacctttgacgcga

SEQ ID NO: 10598 - DNA, 35 bp, Artificial Sequence
  Synthetic oligonucleotide
aatactacctgcgcgagcccgttcctgccctccta

SEQ ID NO: 10599 - DNA, 35 bp, Artificial Sequence
  Synthetic oligonucleotide
tgtgacccgacggcaatctgcctatcatcttgctc

SEQ ID NO: 10600 - DNA, 35 bp, Artificial Sequence
  Synthetic oligonucleotide
ccacgccacccacctcgagcaccaccggtcgtgat

SEQ ID NO: 10601 - DNA, 35 bp, Artificial Sequence
  Synthetic oligonucleotide
tcagtcctcgaccacatctacatctccggatctgc

SEQ ID NO: 10602 - DNA, 36 bp, Artificial Sequence
  Synthetic oligonucleotide
gtgcatccccgagcgcaccaccaccgacctagccaa

SEQ ID NO: 10603 - DNA, 35 bp, Artificial Sequence
  Synthetic oligonucleotide
accccccccacacgtgttgccccacggccaggaac

SEQ ID NO: 10604 - DNA, 36 bp, Artificial Sequence
  Synthetic oligonucleotide
tgcacacgccccctgtcgccatccattcactgtgaa

SEQ ID NO: 10605 - DNA, 36 bp, Artificial Sequence
  Synthetic oligonucleotide
acctgagccgcacccttctgtcctggagttctcgta

SEQ ID NO: 10606 - DNA, 35 bp, Artificial Sequence
  Synthetic oligonucleotide
gatcattgtcctgctgccgaccccatctctcatac

SEQ ID NO: 10607 - DNA, 35 bp, Artificial Sequence
  Synthetic oligonucleotide
gttgcgcgcactttaccatcctggccatctctgtg

SEQ ID NO: 10608 - DNA, 35 bp, Artificial Sequence
  Synthetic oligonucleotide
agagtgccaccatgcgacaggaaccatctctccgt

SEQ ID NO: 10609 - DNA, 35 bp, Artificial Sequence
  Synthetic oligonucleotide
acctgctacggcccttccctcgctacctgtactat

SEQ ID NO: 10610 - DNA, 35 bp, Artificial Sequence
  Synthetic oligonucleotide
tgaccctcgcacaataccataaagcaccatcaatt

SEQ ID NO: 10611 - DNA, 37 bp, Artificial Sequence
  Synthetic oligonucleotide
acgcactcacctcagagtgctttacatagtcccccga

SEQ ID NO: 10612 - DNA, 35 bp, Artificial Sequence
  Synthetic oligonucleotide
tgttcccccggacgtttcccctactcctttgggcc

SEQ ID NO: 10613 - DNA, 35 bp, Artificial Sequence
  Synthetic oligonucleotide
gagcgcccgcccagaattccttctgcacgctttcc

SEQ ID NO: 10614 - DNA, 35 bp, Artificial Sequence
  Synthetic oligonucleotide
tgcaccacttttcgttgtcataactatctccctgc

SEQ ID NO: 10615 - DNA, 36 bp, Artificial Sequence
  Synthetic oligonucleotide
gctgtgccgactttagccatgatgccacttcccaca

SEQ ID NO: 10616 - DNA, 37 bp, Artificial Sequence
  Synthetic oligonucleotide
tatgggcgcaacgcgaccgttatccttcactactcga

SEQ ID NO: 10617 - DNA, 37 bp, Artificial Sequence
  Synthetic oligonucleotide
acgaacccatactctgtagaccctccctttgactgga

SEQ ID NO: 10618 - DNA, 36 bp, Artificial Sequence
  Synthetic oligonucleotide
cacgtccctcccatgctgtccgttcgtactttctta

SEQ ID NO: 10619 - DNA, 35 bp, Artificial Sequence
  Synthetic oligonucleotide
atctagcgcatctgcagctcttgcctctattcctt

SEQ ID NO: 10620 - DNA, 35 bp, Artificial Sequence
  Synthetic oligonucleotide
atcgccccacgttgtcgtcacaggtcttctcctag

SEQ ID NO: 10621 - DNA, 36 bp, Artificial Sequence
  Synthetic oligonucleotide
acgttcacaaccggttttgtctgccattcatcttta

SEQ ID NO: 10622 - DNA, 36 bp, Artificial Sequence
  Synthetic oligonucleotide
accactcctgctccaccgctggacactcatttgaca

SEQ ID NO: 10623 - DNA, 35 bp, Artificial Sequence
  Synthetic oligonucleotide
taacgacccccggcgccatcacaccgcaccttggt

SEQ ID NO: 10624 - DNA, 35 bp, Artificial Sequence
  Synthetic oligonucleotide
tcacgcctcctcgactgcgttataacgtcttccaa

SEQ ID NO: 10625 - DNA, 35 bp, Artificial Sequence
  Synthetic oligonucleotide
accactaccgctacaaccaggcttctgcttcctcg

SEQ ID NO: 10626 - DNA, 32 bp, Artificial Sequence
  Synthetic oligonucleotide
agatcacttcccgaatcgcgcatcctagtacc

SEQ ID NO: 10627 - DNA, 35 bp, Artificial Sequence
  Synthetic oligonucleotide
acccgcccaccgactcaccctgatagatacatagc

SEQ ID NO: 10628 - DNA, 36 bp, Artificial Sequence
  Synthetic oligonucleotide
gatccctcctccgccttgcaacgggacaggtaacaa

SEQ ID NO: 10629 - DNA, 36 bp, Artificial Sequence
  Synthetic oligonucleotide
ggttacccagccggccaaacgaaccccccgcctgca

SEQ ID NO: 10630 - DNA, 37 bp, Artificial Sequence
  Synthetic oligonucleotide
gaaatggtggagggatgggggggcatacacagagaga

SEQ ID NO: 10631 - DNA, 36 bp, Artificial Sequence
  Synthetic oligonucleotide
gaagggtagggaacacagcggaaagaacatggctga

SEQ ID NO: 10632 - DNA, 36 bp, Artificial Sequence
  Synthetic oligonucleotide
gcactactagttctgtccacccatcgttccgtttta

SEQ ID NO: 10633 - DNA, 35 bp, Artificial Sequence
  Synthetic oligonucleotide
acaatcaaccccgcaccttagccgtaactgcgcgc

SEQ ID NO: 10634 - DNA, 38 bp, Artificial Sequence
  Synthetic oligonucleotide
tacacgtcgcgtcttacttatgtcctctccgctgctga

SEQ ID NO: 10635 - DNA, 38 bp, Artificial Sequence
  Synthetic oligonucleotide
cctgccgcactcaacacctatggcctgtttcaccttga

SEQ ID NO: 10636 - DNA, 37 bp, Artificial Sequence
  Synthetic oligonucleotide
atcgaccgtcccagttctaactcaagctcccttcaga

SEQ ID NO: 10637 - DNA, 37 bp, Artificial Sequence
  Synthetic oligonucleotide
gactcgccgtcagcctctcttaccaccacaattccga

SEQ ID NO: 10638 - DNA, 35 bp, Artificial Sequence
  Synthetic oligonucleotide
tcatacactcgctactccctgtagtatcaccgttc

SEQ ID NO: 10639 - DNA, 35 bp, Artificial Sequence
  Synthetic oligonucleotide
gaccgtgagccggaccgtggtagggggtgggttgg

SEQ ID NO: 10640 - DNA, 35 bp, Artificial Sequence
  Synthetic oligonucleotide
gacgacaacagcatatctcgttcctgctttatcca

SEQ ID NO: 10641 - DNA, 35 bp, Artificial Sequence
  Synthetic oligonucleotide
tcctctaccgtcgcatgatctaccttgctccgccc

SEQ ID NO: 10642 - DNA, 35 bp, Artificial Sequence
  Synthetic oligonucleotide
acacactcatccattgggtacgatagccaacgctc

SEQ ID NO: 10643 - DNA, 38 bp, Artificial Sequence
  Synthetic oligonucleotide
ggacgcttgcccgagccgccctctgatccgcactttga

SEQ ID NO: 10644 - DNA, 35 bp, Artificial Sequence
  Synthetic oligonucleotide
acccacccacttggttgtttctattcgaaccgcac

SEQ ID NO: 10645 - DNA, 36 bp, Artificial Sequence
  Synthetic oligonucleotide
acccgtactatcctggccctacaggcactgcccatg

SEQ ID NO: 10646 - DNA, 35 bp, Artificial Sequence
  Synthetic oligonucleotide
aaatagttgggagggggacaaggcaaaggaatggg

SEQ ID NO: 10647 - DNA, 36 bp, Artificial Sequence
  Synthetic oligonucleotide
aatgggaggagggaggctaggtactaaggtggaata

SEQ ID NO: 10648 - DNA, 36 bp, Artificial Sequence
  Synthetic oligonucleotide
ttccacacactgaatcttgagcgactctcgctacga

SEQ ID NO: 10649 - DNA, 38 bp, Artificial Sequence
  Synthetic oligonucleotide
tgcaagcccgaccgtaatccttccgaccacaattgtga

SEQ ID NO: 10650 - DNA, 35 bp, Artificial Sequence
  Synthetic oligonucleotide
tacacccgcatgtaccctttcgcaggagccttttt

SEQ ID NO: 10651 - DNA, 36 bp, Artificial Sequence
  Synthetic oligonucleotide
tagtaaccggtgccccgcccccctctgtgctctata

SEQ ID NO: 10652 - DNA, 37 bp, Artificial Sequence
  Synthetic oligonucleotide
tctgcctccttccccggtctgtttatcgtcaccttga

SEQ ID NO: 10653 - DNA, 35 bp, Artificial Sequence
  Synthetic oligonucleotide
acctcccgctcgatcagatctccattcctacaccg

SEQ ID NO: 10654 - DNA, 35 bp, Artificial Sequence
  Synthetic oligonucleotide
taccccacccgtactgtccatgcacgtgcaataat

SEQ ID NO: 10655 - DNA, 36 bp, Artificial Sequence
  Synthetic oligonucleotide
ttcacagcctacctctggttcccgtttatcgcccga

SEQ ID NO: 10656 - DNA, 35 bp, Artificial Sequence
  Synthetic oligonucleotide
tatcacccaggtgccgcccctatcttgttgcaatg

SEQ ID NO: 10657 - DNA, 37 bp, Artificial Sequence
  Synthetic oligonucleotide
gacacaccaccatgtgcccttcaccacgcctagtcga

SEQ ID NO: 10658 - DNA, 36 bp, Artificial Sequence
  Synthetic oligonucleotide
gagcacccccctatacatactgaccatgctcgacca

SEQ ID NO: 10659 - DNA, 35 bp, Artificial Sequence
  Synthetic oligonucleotide
tcccgcctcatatcttggcctcgtacgcctcgtgc

SEQ ID NO: 10660 - DNA, 36 bp, Artificial Sequence
  Synthetic oligonucleotide
gcactaatctcagtctgcctattgcaccctctcgta

SEQ ID NO: 10661 - DNA, 36 bp, Artificial Sequence
  Synthetic oligonucleotide
atgcacccccacctgtacgtgttatcaccgcaacaa

SEQ ID NO: 10662 - DNA, 38 bp, Artificial Sequence
  Synthetic oligonucleotide
gactcccaatcagcctggcccacctacccagatcctga

SEQ ID NO: 10663 - DNA, 38 bp, Artificial Sequence
  Synthetic oligonucleotide
gccccatcctgcagttaccaattgtcaccacggagtga

SEQ ID NO: 10664 - DNA, 35 bp, Artificial Sequence
  Synthetic oligonucleotide
gttgacacgtccagctgcacgcatcctttttccca

SEQ ID NO: 10665 - DNA, 38 bp, Artificial Sequence
  Synthetic oligonucleotide
tcctcacacccagtttatcgacagatcgcgagatctga

SEQ ID NO: 10666 - DNA, 38 bp, Artificial Sequence
  Synthetic oligonucleotide
ttgggtcggggctgggtggggaactaaaggcgaagtga

SEQ ID NO: 10667 - DNA, 38 bp, Artificial Sequence
  Synthetic oligonucleotide
gccagggcgctatgcccagccatactgtattgccttga

SEQ ID NO: 10668 - DNA, 35 bp, Artificial Sequence
  Synthetic oligonucleotide
tctgcatcccctccgcacgttacccacggacaaca

SEQ ID NO: 10669 - DNA, 36 bp, Artificial Sequence
  Synthetic oligonucleotide
gagcacagaccggcgctatcgtaccccttgccaaca

SEQ ID NO: 10670 - DNA, 35 bp, Artificial Sequence
  Synthetic oligonucleotide
ttaggccgacgcattctgccgatccgccgcttcct

SEQ ID NO: 10671 - DNA, 36 bp, Artificial Sequence
  Synthetic oligonucleotide
aaccgcccgacagtcggctacctttcttccgtacaa

SEQ ID NO: 10672 - DNA, 36 bp, Artificial Sequence
  Synthetic oligonucleotide
tgcactctatgattccaggctgacctgctccactca

SEQ ID NO: 10673 - DNA, 38 bp, Artificial Sequence
  Synthetic oligonucleotide
aaagggagtggagcatattagcagaagcaggggggtga

SEQ ID NO: 10674 - DNA, 35 bp, Artificial Sequence
  Synthetic oligonucleotide
acttgtcatcccccctagcttggtcgctcctgccc

SEQ ID NO: 10675 - DNA, 35 bp, Artificial Sequence
  Synthetic oligonucleotide
acccccccgcatgcacgcgtccccgattgccctgc

SEQ ID NO: 10676 - DNA, 35 bp, Artificial Sequence
  Synthetic oligonucleotide
tcccggccaaccgccaacccgcgtgccacaccccg

SEQ ID NO: 10677 - DNA, 35 bp, Artificial Sequence
  Synthetic oligonucleotide
gccaggagccctaactggacatgttcctgcatttt

SEQ ID NO: 10678 - DNA, 35 bp, Artificial Sequence
  Synthetic oligonucleotide
gcacactacggctttgtacgttgatctcaccttta

SEQ ID NO: 10679 - DNA, 36 bp, Artificial Sequence
  Synthetic oligonucleotide
atcccgcgccctttgtctacacgcgtcttatcccca

SEQ ID NO: 10680 - DNA, 34 bp, Artificial Sequence
  Synthetic oligonucleotide
ggatcgattgaccccgtacgccccacctggttcc

SEQ ID NO: 10681 - DNA, 34 bp, Artificial Sequence
  Synthetic oligonucleotide
ggtcacctagctggaacccctcgtctcacctctc

SEQ ID NO: 10682 - DNA, 36 bp, Artificial Sequence
  Synthetic oligonucleotide
tcagatgcactcatgtcttatctttacattcgcgaa

SEQ ID NO: 10683 - DNA, 35 bp, Artificial Sequence
  Synthetic oligonucleotide
acccgcacaactatttgggcatactggtcttcata

SEQ ID NO: 10684 - DNA, 34 bp, Artificial Sequence
  Synthetic oligonucleotide
gtagcccacacccttctgcgctaacgcgatcctg

SEQ ID NO: 10685 - DNA, 35 bp, Artificial Sequence
  Synthetic oligonucleotide
tccccatgactgaattggacacccctactctggct

SEQ ID NO: 10686 - DNA, 36 bp, Artificial Sequence
  Synthetic oligonucleotide
gttgtcgtgtcctgcctatgtccctcgtgctcttta

SEQ ID NO: 10687 - DNA, 36 bp, Artificial Sequence
  Synthetic oligonucleotide
gcgcaaccactcatggtaaactacgttattctgcca

SEQ ID NO: 10688 - DNA, 38 bp, Artificial Sequence
  Synthetic oligonucleotide
accgacaccccacaacaggtttatacgtaccgccatga

SEQ ID NO: 10689 - DNA, 38 bp, Artificial Sequence
  Synthetic oligonucleotide
tgattgccgccgtccctccgctctgtttcaaaccctga

SEQ ID NO: 10690 - DNA, 38 bp, Artificial Sequence
  Synthetic oligonucleotide
agaatgcgggcgggaaggggcttgtagggtagcattga

SEQ ID NO: 10691 - DNA, 35 bp, Artificial Sequence
  Synthetic oligonucleotide
taatggcccactgccccctcggtctcgagtgctcc

SEQ ID NO: 10692 - DNA, 35 bp, Artificial Sequence
  Synthetic oligonucleotide
actcgccactaggtctacacgacggcccccccatc

SEQ ID NO: 10693 - DNA, 38 bp, Artificial Sequence
  Synthetic oligonucleotide
gacaccctcccgccgcttctccagcacgactgtgctga

SEQ ID NO: 10694 - DNA, 35 bp, Artificial Sequence
  Synthetic oligonucleotide
agtatcccaggtacactgtgcgccttccttcctag

SEQ ID NO: 10695 - DNA, 35 bp, Artificial Sequence
  Synthetic oligonucleotide
tagcacccacctgttggttctgttctcaaggtcca

SEQ ID NO: 10696 - DNA, 37 bp, Artificial Sequence
  Synthetic oligonucleotide
gcctgactcgctcaccattatttacaactcgtaccga

SEQ ID NO: 10697 - DNA, 35 bp, Artificial Sequence
  Synthetic oligonucleotide
gcgatcggcctcaattcaccctcgtgacatccctt

SEQ ID NO: 10698 - DNA, 36 bp, Artificial Sequence
  Synthetic oligonucleotide
tgcccaggctctgacccctgcatattcgtgatttga

SEQ ID NO: 10699 - DNA, 36 bp, Artificial Sequence
  Synthetic oligonucleotide
gtcaacccgcaggacacatactggacctactcttca

SEQ ID NO: 10700 - DNA, 38 bp, Artificial Sequence
  Synthetic oligonucleotide
gcacatcgctgaactccatccgtgcaattctttggtga

SEQ ID NO: 10701 - DNA, 35 bp, Artificial Sequence
  Synthetic oligonucleotide
ttgcgccccgggccaatcacaatcgcttcctgaac

SEQ ID NO: 10702 - DNA, 36 bp, Artificial Sequence
  Synthetic oligonucleotide
gttcccaccgtgtgcccatctatgtcacgtacccga

SEQ ID NO: 10703 - DNA, 37 bp, Artificial Sequence
  Synthetic oligonucleotide
agctccaccccgtctctcttgtctcaccaggcttgga

SEQ ID NO: 10704 - DNA, 36 bp, Artificial Sequence
  Synthetic oligonucleotide
aatcgccccagtgcgataccacctcgaaacatctta

SEQ ID NO: 10705 - DNA, 35 bp, Artificial Sequence
  Synthetic oligonucleotide
gtacgcccatgagctggcctctttcatcactgtac

SEQ ID NO: 10706 - DNA, 35 bp, Artificial Sequence
  Synthetic oligonucleotide
agactccccaccatgcctaccgacatactagagca

SEQ ID NO: 10707 - DNA, 35 bp, Artificial Sequence
  Synthetic oligonucleotide
gctccacctccgcagcggtgcgttcctagccctcc

SEQ ID NO: 10708 - DNA, 35 bp, Artificial Sequence
  Synthetic oligonucleotide
atatcgctcgcccatttgtacgttctgcactatgc

SEQ ID NO: 10709 - DNA, 35 bp, Artificial Sequence
  Synthetic oligonucleotide
gctcactgccaatgcgtcttttccactgacgcact

SEQ ID NO: 10710 - DNA, 37 bp, Artificial Sequence
  Synthetic oligonucleotide
gcacgactccctctgcctgtccgccctcgcatcccga

SEQ ID NO: 10711 - DNA, 35 bp, Artificial Sequence
  Synthetic oligonucleotide
atcgacctacagcctttgccaccaaccttttctga

SEQ ID NO: 10712 - DNA, 37 bp, Artificial Sequence
  Synthetic oligonucleotide
gacgtgggacgatttgccgggggtgggctggagggga

SEQ ID NO: 10713 - DNA, 35 bp, Artificial Sequence
  Synthetic oligonucleotide
tgctccccgccccctcgtttgcaattcgcagttta

SEQ ID NO: 10714 - DNA, 35 bp, Artificial Sequence
  Synthetic oligonucleotide
ttgcactcatcatctgttggttctccctttcaccg

SEQ ID NO: 10715 - DNA, 36 bp, Artificial Sequence
  Synthetic oligonucleotide
tgacggacattgctacggatcactacgcaccccgaa

SEQ ID NO: 10716 - DNA, 35 bp, Artificial Sequence
  Synthetic oligonucleotide
acgcacccttccttcccgagctgtttgacctgcga

SEQ ID NO: 10717 - DNA, 38 bp, Artificial Sequence
  Synthetic oligonucleotide
tagacacgcacccggccatctaacacatctttttctga

SEQ ID NO: 10718 - DNA, 35 bp, Artificial Sequence
  Synthetic oligonucleotide
gcaagcgcattccccatagtgctttgatgcccttt

SEQ ID NO: 10719 - DNA, 37 bp, Artificial Sequence
  Synthetic oligonucleotide
tggacacacatgccgttacatgcaacacccacttcga

SEQ ID NO: 10720 - DNA, 38 bp, Artificial Sequence
  Synthetic oligonucleotide
cgcgaggcttagcccggtatccaacgcccactccttga

SEQ ID NO: 10721 - DNA, 35 bp, Artificial Sequence
  Synthetic oligonucleotide
atgtgtttgcaccgatcccgctctctgtccgcccc

SEQ ID NO: 10722 - DNA, 35 bp, Artificial Sequence
  Synthetic oligonucleotide
atctgccctacctgaaatgttgctccgttaccctc

SEQ ID NO: 10723 - DNA, 35 bp, Artificial Sequence
  Synthetic oligonucleotide
tacacccgtacttgccagtaatttcacctgttttt

SEQ ID NO: 10724 - DNA, 35 bp, Artificial Sequence
  Synthetic oligonucleotide
gacgtacgcgctccgcatctgctaaccgttcctca

SEQ ID NO: 10725 - DNA, 35 bp, Artificial Sequence
  Synthetic oligonucleotide
attccaccccggccacaatgtcgcatactctggcc

SEQ ID NO: 10726 - DNA, 35 bp, Artificial Sequence
  Synthetic oligonucleotide
gtccgccttcacgctggtcctctcgaagccaacct

SEQ ID NO: 10727 - DNA, 35 bp, Artificial Sequence
  Synthetic oligonucleotide
acacctcaccgccacagtcgatgtccttatcgacc

SEQ ID NO: 10728 - DNA, 36 bp, Artificial Sequence
  Synthetic oligonucleotide
tcagatgcactatgcacgctggctcatatggcccca

SEQ ID NO: 10729 - DNA, 35 bp, Artificial Sequence
  Synthetic oligonucleotide
acatgccatcagatcatgaccatcgccccctcaca

SEQ ID NO: 10730 - DNA, 36 bp, Artificial Sequence
  Synthetic oligonucleotide
acaccattccacactcatcccgcgctgctgagccca

SEQ ID NO: 10731 - DNA, 35 bp, Artificial Sequence
  Synthetic oligonucleotide
tgcgccctcgccgcacgaataattaaccacaacgc

SEQ ID NO: 10732 - DNA, 36 bp, Artificial Sequence
  Synthetic oligonucleotide
gagtgcatacatcactgttactacgttcccttgcca

SEQ ID NO: 10733 - DNA, 36 bp, Artificial Sequence
  Synthetic oligonucleotide
atcatggccaacacagcgcaccttccaccgtagtca

SEQ ID NO: 10734 - DNA, 36 bp, Artificial Sequence
  Synthetic oligonucleotide
ttccgcccatcctttctgtcatatcttcagccttta

SEQ ID NO: 10735 - DNA, 35 bp, Artificial Sequence
  Synthetic oligonucleotide
acaacgcatttgctccgcgcgactcgcccactcct

SEQ ID NO: 10736 - DNA, 36 bp, Artificial Sequence
  Synthetic oligonucleotide
acaccgccagttgctaacttcttcctgccccgacca

SEQ ID NO: 10737 - DNA, 33 bp, Artificial Sequence
  Synthetic oligonucleotide
gcaacaacggttcctcgccccctcgctagatat

SEQ ID NO: 10738 - DNA, 36 bp, Artificial Sequence
  Synthetic oligonucleotide
ggtgagaggaactgagtaaaatgcaaggggtaaaga

SEQ ID NO: 10739 - DNA, 35 bp, Artificial Sequence
  Synthetic oligonucleotide
actcgtgcccatcttggttattaaatccaccttgc

SEQ ID NO: 10740 - DNA, 35 bp, Artificial Sequence
  Synthetic oligonucleotide
acaccggcaattcgcccacttccgcctctggttcg

SEQ ID NO: 10741 - DNA, 35 bp, Artificial Sequence
  Synthetic oligonucleotide
acaaccatgtccgtcaccttcactatggtcttctc

SEQ ID NO: 10742 - DNA, 37 bp, Artificial Sequence
  Synthetic oligonucleotide
atggctcacaacgggcgggtggggtacagtctgggga

SEQ ID NO: 10743 - DNA, 36 bp, Artificial Sequence
  Synthetic oligonucleotide
acccatcctgcccctgctacgagtacagctatctta

SEQ ID NO: 10744 - DNA, 35 bp, Artificial Sequence
  Synthetic oligonucleotide
tgtgacgctagagtgcgcctgcgatcttccccacc

SEQ ID NO: 10745 - DNA, 35 bp, Artificial Sequence
  Synthetic oligonucleotide
ttcgacgccgcgtgattccgcccttcgcttcgcct

SEQ ID NO: 10746 - DNA, 37 bp, Artificial Sequence
  Synthetic oligonucleotide
gacaaccctttctcatcggtatgttaccactctttga

SEQ ID NO: 10747 - DNA, 36 bp, Artificial Sequence
  Synthetic oligonucleotide
taggacacctacgcccacaccgtatctcacaaggga

SEQ ID NO: 10748 - DNA, 37 bp, Artificial Sequence
  Synthetic oligonucleotide
gacccaacgcccaattgatctcacatggcaactttga

SEQ ID NO: 10749 - DNA, 35 bp, Artificial Sequence
  Synthetic oligonucleotide
agtagggggaggggaacgatagctaccggcgaggg

SEQ ID NO: 10750 - DNA, 35 bp, Artificial Sequence
  Synthetic oligonucleotide
gcccctcccactcgttgagccccacctgaagtccc

SEQ ID NO: 10751 - DNA, 35 bp, Artificial Sequence
  Synthetic oligonucleotide
ttgaggtcgcctcggttatctaacgcccagttctc

SEQ ID NO: 10752 - DNA, 35 bp, Artificial Sequence
  Synthetic oligonucleotide
tacctccacacgatttgaactttttgccgtatccg

SEQ ID NO: 10753 - DNA, 35 bp, Artificial Sequence
  Synthetic oligonucleotide
accccgtccaccttgatgccgtcaccggtacctcg

SEQ ID NO: 10754 - DNA, 35 bp, Artificial Sequence
  Synthetic oligonucleotide
gcgccctcaacttgtcgttctgcacgtcttcctcc

SEQ ID NO: 10755 - DNA, 35 bp, Artificial Sequence
  Synthetic oligonucleotide
accgtacgccccgctgccagcctcccaactttcat

SEQ ID NO: 10756 - DNA, 35 bp, Artificial Sequence
  Synthetic oligonucleotide
gtagaaagggtgggtaggattaacgggatgggggt

SEQ ID NO: 10757 - DNA, 35 bp, Artificial Sequence
  Synthetic oligonucleotide
atagtgcgcctctccgtttgcctctctggtttcat

SEQ ID NO: 10758 - DNA, 37 bp, Artificial Sequence
  Synthetic oligonucleotide
accgggggggtgcgagtactgaaggggcggatgtcga

SEQ ID NO: 10759 - DNA, 35 bp, Artificial Sequence
  Synthetic oligonucleotide
agttgcccgcttcggccagtttttgcccagcccac

SEQ ID NO: 10760 - DNA, 35 bp, Artificial Sequence
  Synthetic oligonucleotide
tgcctttccgcacacatctgtcacacagactcctg

SEQ ID NO: 10761 - DNA, 35 bp, Artificial Sequence
  Synthetic oligonucleotide
ttggaccgccggcgagtcaacatcaagctctcatt

SEQ ID NO: 10762 - DNA, 37 bp, Artificial Sequence
  Synthetic oligonucleotide
acaatgcgggctacacgggggaacgggaaacgggaga

SEQ ID NO: 10763 - DNA, 35 bp, Artificial Sequence
  Synthetic oligonucleotide
ttgccggagaattgccgcctgttcccaccctacac

SEQ ID NO: 10764 - DNA, 37 bp, Artificial Sequence
  Synthetic oligonucleotide
tccagacacgcatgcagttctcgcactcaatcatcga

SEQ ID NO: 10765 - DNA, 35 bp, Artificial Sequence
  Synthetic oligonucleotide
gtttgacgccactcgcataactgtagattccatcc

SEQ ID NO: 10766 - DNA, 36 bp, Artificial Sequence
  Synthetic oligonucleotide
tccatctgccatccacgctatcttaaggtccagtga

SEQ ID NO: 10767 - DNA, 35 bp, Artificial Sequence
  Synthetic oligonucleotide
agtgcgcccgggcctaggtctgtcctcttccttat

SEQ ID NO: 10768 - DNA, 38 bp, Artificial Sequence
  Synthetic oligonucleotide
accccaccactgcccacgttcatttaccctcgtattga

SEQ ID NO: 10769 - DNA, 35 bp, Artificial Sequence
  Synthetic oligonucleotide
gatcatggcattccctggcctattactgaactacc

SEQ ID NO: 10770 - DNA, 35 bp, Artificial Sequence
  Synthetic oligonucleotide
agccaccgcagttactgggttcacctatttcctcc

SEQ ID NO: 10771 - DNA, 38 bp, Artificial Sequence
  Synthetic oligonucleotide
agaccgtaggtcggctccctcttccgtctcctccgtga

SEQ ID NO: 10772 - DNA, 38 bp, Artificial Sequence
  Synthetic oligonucleotide
tcgatccccccgactcactgttttgcgtgccacgttga

SEQ ID NO: 10773 - DNA, 35 bp, Artificial Sequence
  Synthetic oligonucleotide
tgctcacaatcaaagtgctccctgatcctgttctc

SEQ ID NO: 10774 - DNA, 35 bp, Artificial Sequence
  Synthetic oligonucleotide
acgacaatcggcacaccgagttccacctggccatt

SEQ ID NO: 10775 - DNA, 36 bp, Artificial Sequence
  Synthetic oligonucleotide
gccatgtcaagtctctaaaatgtactccaccacgca

SEQ ID NO: 10776 - DNA, 35 bp, Artificial Sequence
  Synthetic oligonucleotide
tggtcggacgcccgcacgtttaactcccctgcata

SEQ ID NO: 10777 - DNA, 35 bp, Artificial Sequence
  Synthetic oligonucleotide
gccccccttcgagcccgtctccccctcaggtgtcc

SEQ ID NO: 10778 - DNA, 36 bp, Artificial Sequence
  Synthetic oligonucleotide
ttgatcggcgcaccttttctacccgcccgctttgca

SEQ ID NO: 10779 - DNA, 35 bp, Artificial Sequence
  Synthetic oligonucleotide
agcacctacttggacgtaccatccgccgccattcc

SEQ ID NO: 10780 - DNA, 35 bp, Artificial Sequence
  Synthetic oligonucleotide
tgcttactgccatcaaccacaacccccatgttttg

SEQ ID NO: 10781 - DNA, 35 bp, Artificial Sequence
  Synthetic oligonucleotide
gccgctgccccagcgcgggctttccgacctcacac

SEQ ID NO: 10782 - DNA, 37 bp, Artificial Sequence
  Synthetic oligonucleotide
tagtacacacttgaccttactgcctgacactccgcga

SEQ ID NO: 10783 - DNA, 35 bp, Artificial Sequence
  Synthetic oligonucleotide
ttgggagcctcggtcatccagtcgattcttaccac

SEQ ID NO: 10784 - DNA, 35 bp, Artificial Sequence
  Synthetic oligonucleotide
gtatagtgtgggaggggcgggaaagtagcggggag

SEQ ID NO: 10785 - DNA, 35 bp, Artificial Sequence
  Synthetic oligonucleotide
gctcacatccctgccctggtgtcccttccgcttcg

SEQ ID NO: 10786 - DNA, 37 bp, Artificial Sequence
  Synthetic oligonucleotide
tatgcatgccctcccgccgctccctcccatggcgtga

SEQ ID NO: 10787 - DNA, 35 bp, Artificial Sequence
  Synthetic oligonucleotide
gctcacctcatcgtggtttgttcccattttgtttg

SEQ ID NO: 10788 - DNA, 35 bp, Artificial Sequence
  Synthetic oligonucleotide
acacttggcgtaccagctcgccttttctacacctg

SEQ ID NO: 10789 - DNA, 35 bp, Artificial Sequence
  Synthetic oligonucleotide
gcgcaccacttcgctgaaaagctctcgttcccctg

SEQ ID NO: 10790 - DNA, 38 bp, Artificial Sequence
  Synthetic oligonucleotide
acacccctcatatgcgtagcattcgaccccgaaattga

SEQ ID NO: 10791 - DNA, 35 bp, Artificial Sequence
  Synthetic oligonucleotide
taggtgccaacccggttcaccctcctgctttgttc

SEQ ID NO: 10792 - DNA, 37 bp, Artificial Sequence
  Synthetic oligonucleotide
gccaaccagcttaaggagggcgggagggaggactcga

SEQ ID NO: 10793 - DNA, 35 bp, Artificial Sequence
  Synthetic oligonucleotide
tcccatccaatcctcactgtgccttaataccgtaa

SEQ ID NO: 10794 - DNA, 35 bp, Artificial Sequence
  Synthetic oligonucleotide
atcacccgcacggagacgcatacccatggtccacc

SEQ ID NO: 10795 - DNA, 35 bp, Artificial Sequence
  Synthetic oligonucleotide
gcctaaaccctccgaacggtcatctagagcccctg

SEQ ID NO: 10796 - DNA, 36 bp, Artificial Sequence
  Synthetic oligonucleotide
gtcccagccgccggttctctccctgtctcctttgga

SEQ ID NO: 10797 - DNA, 36 bp, Artificial Sequence
  Synthetic oligonucleotide
tccacgcatgccgcccgaagcagtttttgcccttga

SEQ ID NO: 10798 - DNA, 35 bp, Artificial Sequence
  Synthetic oligonucleotide
gactgctgcggctgtcctttacctctcatgtactc

SEQ ID NO: 10799 - DNA, 35 bp, Artificial Sequence
  Synthetic oligonucleotide
actcagcattctatcggttccttcacatcacgctg

SEQ ID NO: 10800 - DNA, 35 bp, Artificial Sequence
  Synthetic oligonucleotide
acagatgtcgttcgtactttccacgcacttcttaa

SEQ ID NO: 10801 - DNA, 37 bp, Artificial Sequence
  Synthetic oligonucleotide
gccttgccgccaaacatatacatcccgctgactgtga

SEQ ID NO: 10802 - DNA, 35 bp, Artificial Sequence
  Synthetic oligonucleotide
gtgcccctcgttcagccgtgtcgccttgccctgtc

SEQ ID NO: 10803 - DNA, 37 bp, Artificial Sequence
  Synthetic oligonucleotide
tcctacgccgcccatgatcactccccttgctggagga

SEQ ID NO: 10804 - DNA, 36 bp, Artificial Sequence
  Synthetic oligonucleotide
gaaccgagttcccatgcccatcaataccctcgcgta

SEQ ID NO: 10805 - DNA, 35 bp, Artificial Sequence
  Synthetic oligonucleotide
acaggacgcttcggcccgccctatgctacccgccc

SEQ ID NO: 10806 - DNA, 35 bp, Artificial Sequence
  Synthetic oligonucleotide
gcgacggcaaccctgattacgctccccccgacgtc

SEQ ID NO: 10807 - DNA, 35 bp, Artificial Sequence
  Synthetic oligonucleotide
gttgccctgctccccttatccttaacaggactgcc

SEQ ID NO: 10808 - DNA, 35 bp, Artificial Sequence
  Synthetic oligonucleotide
gacctgtcccgccactgtcaagaccttcgctgaaa

SEQ ID NO: 10809 - DNA, 38 bp, Artificial Sequence
  Synthetic oligonucleotide
gattcacacccaccgttactaagcatatatggcactga

SEQ ID NO: 10810 - DNA, 37 bp, Artificial Sequence
  Synthetic oligonucleotide
agcgcggtcacgattgcgcctccctccatcctctcga

SEQ ID NO: 10811 - DNA, 35 bp, Artificial Sequence
  Synthetic oligonucleotide
ttgacccgcttagccgttacctgaccgtcgaaccc

SEQ ID NO: 10812 - DNA, 37 bp, Artificial Sequence
  Synthetic oligonucleotide
gagccggagcaggtggggagggggcggcgatatagga

SEQ ID NO: 10813 - DNA, 37 bp, Artificial Sequence
  Synthetic oligonucleotide
gaaacagccccagcgaacaccgaatcccctttcatga

SEQ ID NO: 10814 - DNA, 38 bp, Artificial Sequence
  Synthetic oligonucleotide
gtggccccctgccagttttgctcgccctctaccattga

SEQ ID NO: 10815 - DNA, 36 bp, Artificial Sequence
  Synthetic oligonucleotide
gtgccactgactagtcgacatttgcatctccaccta

SEQ ID NO: 10816 - DNA, 36 bp, Artificial Sequence
  Synthetic oligonucleotide
aaaaagccgggagggggcgaggggcgggtgagcaaa

SEQ ID NO: 10817 - DNA, 35 bp, Artificial Sequence
  Synthetic oligonucleotide
gtcacgccacctttcgtaattgtcaaggtcctgtt

SEQ ID NO: 10818 - DNA, 35 bp, Artificial Sequence
  Synthetic oligonucleotide
ctccccacccacgggatgaatctcaatgttgccaa

SEQ ID NO: 10819 - DNA, 35 bp, Artificial Sequence
  Synthetic oligonucleotide
actgtgcctccgctaacacgcctcttaccacgcat

SEQ ID NO: 10820 - DNA, 35 bp, Artificial Sequence
  Synthetic oligonucleotide
tgtgtgcaacacctaccggactccctaccttcgct

SEQ ID NO: 10821 - DNA, 35 bp, Artificial Sequence
  Synthetic oligonucleotide
tccacgtccaatattagttcaccgtttttgcttcc

SEQ ID NO: 10822 - DNA, 36 bp, Artificial Sequence
  Synthetic oligonucleotide
atcccctgtgcctattcgttgctctgctcttctaca

SEQ ID NO: 10823 - DNA, 38 bp, Artificial Sequence
  Synthetic oligonucleotide
gacaaccgcccgaccgatcttccctctgtttctgttga

SEQ ID NO: 10824 - DNA, 35 bp, Artificial Sequence
  Synthetic oligonucleotide
tccaacccttccgccacctcatacgagacagaccc

SEQ ID NO: 10825 - DNA, 35 bp, Artificial Sequence
  Synthetic oligonucleotide
tctcgcgctcagtttctacaccagtgccaccttcc

SEQ ID NO: 10826 - DNA, 36 bp, Artificial Sequence
  Synthetic oligonucleotide
gaagggtggaaggaagtagcacatggcgggcagaga

SEQ ID NO: 10827 - DNA, 37 bp, Artificial Sequence
  Synthetic oligonucleotide
acacccatgatcttatcgctacctccccgtataggga

SEQ ID NO: 10828 - DNA, 36 bp, Artificial Sequence
  Synthetic oligonucleotide
gagcccccccgcccacgattatcatcactgacacaa

SEQ ID NO: 10829 - DNA, 37 bp, Artificial Sequence
  Synthetic oligonucleotide
gttgctacctctggccattcttacactctctacgaga

SEQ ID NO: 10830 - DNA, 36 bp, Artificial Sequence
  Synthetic oligonucleotide
acgtgcgccgcctacaccgtcctcgcctgtaacaca

SEQ ID NO: 10831 - DNA, 36 bp, Artificial Sequence
  Synthetic oligonucleotide
actgcgcactccggtgtcccccaacgtccttgctca

SEQ ID NO: 10832 - DNA, 36 bp, Artificial Sequence
  Synthetic oligonucleotide
acccaactcaaactgccgccatacgcagctccgcca

SEQ ID NO: 10833 - DNA, 37 bp, Artificial Sequence
  Synthetic oligonucleotide
acaacaccccctccattaatactagttacagctacga

SEQ ID NO: 10834 - DNA, 35 bp, Artificial Sequence
  Synthetic oligonucleotide
tgatcccccgcttatcctcatactctagtgacata

SEQ ID NO: 10835 - DNA, 35 bp, Artificial Sequence
  Synthetic oligonucleotide
gaaactgcactcgatccgtccccattcacctgtct

SEQ ID NO: 10836 - DNA, 38 bp, Artificial Sequence
  Synthetic oligonucleotide
ttgccgctgcctcccatcaccctgccacattatgttga

SEQ ID NO: 10837 - DNA, 35 bp, Artificial Sequence
  Synthetic oligonucleotide
acgctcatcaacgggcatgcatagtcttcccctcc

SEQ ID NO: 10838 - DNA, 35 bp, Artificial Sequence
  Synthetic oligonucleotide
gtgccgacatctctttgcccacggcctagcttatc

SEQ ID NO: 10839 - DNA, 34 bp, Artificial Sequence
  Synthetic oligonucleotide
tgtgagtgattgccgcctgttatttgcccggttt

SEQ ID NO: 10840 - DNA, 38 bp, Artificial Sequence
  Synthetic oligonucleotide
acgacccacagagtaaacccatcccctcccggccatga

SEQ ID NO: 10841 - DNA, 37 bp, Artificial Sequence
  Synthetic oligonucleotide
gccaccttatcccgtttaggcaacatccttttcctga

SEQ ID NO: 10842 - DNA, 35 bp, Artificial Sequence
  Synthetic oligonucleotide
ttggtaccatctccctatagcgactgttcccccgc

SEQ ID NO: 10843 - DNA, 35 bp, Artificial Sequence
  Synthetic oligonucleotide
tgcgaagccgcccctttgttgttttttttacctgt

SEQ ID NO: 10844 - DNA, 35 bp, Artificial Sequence
  Synthetic oligonucleotide
tcttcaagcccagcccggactacatctgcactctt

SEQ ID NO: 10845 - DNA, 37 bp, Artificial Sequence
  Synthetic oligonucleotide
agtgggctgggaggggaggcattgtaaaaagggagga

SEQ ID NO: 10846 - DNA, 35 bp, Artificial Sequence
  Synthetic oligonucleotide
gtagtcaaacaaggggatggagggtggaaaatggc

SEQ ID NO: 10847 - DNA, 35 bp, Artificial Sequence
  Synthetic oligonucleotide
gaaccaccggacaacaaatacgtgccgtgcctact

SEQ ID NO: 10848 - DNA, 37 bp, Artificial Sequence
  Synthetic oligonucleotide
tcctccggacgcacacgcttctatttggccttcccga

SEQ ID NO: 10849 - DNA, 37 bp, Artificial Sequence
  Synthetic oligonucleotide
gcatcacgcgcacatctcataccgaaacgaactagga

SEQ ID NO: 10850 - DNA, 35 bp, Artificial Sequence
  Synthetic oligonucleotide
atcccacctccaaattgctgttcctatacttccag

SEQ ID NO: 10851 - DNA, 35 bp, Artificial Sequence
  Synthetic oligonucleotide
aatgcagatcggcactccttattcgcctcacactt

SEQ ID NO: 10852 - DNA, 36 bp, Artificial Sequence
  Synthetic oligonucleotide
acgcccgctccggacccacatgctccacctgccgca

SEQ ID NO: 10853 - DNA, 37 bp, Artificial Sequence
  Synthetic oligonucleotide
ttgatccgactgatcctgttgccaccatatcctacga

SEQ ID NO: 10854 - DNA, 37 bp, Artificial Sequence
  Synthetic oligonucleotide
gccacccgccttttctgtctcaggcgcaaccctcgga

SEQ ID NO: 10855 - DNA, 35 bp, Artificial Sequence
  Synthetic oligonucleotide
tcaccccaaatgccgtactatccagaggactgact

SEQ ID NO: 10856 - DNA, 35 bp, Artificial Sequence
  Synthetic oligonucleotide
tccatgcctcacagcctaaggctacacaaacgttt

SEQ ID NO: 10857 - DNA, 38 bp, Artificial Sequence
  Synthetic oligonucleotide
agtcaacccgaccctgcctggccatttgccctttctga

SEQ ID NO: 10858 - DNA, 35 bp, Artificial Sequence
  Synthetic oligonucleotide
gcacgcacgctcttatgccccatttcgctcgtggc

SEQ ID NO: 10859 - DNA, 35 bp, Artificial Sequence
  Synthetic oligonucleotide
tcaggtcgcgttgggccgggcttgggggggtaggg

SEQ ID NO: 10860 - DNA, 35 bp, Artificial Sequence
  Synthetic oligonucleotide
aacacctacaccactcacgagatgcatcgagcaca

SEQ ID NO: 10861 - DNA, 35 bp, Artificial Sequence
  Synthetic oligonucleotide
ttagtgcacgctgctactcttgcttttgtaactca

SEQ ID NO: 10862 - DNA, 35 bp, Artificial Sequence
  Synthetic oligonucleotide
tccatcctgtgaccctgattctcaccacctcttgg

SEQ ID NO: 10863 - DNA, 38 bp, Artificial Sequence
  Synthetic oligonucleotide
gcactgcgcaaatccgtaaaatccccgtaccctgctga

SEQ ID NO: 10864 - DNA, 36 bp, Artificial Sequence
  Synthetic oligonucleotide
aagtgccagccaccgcatctgggctatcattttcca

SEQ ID NO: 10865 - DNA, 36 bp, Artificial Sequence
  Synthetic oligonucleotide
gacaacccagtgtcgctacttttaattccgcctcga

SEQ ID NO: 10866 - DNA, 35 bp, Artificial Sequence
  Synthetic oligonucleotide
gacgacttatcggcctttgcattttgaactcgccc

SEQ ID NO: 10867 - DNA, 35 bp, Artificial Sequence
  Synthetic oligonucleotide
taaccagccgcccgggctcatcctaccctcacctc

SEQ ID NO: 10868 - DNA, 35 bp, Artificial Sequence
  Synthetic oligonucleotide
ttcgagaggaggaggctacgggaggaagggagaaa

SEQ ID NO: 10869 - DNA, 35 bp, Artificial Sequence
  Synthetic oligonucleotide
gccttcgtgcgatcgctagcacctgccatcattca

SEQ ID NO: 10870 - DNA, 38 bp, Artificial Sequence
  Synthetic oligonucleotide
ttgtcccatctctgccgattcgtggaggtctcccgtga

SEQ ID NO: 10871 - DNA, 38 bp, Artificial Sequence
  Synthetic oligonucleotide
gacatggagtcccattggggcaaggggggggtgggtga

SEQ ID NO: 10872 - DNA, 36 bp, Artificial Sequence
  Synthetic oligonucleotide
gccacagctgtcccgacgaatcactgccctattcta

SEQ ID NO: 10873 - DNA, 36 bp, Artificial Sequence
  Synthetic oligonucleotide
accgccgtacccacgcctccctcagccactacgaaa

SEQ ID NO: 10874 - DNA, 35 bp, Artificial Sequence
  Synthetic oligonucleotide
gcgagagggggagtaagggagcgcggggcattggt

SEQ ID NO: 10875 - DNA, 36 bp, Artificial Sequence
  Synthetic oligonucleotide
tagagccagggggggtggacgctggagagggtggca

SEQ ID NO: 10876 - DNA, 36 bp, Artificial Sequence
  Synthetic oligonucleotide
aactctgccatccctgctcgcctgtatttgtacgta

SEQ ID NO: 10877 - DNA, 36 bp, Artificial Sequence
  Synthetic oligonucleotide
gcctgccccgatcgcagggccacttacctcacacga

SEQ ID NO: 10878 - DNA, 36 bp, Artificial Sequence
  Synthetic oligonucleotide
tacgctgctgagctgcgttatcccaagcacccctta

SEQ ID NO: 10879 - DNA, 37 bp, Artificial Sequence
  Synthetic oligonucleotide
gagggaggaatggggggggtagcagggccgactaaga

SEQ ID NO: 10880 - DNA, 37 bp, Artificial Sequence
  Synthetic oligonucleotide
accacgtatccactgtttgcacactccgctttttaga

SEQ ID NO: 10881 - DNA, 37 bp, Artificial Sequence
  Synthetic oligonucleotide
gaccccaccctcacacctggtagccttcttctctgga

SEQ ID NO: 10882 - DNA, 35 bp, Artificial Sequence
  Synthetic oligonucleotide
ccctggtacccctgccatgttgttgcccaactgtt

SEQ ID NO: 10883 - DNA, 37 bp, Artificial Sequence
  Synthetic oligonucleotide
ttcgagacgcccgactggtcatcagccccccacacga

SEQ ID NO: 10884 - DNA, 35 bp, Artificial Sequence
  Synthetic oligonucleotide
tactgtggcgtggtctgttcactcagccgcttctc

SEQ ID NO: 10885 - DNA, 35 bp, Artificial Sequence
  Synthetic oligonucleotide
gcatccggccataattatatgtacttcactccctt

SEQ ID NO: 10886 - DNA, 37 bp, Artificial Sequence
  Synthetic oligonucleotide
atgcgcaatgttccgccgctgtctcacgccatcccga

SEQ ID NO: 10887 - DNA, 35 bp, Artificial Sequence
  Synthetic oligonucleotide
gccccgccgccgggtcatccaccgtgctaccttaa

SEQ ID NO: 10888 - DNA, 37 bp, Artificial Sequence
  Synthetic oligonucleotide
tctgggggtgagaacatacgaaggggtgaggcgggga

SEQ ID NO: 10889 - DNA, 35 bp, Artificial Sequence
  Synthetic oligonucleotide
gtgatctggggtggggaaatcaagtggcgggaaaa

SEQ ID NO: 10890 - DNA, 36 bp, Artificial Sequence
  Synthetic oligonucleotide
tgtacgcaccctccacgcgataaccactctcgcaaa

SEQ ID NO: 10891 - DNA, 36 bp, Artificial Sequence
  Synthetic oligonucleotide
gatgcacctttctcgttcgccttgataatccaacca

SEQ ID NO: 10892 - DNA, 38 bp, Artificial Sequence
  Synthetic oligonucleotide
gcatcctgccctggccacgtatccattccatcttttga

SEQ ID NO: 10893 - DNA, 37 bp, Artificial Sequence
  Synthetic oligonucleotide
tccagggggagaggaagggaacggtacgttggtgaga

SEQ ID NO: 10894 - DNA, 35 bp, Artificial Sequence
  Synthetic oligonucleotide
ttgccacgactcggcgcctattttccatccgaacc

SEQ ID NO: 10895 - DNA, 38 bp, Artificial Sequence
  Synthetic oligonucleotide
actagcccacgactcttacctggcctgttctctcttga

SEQ ID NO: 10896 - DNA, 35 bp, Artificial Sequence
  Synthetic oligonucleotide
gaagggcaactgaccattgcgcaaactccactttc

SEQ ID NO: 10897 - DNA, 36 bp, Artificial Sequence
  Synthetic oligonucleotide
ggacacatcatctgcaatatctgtactctcctgcca

SEQ ID NO: 10898 - DNA, 35 bp, Artificial Sequence
  Synthetic oligonucleotide
gcccccggccctactgtccgttattcctgttccgt

SEQ ID NO: 10899 - DNA, 36 bp, Artificial Sequence
  Synthetic oligonucleotide
tgtcacccctggcttgcatacatctgatttctcgaa

SEQ ID NO: 10900 - DNA, 37 bp, Artificial Sequence
  Synthetic oligonucleotide
ggaggggaggagttgggtgccgggagcatggcgggga

SEQ ID NO: 10901 - DNA, 35 bp, Artificial Sequence
  Synthetic oligonucleotide
gacccctgccaatggcccctcatttctgtaaatga

SEQ ID NO: 10902 - DNA, 35 bp, Artificial Sequence
  Synthetic oligonucleotide
atcatgggcggggaaatgggctggagggtagggtg

SEQ ID NO: 10903 - DNA, 35 bp, Artificial Sequence
  Synthetic oligonucleotide
cacagacccctcctgtgatgagtataaaatcatgt

SEQ ID NO: 10904 - DNA, 37 bp, Artificial Sequence
  Synthetic oligonucleotide
tgtgccctatgctatcatccccggtcctccttgttga

SEQ ID NO: 10905 - DNA, 35 bp, Artificial Sequence
  Synthetic oligonucleotide
gttacgccattgcactcattctgggacctgaacct

SEQ ID NO: 10906 - DNA, 35 bp, Artificial Sequence
  Synthetic oligonucleotide
tcttgccaccgtgcattctattactacccacaggt

SEQ ID NO: 10907 - DNA, 35 bp, Artificial Sequence
  Synthetic oligonucleotide
gccgccccaagccactagatcacgcacaaattcat

SEQ ID NO: 10908 - DNA, 36 bp, Artificial Sequence
  Synthetic oligonucleotide
acttccatcgcctcagctcttcacatgtgaccccca

SEQ ID NO: 10909 - DNA, 35 bp, Artificial Sequence
  Synthetic oligonucleotide
acccacactcggtctccctccgtgctttcagtaaa

SEQ ID NO: 10910 - DNA, 35 bp, Artificial Sequence
  Synthetic oligonucleotide
atctcactacgccatgtctggtttcacgacttaac

SEQ ID NO: 10911 - DNA, 37 bp, Artificial Sequence
  Synthetic oligonucleotide
tgacaatagcctccgttccccagcgcgttactaccga

SEQ ID NO: 10912 - DNA, 35 bp, Artificial Sequence
  Synthetic oligonucleotide
aaatccccatgctggttgccgaccagtgctaccct

SEQ ID NO: 10913 - DNA, 35 bp, Artificial Sequence
  Synthetic oligonucleotide
gacccgccgtagactggcaggccaacacactcaca

SEQ ID NO: 10914 - DNA, 37 bp, Artificial Sequence
  Synthetic oligonucleotide
gaggggtggtggacggagaggagaaacgaaggtgcga

SEQ ID NO: 10915 - DNA, 36 bp, Artificial Sequence
  Synthetic oligonucleotide
ttcgaccccggggaacctaacctacgccatgtaaca

SEQ ID NO: 10916 - DNA, 35 bp, Artificial Sequence
  Synthetic oligonucleotide
gactgtaccgctcatctaagcaccttgaacttcca

SEQ ID NO: 10917 - DNA, 35 bp, Artificial Sequence
  Synthetic oligonucleotide
tgcccacgccagcctattcggacgcacttttcttt

SEQ ID NO: 10918 - DNA, 35 bp, Artificial Sequence
  Synthetic oligonucleotide
ttcaccgacgataagttccgctttcgcacctctac

SEQ ID NO: 10919 - DNA, 35 bp, Artificial Sequence
  Synthetic oligonucleotide
gcccaacctccggacatcatgcacctatttgtcgc

SEQ ID NO: 10920 - DNA, 38 bp, Artificial Sequence
  Synthetic oligonucleotide
tgttatgcggccagcatctgcacccaactccaccttga

SEQ ID NO: 10921 - DNA, 36 bp, Artificial Sequence
  Synthetic oligonucleotide
gcacaccacctcggcgcgagcggattttttgcatca

SEQ ID NO: 10922 - DNA, 31 bp, Artificial Sequence
  Synthetic oligonucleotide
gaagcacaccactttttgcaaacctctactc

SEQ ID NO: 10923 - DNA, 35 bp, Artificial Sequence
  Synthetic oligonucleotide
acattgcggctgtctgaataccaccacccctgcca

SEQ ID NO: 10924 - DNA, 37 bp, Artificial Sequence
  Synthetic oligonucleotide
atccaatccgttctccaagtttcctgtccgtccacga

SEQ ID NO: 10925 - DNA, 36 bp, Artificial Sequence
  Synthetic oligonucleotide
agacccctcccatgtgctttccatcgtttaacgcaa

SEQ ID NO: 10926 - DNA, 35 bp, Artificial Sequence
  Synthetic oligonucleotide
tacgcgaatgcacaccatcacagatcgcctccctc

SEQ ID NO: 10927 - DNA, 37 bp, Artificial Sequence
  Synthetic oligonucleotide
tgtctcgcctcaccccccgctgctcacgtccccagga

SEQ ID NO: 10928 - DNA, 35 bp, Artificial Sequence
  Synthetic oligonucleotide
accacacgcgattctattctagtcagttcatctcc

SEQ ID NO: 10929 - DNA, 36 bp, Artificial Sequence
  Synthetic oligonucleotide
atcatatgcccttgatggcgacgcccccgataccca

SEQ ID NO: 10930 - DNA, 38 bp, Artificial Sequence
  Synthetic oligonucleotide
tgttacgcactgcctattccgtcccccatcactggtga

SEQ ID NO: 10931 - DNA, 36 bp, Artificial Sequence
  Synthetic oligonucleotide
gtgagggcaagggctgaggacaaggaagggggtata

SEQ ID NO: 10932 - DNA, 35 bp, Artificial Sequence
  Synthetic oligonucleotide
atggtgaaccagttttctatccgtgcctgtcttcc

SEQ ID NO: 10933 - DNA, 35 bp, Artificial Sequence
  Synthetic oligonucleotide
tgatcgacacttctcgagtcccgtgcctcatacct

SEQ ID NO: 10934 - DNA, 35 bp, Artificial Sequence
  Synthetic oligonucleotide
gcgaacgcacaagcagttctcgacaccatcccatt

SEQ ID NO: 10935 - DNA, 36 bp, Artificial Sequence
  Synthetic oligonucleotide
acacacgtctagcccggcggccctttgctcactcca

SEQ ID NO: 10936 - DNA, 37 bp, Artificial Sequence
  Synthetic oligonucleotide
tcacatgcgcgtacgtaagaaggggtggtgggcgtga

SEQ ID NO: 10937 - DNA, 36 bp, Artificial Sequence
  Synthetic oligonucleotide
atgcatctatctgccacccgtaggtccctgcccaca

SEQ ID NO: 10938 - DNA, 37 bp, Artificial Sequence
  Synthetic oligonucleotide
tgcatgtaccgaagcgtcatcctgtccacacctccga

SEQ ID NO: 10939 - DNA, 38 bp, Artificial Sequence
  Synthetic oligonucleotide
tcccacctccagtccgcaccttcatggaactcatttga

SEQ ID NO: 10940 - DNA, 35 bp, Artificial Sequence
  Synthetic oligonucleotide
acgtaactgtcgatgtcccccgcttttgtactgcc

SEQ ID NO: 10941 - DNA, 35 bp, Artificial Sequence
  Synthetic oligonucleotide
taacccccgtcggtcgttctatcacaagttttagc

SEQ ID NO: 10942 - DNA, 35 bp, Artificial Sequence
  Synthetic oligonucleotide
accctagaggtcgctgcgagccctgcctctctcca

SEQ ID NO: 10943 - DNA, 38 bp, Artificial Sequence
  Synthetic oligonucleotide
tacacgcgcctctagtcttcgccgcccatgtttactga

SEQ ID NO: 10944 - DNA, 38 bp, Artificial Sequence
  Synthetic oligonucleotide
tctgacctaccctcggcttatataaacgcttggcctga

SEQ ID NO: 10945 - DNA, 38 bp, Artificial Sequence
  Synthetic oligonucleotide
tatcgcgcacagcctcgcatcctaccttgcacacttga

SEQ ID NO: 10946 - DNA, 36 bp, Artificial Sequence
  Synthetic oligonucleotide
gacgagaggggggagcagtcggtatggtcggtggta

SEQ ID NO: 10947 - DNA, 35 bp, Artificial Sequence
  Synthetic oligonucleotide
gcaaacacttcggtatctgcactatctggttccct

SEQ ID NO: 10948 - DNA, 35 bp, Artificial Sequence
  Synthetic oligonucleotide
gcacacgctcccgccccaccagtaatgaatggttg

SEQ ID NO: 10949 - DNA, 35 bp, Artificial Sequence
  Synthetic oligonucleotide
ttaacctccacaacgctaccgccccgcccctctga

SEQ ID NO: 10950 - DNA, 36 bp, Artificial Sequence
  Synthetic oligonucleotide
tactcgctccatccgtcctttagtggcgttaaccca

SEQ ID NO: 10951 - DNA, 36 bp, Artificial Sequence
  Synthetic oligonucleotide
gccttcatcagttcgctccaacgtggcacatcctca

SEQ ID NO: 10952 - DNA, 38 bp, Artificial Sequence
  Synthetic oligonucleotide
tgacccatcccgtggtgattcccgagtctctcccttga

SEQ ID NO: 10953 - DNA, 35 bp, Artificial Sequence
  Synthetic oligonucleotide
acacaccactctgcatccttgggcttacaggggcc

SEQ ID NO: 10954 - DNA, 35 bp, Artificial Sequence
  Synthetic oligonucleotide
gtggtgccgtccctgggagccgataccttcacctg

SEQ ID NO: 10955 - DNA, 35 bp, Artificial Sequence
  Synthetic oligonucleotide
tcagtagcccctgttccctcgttccgaaggttgct

SEQ ID NO: 10956 - DNA, 38 bp, Artificial Sequence
  Synthetic oligonucleotide
aacgaccgggccatttctgaagccacactcatgcctga

SEQ ID NO: 10957 - DNA, 35 bp, Artificial Sequence
  Synthetic oligonucleotide
actcgctgccggtccattcttcacccaatcactga

SEQ ID NO: 10958 - DNA, 36 bp, Artificial Sequence
  Synthetic oligonucleotide
gccaacgcctagaaaccctctccgcgtccgcccaca

SEQ ID NO: 10959 - DNA, 36 bp, Artificial Sequence
  Synthetic oligonucleotide
tgcaccgccgggcccttcacgaccctcctacatgta

SEQ ID NO: 10960 - DNA, 35 bp, Artificial Sequence
  Synthetic oligonucleotide
gccacctggctctataactacgttgcacagtcctc

SEQ ID NO: 10961 - DNA, 36 bp, Artificial Sequence
  Synthetic oligonucleotide
acaggacagcacacacgcgtactgcacctaacttta

SEQ ID NO: 10962 - DNA, 35 bp, Artificial Sequence
  Synthetic oligonucleotide
tgcacgataccgctgcccgtctcatcgaccaactg

SEQ ID NO: 10963 - DNA, 37 bp, Artificial Sequence
  Synthetic oligonucleotide
tcccgccgccatgcctttagtactcctcgcgacgtga

SEQ ID NO: 10964 - DNA, 38 bp, Artificial Sequence
  Synthetic oligonucleotide
gtgaggggggagggggttgcataagggcatctatgtga

SEQ ID NO: 10965 - DNA, 35 bp, Artificial Sequence
  Synthetic oligonucleotide
accgggaacggggggaacgggagaaacgaggtggg

SEQ ID NO: 10966 - DNA, 35 bp, Artificial Sequence
  Synthetic oligonucleotide
ttgcaacctgccgctacttcccttcttgtcgttca

SEQ ID NO: 10967 - DNA, 35 bp, Artificial Sequence
  Synthetic oligonucleotide
agccaactgccccactttggtgcctttctcccgtg

SEQ ID NO: 10968 - DNA, 35 bp, Artificial Sequence
  Synthetic oligonucleotide
ttcgcatgcccgcttctctcatctgtatcgctcct

SEQ ID NO: 10969 - DNA, 35 bp, Artificial Sequence
  Synthetic oligonucleotide
gccaagcctagcttttgatccaccaacgtacccgc

SEQ ID NO: 10970 - DNA, 36 bp, Artificial Sequence
  Synthetic oligonucleotide
ggaacgcctcgccgcagtaactgttactttctctca

SEQ ID NO: 10971 - DNA, 35 bp, Artificial Sequence
  Synthetic oligonucleotide
ttccgcagacgttgttcatgttttgcccttactcc

SEQ ID NO: 10972 - DNA, 37 bp, Artificial Sequence
  Synthetic oligonucleotide
tgtccgggtgggatgggtgctgtatgggcttgtaaga

SEQ ID NO: 10973 - DNA, 35 bp, Artificial Sequence
  Synthetic oligonucleotide
gctcctcgaccctcgcgtttgtttaccgtgcttcc

SEQ ID NO: 10974 - DNA, 36 bp, Artificial Sequence
  Synthetic oligonucleotide
attgcccagcccgatgtctcgtaaactcaggcccca

SEQ ID NO: 10975 - DNA, 35 bp, Artificial Sequence
  Synthetic oligonucleotide
acatggtgcgcgccgcgactgtactcccacttgct

SEQ ID NO: 10976 - DNA, 33 bp, Artificial Sequence
  Synthetic oligonucleotide
tcactcgttcccgaggctcacccgatcataccc

SEQ ID NO: 10977 - DNA, 35 bp, Artificial Sequence
  Synthetic oligonucleotide
atgggtggttttggttgatggggaatgcgatgggg

SEQ ID NO: 10978 - DNA, 37 bp, Artificial Sequence
  Synthetic oligonucleotide
ttgcaagcctgaggggggaggggggttgcactgggga

SEQ ID NO: 10979 - DNA, 36 bp, Artificial Sequence
  Synthetic oligonucleotide
aatgagggggagggcatagtattgcaggagagggta

SEQ ID NO: 10980 - DNA, 35 bp, Artificial Sequence
  Synthetic oligonucleotide
ttgtgcctccgagcttccccgctacacacgctacc

SEQ ID NO: 10981 - DNA, 35 bp, Artificial Sequence
  Synthetic oligonucleotide
tacttgttcgctccatccatgcttcccgttccgcg

SEQ ID NO: 10982 - DNA, 36 bp, Artificial Sequence
  Synthetic oligonucleotide
tccgccccaccgtggaatcttccttatcaccctcga

SEQ ID NO: 10983 - DNA, 36 bp, Artificial Sequence
  Synthetic oligonucleotide
gtcatcgctgtctgcctcgtcgtccacggattctca

SEQ ID NO: 10984 - DNA, 35 bp, Artificial Sequence
  Synthetic oligonucleotide
tagatcgtagtatcgtaccccatgcttgaaccacc

SEQ ID NO: 10985 - DNA, 35 bp, Artificial Sequence
  Synthetic oligonucleotide
agccccagtaacctccgctgcgcacacttcctgtc

SEQ ID NO: 10986 - DNA, 35 bp, Artificial Sequence
  Synthetic oligonucleotide
gcactacctcccgttctccctgtaattgtgcgttc

SEQ ID NO: 10987 - DNA, 35 bp, Artificial Sequence
  Synthetic oligonucleotide
gccgacggggagaacgggggagggcgatcgggggg

SEQ ID NO: 10988 - DNA, 37 bp, Artificial Sequence
  Synthetic oligonucleotide
ttccgccacgccctgactccggagtccctctcaccga

SEQ ID NO: 10989 - DNA, 35 bp, Artificial Sequence
  Synthetic oligonucleotide
agatcccatcacgctagtgctacatgcccaacaac

SEQ ID NO: 10990 - DNA, 35 bp, Artificial Sequence
  Synthetic oligonucleotide
tattcatgccatcatagcgctatcgtaccttggtc

SEQ ID NO: 10991 - DNA, 35 bp, Artificial Sequence
  Synthetic oligonucleotide
tacgagactctggtgctctccgcccctaaactgcg

SEQ ID NO: 10992 - DNA, 35 bp, Artificial Sequence
  Synthetic oligonucleotide
aacatccctcctgttgttttactccactctcccgt

SEQ ID NO: 10993 - DNA, 35 bp, Artificial Sequence
  Synthetic oligonucleotide
tctggggagtaggggggaatctaggcggatggggt

SEQ ID NO: 10994 - DNA, 36 bp, Artificial Sequence
  Synthetic oligonucleotide
acttcggggacaccacatgccgattttgttacacca

SEQ ID NO: 10995 - DNA, 37 bp, Artificial Sequence
  Synthetic oligonucleotide
tcccacaccacttgtctatccgtccacgaagttcgga

SEQ ID NO: 10996 - DNA, 35 bp, Artificial Sequence
  Synthetic oligonucleotide
acacgcccactccgcctgtcagttaagactttaat

SEQ ID NO: 10997 - DNA, 36 bp, Artificial Sequence
  Synthetic oligonucleotide
acacaccccacttcgcacatctcgctttgttgttca

SEQ ID NO: 10998 - DNA, 36 bp, Artificial Sequence
  Synthetic oligonucleotide
taccgttgcctctgcatcacgccctctcctgagtta

SEQ ID NO: 10999 - DNA, 35 bp, Artificial Sequence
  Synthetic oligonucleotide
gaggtgacggaaggaggcgctgggcgaaaaaaaaa

SEQ ID NO: 11000 - DNA, 38 bp, Artificial Sequence
  Synthetic oligonucleotide
tccccatgccgggatgctggcctctatgctaaccttga

SEQ ID NO: 11001 - DNA, 35 bp, Artificial Sequence
  Synthetic oligonucleotide
atgcctccgcttacccctcaccgtgctgaaagttc

SEQ ID NO: 11002 - DNA, 36 bp, Artificial Sequence
  Synthetic oligonucleotide
tcacgccgccattgtccatttgatctgtgctcacaa

SEQ ID NO: 11003 - DNA, 34 bp, Artificial Sequence
  Synthetic oligonucleotide
tcattgccgtaacattgctcccctccacaagccg

SEQ ID NO: 11004 - DNA, 35 bp, Artificial Sequence
  Synthetic oligonucleotide
actgagcccgcagcccacgtacgactccttgaact

SEQ ID NO: 11005 - DNA, 36 bp, Artificial Sequence
  Synthetic oligonucleotide
atcgccacccacatcctcgtttacaaacgcctaata

SEQ ID NO: 11006 - DNA, 35 bp, Artificial Sequence
  Synthetic oligonucleotide
ttcgcgcatacgtcactatcgtcgccctacaccta

SEQ ID NO: 11007 - DNA, 35 bp, Artificial Sequence
  Synthetic oligonucleotide
agtggatgccgcacgtatccgtcgttttctatcac

SEQ ID NO: 11008 - DNA, 35 bp, Artificial Sequence
  Synthetic oligonucleotide
tctcactgtgtgccactgtcccctcccaagcctgc

SEQ ID NO: 11009 - DNA, 35 bp, Artificial Sequence
  Synthetic oligonucleotide
attggtcccatcgcccccttgtcacatgacgctgt

SEQ ID NO: 11010 - DNA, 35 bp, Artificial Sequence
  Synthetic oligonucleotide
gaagcggtcgcctcgttgctctgtacatccttctt

SEQ ID NO: 11011 - DNA, 35 bp, Artificial Sequence
  Synthetic oligonucleotide
gtggtgaaacattggtgcaatcgaccacgccctcc

SEQ ID NO: 11012 - DNA, 36 bp, Artificial Sequence
  Synthetic oligonucleotide
acgccaccccccatacgagtagaaactcgttccaaa

SEQ ID NO: 11013 - DNA, 35 bp, Artificial Sequence
  Synthetic oligonucleotide
gtcttcccacccgctcccattgcaagggccttgca

SEQ ID NO: 11014 - DNA, 37 bp, Artificial Sequence
  Synthetic oligonucleotide
acgctagcctctgtttcaccctctgccgtgctctcga

SEQ ID NO: 11015 - DNA, 35 bp, Artificial Sequence
  Synthetic oligonucleotide
gattccgcctggatttatacagtcccatcccctct

SEQ ID NO: 11016 - DNA, 36 bp, Artificial Sequence
  Synthetic oligonucleotide
tgttccacgcctaacctcatatacacaccgtacgga

SEQ ID NO: 11017 - DNA, 37 bp, Artificial Sequence
  Synthetic oligonucleotide
accatgcctctcttcagactccccgccatgaccgtga

SEQ ID NO: 11018 - DNA, 38 bp, Artificial Sequence
  Synthetic oligonucleotide
aacaaccgcacatgtacacacaccacgacggaagctga

SEQ ID NO: 11019 - DNA, 35 bp, Artificial Sequence
  Synthetic oligonucleotide
atcccatgtgaacttccagtcccatcgccttgcct

SEQ ID NO: 11020 - DNA, 35 bp, Artificial Sequence
  Synthetic oligonucleotide
ggaccccctcatcaccgggctctcaccctcgaacc

SEQ ID NO: 11021 - DNA, 35 bp, Artificial Sequence
  Synthetic oligonucleotide
gagcgcctgcgactagtctcccgatccacctcgca

SEQ ID NO: 11022 - DNA, 36 bp, Artificial Sequence
  Synthetic oligonucleotide
tgcatccgaagggttccttgccaccatctcatatca

SEQ ID NO: 11023 - DNA, 35 bp, Artificial Sequence
  Synthetic oligonucleotide
gcgatgacgtctcgccctacaatgccacaacaccg

SEQ ID NO: 11024 - DNA, 37 bp, Artificial Sequence
  Synthetic oligonucleotide
atgaagtgggagtgggcgaaatcgggtgggtggtgga

SEQ ID NO: 11025 - DNA, 38 bp, Artificial Sequence
  Synthetic oligonucleotide
tgcctcacctctccgctgaactgctctggacctcctga

SEQ ID NO: 11026 - DNA, 35 bp, Artificial Sequence
  Synthetic oligonucleotide
gcgttcgccgccgaatctatctcttgcctccgccc

SEQ ID NO: 11027 - DNA, 36 bp, Artificial Sequence
  Synthetic oligonucleotide
acgcctatctgccgcctgtatcaatgcattttccga

SEQ ID NO: 11028 - DNA, 37 bp, Artificial Sequence
  Synthetic oligonucleotide
tccaccctcaaaaccttcgttttagttgacccctcga

SEQ ID NO: 11029 - DNA, 37 bp, Artificial Sequence
  Synthetic oligonucleotide
tactcatcagccgtgccccgttcctcgttccaagtga

SEQ ID NO: 11030 - DNA, 35 bp, Artificial Sequence
  Synthetic oligonucleotide
tccccgaccatcccacacacagtcgtgttatgctc

SEQ ID NO: 11031 - DNA, 35 bp, Artificial Sequence
  Synthetic oligonucleotide
gcatctacaagcgtgcattctgcccacgtcaccca

SEQ ID NO: 11032 - DNA, 35 bp, Artificial Sequence
  Synthetic oligonucleotide
gtgcccctcacacatcgacgttcagactagcattc

SEQ ID NO: 11033 - DNA, 35 bp, Artificial Sequence
  Synthetic oligonucleotide
accgacgtaccaaccacctttgtcgcacagaactc

SEQ ID NO: 11034 - DNA, 36 bp, Artificial Sequence
  Synthetic oligonucleotide
atgcgacggccaacggggacaatgaaaatgggggga

SEQ ID NO: 11035 - DNA, 37 bp, Artificial Sequence
  Synthetic oligonucleotide
tgctatctcatgtctccaatgcgcacgccacacctga

SEQ ID NO: 11036 - DNA, 35 bp, Artificial Sequence
  Synthetic oligonucleotide
tacacctgtacgatcatcaagacccacccatcatt

SEQ ID NO: 11037 - DNA, 36 bp, Artificial Sequence
  Synthetic oligonucleotide
tacacatagtgcctatttcgcctgaaccacccggaa

SEQ ID NO: 11038 - DNA, 37 bp, Artificial Sequence
  Synthetic oligonucleotide
ttacactgcttccggagcgtcttcgtactgctttcga

SEQ ID NO: 11039 - DNA, 37 bp, Artificial Sequence
  Synthetic oligonucleotide
gtagggggcacggggcaagtagggaggtaggtacgga

SEQ ID NO: 11040 - DNA, 35 bp, Artificial Sequence
  Synthetic oligonucleotide
agcgaacagcccgaccatctatccgtgctaatcac

SEQ ID NO: 11041 - DNA, 35 bp, Artificial Sequence
  Synthetic oligonucleotide
accatcgggtgtttgcttactcctgccttgcactc

SEQ ID NO: 11042 - DNA, 35 bp, Artificial Sequence
  Synthetic oligonucleotide
atccaccgcttggcactcgaattaggttcgaatat

SEQ ID NO: 11043 - DNA, 38 bp, Artificial Sequence
  Synthetic oligonucleotide
gtggtcgctcaaaggtaggggatggaagcgggcggtga

SEQ ID NO: 11044 - DNA, 37 bp, Artificial Sequence
  Synthetic oligonucleotide
acgctagtgcctgaactctcctgtgcttgatcctcga

SEQ ID NO: 11045 - DNA, 37 bp, Artificial Sequence
  Synthetic oligonucleotide
gcacctcgctccataccataaatttctcgtccacgga

SEQ ID NO: 11046 - DNA, 37 bp, Artificial Sequence
  Synthetic oligonucleotide
tcgacccccgcacttgttgccatcgtattctttttga

SEQ ID NO: 11047 - DNA, 37 bp, Artificial Sequence
  Synthetic oligonucleotide
aactgagccccgccgccctattcgctacaaactggga

SEQ ID NO: 11048 - DNA, 38 bp, Artificial Sequence
  Synthetic oligonucleotide
gctagggaagggcgggcgggagcaacggcaatcattga

SEQ ID NO: 11049 - DNA, 35 bp, Artificial Sequence
  Synthetic oligonucleotide
tgcgagtgtcactggtctgttatcttcttttccct

SEQ ID NO: 11050 - DNA, 36 bp, Artificial Sequence
  Synthetic oligonucleotide
gactaacactctctgtgataacgtcacccttcttca

SEQ ID NO: 11051 - DNA, 37 bp, Artificial Sequence
  Synthetic oligonucleotide
accacgccccggacccctctattaagcctcccagtga

SEQ ID NO: 11052 - DNA, 35 bp, Artificial Sequence
  Synthetic oligonucleotide
gttgaggccgttcacaccttttcagctgcccaacc

SEQ ID NO: 11053 - DNA, 35 bp, Artificial Sequence
  Synthetic oligonucleotide
gtgggaggtcactcttaggccagtccgcgcttcct

SEQ ID NO: 11054 - DNA, 37 bp, Artificial Sequence
  Synthetic oligonucleotide
acccccggccccccctgtttgaggcatcggtcacgga

SEQ ID NO: 11055 - DNA, 38 bp, Artificial Sequence
  Synthetic oligonucleotide
aaccactccatagtgcctgtcctggtcgcacatagtga

SEQ ID NO: 11056 - DNA, 35 bp, Artificial Sequence
  Synthetic oligonucleotide
tgtgaacaccacgccactatgcgtcctctctacat

SEQ ID NO: 11057 - DNA, 35 bp, Artificial Sequence
  Synthetic oligonucleotide
gagccgtcacctccctcccgctcgaccgttctagt

SEQ ID NO: 11058 - DNA, 35 bp, Artificial Sequence
  Synthetic oligonucleotide
atcgaacctatcatcaccgctccattcacgttgca

SEQ ID NO: 11059 - DNA, 35 bp, Artificial Sequence
  Synthetic oligonucleotide
tgcccgccctccgcggatcgacgccctcgcctacg

SEQ ID NO: 11060 - DNA, 35 bp, Artificial Sequence
  Synthetic oligonucleotide
gccgccctccccccgttgtacctacggatataatc

SEQ ID NO: 11061 - DNA, 35 bp, Artificial Sequence
  Synthetic oligonucleotide
tccggttggcctcgtatcttgaatttcctgtcttc

SEQ ID NO: 11062 - DNA, 36 bp, Artificial Sequence
  Synthetic oligonucleotide
tcacacgatcccttgctgtagtgttttgcccatgca

SEQ ID NO: 11063 - DNA, 38 bp, Artificial Sequence
  Synthetic oligonucleotide
ttcggaaccgccgccggtgactatcacgcccctcctga

SEQ ID NO: 11064 - DNA, 36 bp, Artificial Sequence
  Synthetic oligonucleotide
gatacaccgcttgccatgagtttactctccttccta

SEQ ID NO: 11065 - DNA, 35 bp, Artificial Sequence
  Synthetic oligonucleotide
gcacccgcgcgtctctgcccataccactccggcgc

SEQ ID NO: 11066 - DNA, 35 bp, Artificial Sequence
  Synthetic oligonucleotide
tcacgacaccaacgtttcacacacatccaatatgc

SEQ ID NO: 11067 - DNA, 36 bp, Artificial Sequence
  Synthetic oligonucleotide
taccactctgttctatctgccctatatgtagcttta

SEQ ID NO: 11068 - DNA, 35 bp, Artificial Sequence
  Synthetic oligonucleotide
gtaacaggcccctgactctcgataattacgcctct

SEQ ID NO: 11069 - DNA, 36 bp, Artificial Sequence
  Synthetic oligonucleotide
tagcaccctaattcctgtcttacaacgttgcctcca

SEQ ID NO: 11070 - DNA, 36 bp, Artificial Sequence
  Synthetic oligonucleotide
gtagccagaatccgtgccggccacctttcctctcga

SEQ ID NO: 11071 - DNA, 36 bp, Artificial Sequence
  Synthetic oligonucleotide
tccgacgctgagttactaaccgccacactacatcga

SEQ ID NO: 11072 - DNA, 35 bp, Artificial Sequence
  Synthetic oligonucleotide
gcacggtacctcccatgctgtcggttcatcccttc

SEQ ID NO: 11073 - DNA, 35 bp, Artificial Sequence
  Synthetic oligonucleotide
ccagctcccccccgtgcctcctctgtagagctcat

SEQ ID NO: 11074 - DNA, 36 bp, Artificial Sequence
  Synthetic oligonucleotide
gtccacccactgttgtgcccgtactcggtctactca

SEQ ID NO: 11075 - DNA, 35 bp, Artificial Sequence
  Synthetic oligonucleotide
tctaccccatcccgctgaaggccctttcacaatgg

SEQ ID NO: 11076 - DNA, 34 bp, Artificial Sequence
  Synthetic oligonucleotide
taccctccgacatagactatcaactcacgcttgg

SEQ ID NO: 11077 - DNA, 35 bp, Artificial Sequence
  Synthetic oligonucleotide
agccgagcggcacctcctccaccacgattttccgt

SEQ ID NO: 11078 - DNA, 36 bp, Artificial Sequence
  Synthetic oligonucleotide
tcccctgtcccctctgatccatcgttgaattaacta

SEQ ID NO: 11079 - DNA, 32 bp, Artificial Sequence
  Synthetic oligonucleotide
gtttggatgtcaccccgcccctgttgtcctta

SEQ ID NO: 11080 - DNA, 36 bp, Artificial Sequence
  Synthetic oligonucleotide
accgccctccacggtcgttgccatccgagcaattta

SEQ ID NO: 11081 - DNA, 35 bp, Artificial Sequence
  Synthetic oligonucleotide
tacaactccaggtgagccccgttccgctgtaacat

SEQ ID NO: 11082 - DNA, 36 bp, Artificial Sequence
  Synthetic oligonucleotide
agtgcatcctgtagctgtgctcttgtatgtggccca

SEQ ID NO: 11083 - DNA, 29 bp, Artificial Sequence
  Synthetic oligonucleotide
taaccacaatccgccatcctggagcttga

SEQ ID NO: 11084 - DNA, 35 bp, Artificial Sequence
  Synthetic oligonucleotide
tgcccatgcacgtctcacattcattagcacttatc

SEQ ID NO: 11085 - DNA, 35 bp, Artificial Sequence
  Synthetic oligonucleotide
tgacggctcccacttgtctgttctctggttggtcc

SEQ ID NO: 11086 - DNA, 37 bp, Artificial Sequence
  Synthetic oligonucleotide
gcccgcgctcccacttgatcgaacacaattctaccga

SEQ ID NO: 11087 - DNA, 38 bp, Artificial Sequence
  Synthetic oligonucleotide
gcgatgccccagagtagtttcgttcgccctccccttga

SEQ ID NO: 11088 - DNA, 36 bp, Artificial Sequence
  Synthetic oligonucleotide
atgcctcagagctgcccacccacactcgtatttaca

SEQ ID NO: 11089 - DNA, 35 bp, Artificial Sequence
  Synthetic oligonucleotide
tctgtacatgctgactttggactgcttacccaccc

SEQ ID NO: 11090 - DNA, 36 bp, Artificial Sequence
  Synthetic oligonucleotide
gcgcgggtgtggtgggcgggtattaggcctgtgtga

SEQ ID NO: 11091 - DNA, 35 bp, Artificial Sequence
  Synthetic oligonucleotide
tatggccccacccaccttcataggcagatcttaac

SEQ ID NO: 11092 - DNA, 37 bp, Artificial Sequence
  Synthetic oligonucleotide
tgcgaagcgcggaagggaaggagggaatattgatcga

SEQ ID NO: 11093 - DNA, 35 bp, Artificial Sequence
  Synthetic oligonucleotide
ggtgtccccgctacatgcctttgctttctcacttc

SEQ ID NO: 11094 - DNA, 35 bp, Artificial Sequence
  Synthetic oligonucleotide
aatccaccctcgccgttcgaatataatcgcccccg

SEQ ID NO: 11095 - DNA, 35 bp, Artificial Sequence
  Synthetic oligonucleotide
actatcccccgtcgcgtttgtccgttcgatgctac

SEQ ID NO: 11096 - DNA, 35 bp, Artificial Sequence
  Synthetic oligonucleotide
tactaacgcagcacttatcgacctcccatttcgtc

SEQ ID NO: 11097 - DNA, 35 bp, Artificial Sequence
  Synthetic oligonucleotide
gacaccttcattaccctggcttcaatgtccgctcg

SEQ ID NO: 11098 - DNA, 35 bp, Artificial Sequence
  Synthetic oligonucleotide
attaccgactaagtgcactgtcatcacccaccttc

SEQ ID NO: 11099 - DNA, 35 bp, Artificial Sequence
  Synthetic oligonucleotide
tagtatcaccccgtgccccttgagcctttttgaag

SEQ ID NO: 11100 - DNA, 35 bp, Artificial Sequence
  Synthetic oligonucleotide
gcacatgccatgctaccagtcccagcactttctca

SEQ ID NO: 11101 - DNA, 36 bp, Artificial Sequence
  Synthetic oligonucleotide
tcacactcaccatccaaggcacttcgcacaggtcga

SEQ ID NO: 11102 - DNA, 35 bp, Artificial Sequence
  Synthetic oligonucleotide
gatgggggggtacgtgatggtccccatcagtagga

SEQ ID NO: 11103 - DNA, 38 bp, Artificial Sequence
  Synthetic oligonucleotide
gtgcaagcatccgccgccccccgcgtccactccaggga

SEQ ID NO: 11104 - DNA, 38 bp, Artificial Sequence
  Synthetic oligonucleotide
gccaacctcaccatccacgaccgcccgagatacgttga

SEQ ID NO: 11105 - DNA, 35 bp, Artificial Sequence
  Synthetic oligonucleotide
tccacctctgcgagggtcccccttgtacctacacc

SEQ ID NO: 11106 - DNA, 35 bp, Artificial Sequence
  Synthetic oligonucleotide
attgcccccatcctcagctattgtagaatctctgt

SEQ ID NO: 11107 - DNA, 35 bp, Artificial Sequence
  Synthetic oligonucleotide
tatggcggagtactgggcgcgcattcatctccatc

SEQ ID NO: 11108 - DNA, 35 bp, Artificial Sequence
  Synthetic oligonucleotide
tcatgagggtgggggtaactgtgcgggttctacgg

SEQ ID NO: 11109 - DNA, 35 bp, Artificial Sequence
  Synthetic oligonucleotide
tgtgcctctccattctgtttttgcacggtcatact

SEQ ID NO: 11110 - DNA, 35 bp, Artificial Sequence
  Synthetic oligonucleotide
aatggcacccgtctcccttgccacgtccacccaac

SEQ ID NO: 11111 - DNA, 35 bp, Artificial Sequence
  Synthetic oligonucleotide
gtccgcccccccattttgcatccaggataggtcgc

SEQ ID NO: 11112 - DNA, 35 bp, Artificial Sequence
  Synthetic oligonucleotide
tgccctcccgcccaggtttttaacatcaggccatc

SEQ ID NO: 11113 - DNA, 35 bp, Artificial Sequence
  Synthetic oligonucleotide
atgtgtataccgctgtccaccattatattgcacac

SEQ ID NO: 11114 - DNA, 35 bp, Artificial Sequence
  Synthetic oligonucleotide
gacgggcctgcctgcattaccctacgattcttgac

SEQ ID NO: 11115 - DNA, 35 bp, Artificial Sequence
  Synthetic oligonucleotide
accgttcccgacgcccacagccagcccctccatgc

SEQ ID NO: 11116 - DNA, 38 bp, Artificial Sequence
  Synthetic oligonucleotide
tgcgggggggggcgaagatgattcaggggcgatcgtga

SEQ ID NO: 11117 - DNA, 35 bp, Artificial Sequence
  Synthetic oligonucleotide
tgattcgcagcccgctatcatgtgccatgcccgcc

SEQ ID NO: 11118 - DNA, 35 bp, Artificial Sequence
  Synthetic oligonucleotide
tccaactcgcccccgtcgttcaccgagccaagaac

SEQ ID NO: 11119 - DNA, 35 bp, Artificial Sequence
  Synthetic oligonucleotide
ttcccattcagcgcacctacatcattgcccgcttc

SEQ ID NO: 11120 - DNA, 35 bp, Artificial Sequence
  Synthetic oligonucleotide
gattctccgccccactatgtcttgttttggcattc

SEQ ID NO: 11121 - DNA, 34 bp, Artificial Sequence
  Synthetic oligonucleotide
tgaccaaactgccagcctcccttccctatcaacg

SEQ ID NO: 11122 - DNA, 35 bp, Artificial Sequence
  Synthetic oligonucleotide
acgttcccccccgaccaaatgatgatctacgattg

SEQ ID NO: 11123 - DNA, 35 bp, Artificial Sequence
  Synthetic oligonucleotide
attatcgaccgtgggggggcaataagggagggaat

SEQ ID NO: 11124 - DNA, 35 bp, Artificial Sequence
  Synthetic oligonucleotide
tcacgcatctcttgctgattacaaaccacctccaa

SEQ ID NO: 11125 - DNA, 36 bp, Artificial Sequence
  Synthetic oligonucleotide
ggatcagacgttctgactccatgcacacccgccacc

SEQ ID NO: 11126 - DNA, 36 bp, Artificial Sequence
  Synthetic oligonucleotide
tagttaccccccccagcctcgacgactctcccgata

SEQ ID NO: 11127 - DNA, 35 bp, Artificial Sequence
  Synthetic oligonucleotide
gtgtgccatcgcgctgtacaattgctcttatgcac

SEQ ID NO: 11128 - DNA, 35 bp, Artificial Sequence
  Synthetic oligonucleotide
gaagtggaaaggcggaagcaaacggggcgggcgag

SEQ ID NO: 11129 - DNA, 36 bp, Artificial Sequence
  Synthetic oligonucleotide
gattagacccgctgcgatctctgccaatgcgctcca

SEQ ID NO: 11130 - DNA, 37 bp, Artificial Sequence
  Synthetic oligonucleotide
taccaccttcggattcctcaccatgcacactcatcga

SEQ ID NO: 11131 - DNA, 36 bp, Artificial Sequence
  Synthetic oligonucleotide
tgaggaaaaaggggtggggcgaggaagattacggga

SEQ ID NO: 11132 - DNA, 37 bp, Artificial Sequence
  Synthetic oligonucleotide
gctgtccgcaactctcttcgagccccatcgctttgga

SEQ ID NO: 11133 - DNA, 35 bp, Artificial Sequence
  Synthetic oligonucleotide
gccaggcctgttgaacacccttacgacgctgctgc

SEQ ID NO: 11134 - DNA, 35 bp, Artificial Sequence
  Synthetic oligonucleotide
atggggacgcacagccttcttgtcatggcactttc

SEQ ID NO: 11135 - DNA, 35 bp, Artificial Sequence
  Synthetic oligonucleotide
gcggaatggatcaagggagggaggtagtagggaag

SEQ ID NO: 11136 - DNA, 36 bp, Artificial Sequence
  Synthetic oligonucleotide
tcagcccccccgaatccataaagcctaccgccacga

SEQ ID NO: 11137 - DNA, 35 bp, Artificial Sequence
  Synthetic oligonucleotide
attgagccacttacccttatgaacccgccgacccg

SEQ ID NO: 11138 - DNA, 37 bp, Artificial Sequence
  Synthetic oligonucleotide
atgggacaaggggaaggaggtacggggtttggttgga

SEQ ID NO: 11139 - DNA, 37 bp, Artificial Sequence
  Synthetic oligonucleotide
ttgaccgtccgaccattgcctcatacccccttgctga

SEQ ID NO: 11140 - DNA, 34 bp, Artificial Sequence
  Synthetic oligonucleotide
tacccctcattgcaccggacctgctactggtttc

SEQ ID NO: 11141 - DNA, 36 bp, Artificial Sequence
  Synthetic oligonucleotide
accccaccccttatggtcgatagaactttttcttca

SEQ ID NO: 11142 - DNA, 38 bp, Artificial Sequence
  Synthetic oligonucleotide
gagcgtgctcatcggttttcatcctcactcgttactga

SEQ ID NO: 11143 - DNA, 35 bp, Artificial Sequence
  Synthetic oligonucleotide
gtcataccatccggcattccgaatcaccctacacg

SEQ ID NO: 11144 - DNA, 35 bp, Artificial Sequence
  Synthetic oligonucleotide
tcccatactatctccagccctagcgtcaagacctg

SEQ ID NO: 11145 - DNA, 36 bp, Artificial Sequence
  Synthetic oligonucleotide
acctgcccccaaaagtacctgttcaaggccacgcca

SEQ ID NO: 11146 - DNA, 37 bp, Artificial Sequence
  Synthetic oligonucleotide
atgtgcgccattttatctctacccgtcctggcttcga

SEQ ID NO: 11147 - DNA, 35 bp, Artificial Sequence
  Synthetic oligonucleotide
tcaccaagcccctagacccacggcctctccagacc

SEQ ID NO: 11148 - DNA, 35 bp, Artificial Sequence
  Synthetic oligonucleotide
atgtggccgttggtacctccgctgtccgcatttcc

SEQ ID NO: 11149 - DNA, 36 bp, Artificial Sequence
  Synthetic oligonucleotide
gacaaccagcttttgaacggtcacactccctacgca

SEQ ID NO: 11150 - DNA, 37 bp, Artificial Sequence
  Synthetic oligonucleotide
actgggtggaagtaggggggcaacacgggtcactgga

SEQ ID NO: 11151 - DNA, 34 bp, Artificial Sequence
  Synthetic oligonucleotide
gtcgcccgctcctcatcgccccttcccgctgttc

SEQ ID NO: 11152 - DNA, 37 bp, Artificial Sequence
  Synthetic oligonucleotide
taaaaagggcgaaggggagaaggaaaggaactggaga

SEQ ID NO: 11153 - DNA, 35 bp, Artificial Sequence
  Synthetic oligonucleotide
ttcacgtggcgtgctctaccgttgaatcccgttat

SEQ ID NO: 11154 - DNA, 37 bp, Artificial Sequence
  Synthetic oligonucleotide
accacgccacgctcttatatcctgttccccggtacga

SEQ ID NO: 11155 - DNA, 35 bp, Artificial Sequence
  Synthetic oligonucleotide
aatgcacgccgtacccatcgctcctcctgcttatt

SEQ ID NO: 11156 - DNA, 35 bp, Artificial Sequence
  Synthetic oligonucleotide
gacttccccgaccgaaatgaatttcgcacgtttcc

SEQ ID NO: 11157 - DNA, 35 bp, Artificial Sequence
  Synthetic oligonucleotide
tccaccgcttgctggcccttttaattcctcatcgc

SEQ ID NO: 11158 - DNA, 36 bp, Artificial Sequence
  Synthetic oligonucleotide
gtcaccctccagcctttcgtacgctcgtcaaggcca

SEQ ID NO: 11159 - DNA, 37 bp, Artificial Sequence
  Synthetic oligonucleotide
accctggcccccccccagttctataggtactttgtga

SEQ ID NO: 11160 - DNA, 35 bp, Artificial Sequence
  Synthetic oligonucleotide
tcccctgaccttcctttctcagccctcttcaacgg

SEQ ID NO: 11161 - DNA, 35 bp, Artificial Sequence
  Synthetic oligonucleotide
atggatagccgtcaatcacttgcggacctcttccc

SEQ ID NO: 11162 - DNA, 35 bp, Artificial Sequence
  Synthetic oligonucleotide
cacgtgaccgagtcgacccaccgcccgttacatcc

SEQ ID NO: 11163 - DNA, 35 bp, Artificial Sequence
  Synthetic oligonucleotide
atcagtctgcaaccgctacttcatcccccacgttc

SEQ ID NO: 11164 - DNA, 36 bp, Artificial Sequence
  Synthetic oligonucleotide
gcccccgccgtacgctaattttcgctagtgatttta

SEQ ID NO: 11165 - DNA, 35 bp, Artificial Sequence
  Synthetic oligonucleotide
gacatagccttgtgcattgttttctgtcaacctac

SEQ ID NO: 11166 - DNA, 35 bp, Artificial Sequence
  Synthetic oligonucleotide
gagcctggcccaatgcggtcaacatcccgcacatc

SEQ ID NO: 11167 - DNA, 35 bp, Artificial Sequence
  Synthetic oligonucleotide
tcactgacccatgtactcgcccctctcgctacttg

SEQ ID NO: 11168 - DNA, 35 bp, Artificial Sequence
  Synthetic oligonucleotide
gtgaactaccctctgtattttggacccatgccttc

SEQ ID NO: 11169 - DNA, 37 bp, Artificial Sequence
  Synthetic oligonucleotide
gccccccgcctttctgccttgccgtttactcccgcga

SEQ ID NO: 11170 - DNA, 37 bp, Artificial Sequence
  Synthetic oligonucleotide
tcaccacctctggatgcacttcaaccactattctcga

SEQ ID NO: 11171 - DNA, 38 bp, Artificial Sequence
  Synthetic oligonucleotide
gccccagtcggcctgctgcttggcagtaccacccctga

SEQ ID NO: 11172 - DNA, 38 bp, Artificial Sequence
  Synthetic oligonucleotide
acatcatcgggtggagggagggtgacggctaacgctga

SEQ ID NO: 11173 - DNA, 38 bp, Artificial Sequence
  Synthetic oligonucleotide
gatgccgccctcagcaagcgtgctttcaatacctctga

SEQ ID NO: 11174 - DNA, 35 bp, Artificial Sequence
  Synthetic oligonucleotide
gtccaccgcctgactggcttttccgttcaattata

SEQ ID NO: 11175 - DNA, 35 bp, Artificial Sequence
  Synthetic oligonucleotide
aacactgcagccctggtcacactacaatgtttctc

SEQ ID NO: 11176 - DNA, 35 bp, Artificial Sequence
  Synthetic oligonucleotide
acttcaacttcgccacatgcacccagtgaaccttc

SEQ ID NO: 11177 - DNA, 37 bp, Artificial Sequence
  Synthetic oligonucleotide
actacctccgactcttacacttgagcactccaaccga

SEQ ID NO: 11178 - DNA, 35 bp, Artificial Sequence
  Synthetic oligonucleotide
tgaacgctgcctcccggtccaccgaccccccctta

SEQ ID NO: 11179 - DNA, 37 bp, Artificial Sequence
  Synthetic oligonucleotide
aggatggggacggacggaggccaaagacggtggaaga

SEQ ID NO: 11180 - DNA, 38 bp, Artificial Sequence
  Synthetic oligonucleotide
aaacccatgtgtcctgcttagtgcactgcactccttga

SEQ ID NO: 11181 - DNA, 36 bp, Artificial Sequence
  Synthetic oligonucleotide
agaccctcgctccgttttgatagctgccaccctcca

SEQ ID NO: 11182 - DNA, 37 bp, Artificial Sequence
  Synthetic oligonucleotide
gatccctgtgcacgatacgccccaccttcccacgcga

SEQ ID NO: 11183 - DNA, 35 bp, Artificial Sequence
  Synthetic oligonucleotide
tctgatgacgactcatgcctttctccatctttagc

SEQ ID NO: 11184 - DNA, 37 bp, Artificial Sequence
  Synthetic oligonucleotide
agaaagtgggatggagggtgagggtggctaatacgga

SEQ ID NO: 11185 - DNA, 38 bp, Artificial Sequence
  Synthetic oligonucleotide
ggacacctgcctcaactcgccgacccttatggccatga

SEQ ID NO: 11186 - DNA, 37 bp, Artificial Sequence
  Synthetic oligonucleotide
gacggactggcccagttccacctatccttattgctga

SEQ ID NO: 11187 - DNA, 35 bp, Artificial Sequence
  Synthetic oligonucleotide
gatggaaagtggaaggcgaacaaatacggccaacg

SEQ ID NO: 11188 - DNA, 35 bp, Artificial Sequence
  Synthetic oligonucleotide
tcaaaccctacgtaccatacacttctttgcctacg

SEQ ID NO: 11189 - DNA, 35 bp, Artificial Sequence
  Synthetic oligonucleotide
acgatttcgcctcatcgctattttcccccttgacg

SEQ ID NO: 11190 - DNA, 35 bp, Artificial Sequence
  Synthetic oligonucleotide
gtgtgcactccgtccgcccatctcccctcctgaat

SEQ ID NO: 11191 - DNA, 35 bp, Artificial Sequence
  Synthetic oligonucleotide
gactgccactgctactcgctagatctttccattct

SEQ ID NO: 11192 - DNA, 37 bp, Artificial Sequence
  Synthetic oligonucleotide
tcaactcgccctcctacttactgaccgccgctcgtga

SEQ ID NO: 11193 - DNA, 35 bp, Artificial Sequence
  Synthetic oligonucleotide
atcataccaccgccctgagactatagagtgaagtg

SEQ ID NO: 11194 - DNA, 35 bp, Artificial Sequence
  Synthetic oligonucleotide
gatgccgcttgtcgattcactccctgcctttcgtt

SEQ ID NO: 11195 - DNA, 35 bp, Artificial Sequence
  Synthetic oligonucleotide
tgttccatgccccaaattttttgcgcgaaacttca

SEQ ID NO: 11196 - DNA, 37 bp, Artificial Sequence
  Synthetic oligonucleotide
tatcccgccgggacccaccctccctatacgttcttga

SEQ ID NO: 11197 - DNA, 36 bp, Artificial Sequence
  Synthetic oligonucleotide
accgctaacacccagcatgacttcaccgccgccgta

SEQ ID NO: 11198 - DNA, 36 bp, Artificial Sequence
  Synthetic oligonucleotide
tacaaaccgcgcaccacagcttctatgggccaccca

SEQ ID NO: 11199 - DNA, 36 bp, Artificial Sequence
  Synthetic oligonucleotide
gggacgggggaggaaattgcaaggtagtgggggtga

SEQ ID NO: 11200 - DNA, 36 bp, Artificial Sequence
  Synthetic oligonucleotide
agccacctcacgcgttgcttccacctggtcctttga

SEQ ID NO: 11201 - DNA, 35 bp, Artificial Sequence
  Synthetic oligonucleotide
gtccctcacgtgctccaacattacatgggcttagc

SEQ ID NO: 11202 - DNA, 37 bp, Artificial Sequence
  Synthetic oligonucleotide
aacatcagccgtgttccccgcccttcctgccttccga

SEQ ID NO: 11203 - DNA, 37 bp, Artificial Sequence
  Synthetic oligonucleotide
ttcgactacggtgaatggggaagggggctaaggggga

SEQ ID NO: 11204 - DNA, 36 bp, Artificial Sequence
  Synthetic oligonucleotide
gaccactgaacatgcgagaactgacccgacgctaca

SEQ ID NO: 11205 - DNA, 35 bp, Artificial Sequence
  Synthetic oligonucleotide
ttgcccccttatccaccattagacgcgtgccgtcc

SEQ ID NO: 11206 - DNA, 35 bp, Artificial Sequence
  Synthetic oligonucleotide
ggtcaacacatcgggcatagttacctcacccacct

SEQ ID NO: 11207 - DNA, 35 bp, Artificial Sequence
  Synthetic oligonucleotide
acagccgttcgcagcgcacatcaaggctttttttc

SEQ ID NO: 11208 - DNA, 36 bp, Artificial Sequence
  Synthetic oligonucleotide
tcaccatgcactctactggccttcagacagcaccga

SEQ ID NO: 11209 - DNA, 36 bp, Artificial Sequence
  Synthetic oligonucleotide
gacctgccacacctcctcttagtgcactcaacaata

SEQ ID NO: 11210 - DNA, 36 bp, Artificial Sequence
  Synthetic oligonucleotide
gtccaccccctgaactatgagcccccacaagcaata

SEQ ID NO: 11211 - DNA, 35 bp, Artificial Sequence
  Synthetic oligonucleotide
tcacagccactcgcttccgcttcaccgttcttctt

SEQ ID NO: 11212 - DNA, 36 bp, Artificial Sequence
  Synthetic oligonucleotide
gatcacctctccgaacgtcccgcgaatactttccga

SEQ ID NO: 11213 - DNA, 35 bp, Artificial Sequence
  Synthetic oligonucleotide
gactgacctgcccacagtcatcccttccgccaact

SEQ ID NO: 11214 - DNA, 35 bp, Artificial Sequence
  Synthetic oligonucleotide
tcaacaccaggccgtttctttgctccttactgttt

SEQ ID NO: 11215 - DNA, 36 bp, Artificial Sequence
  Synthetic oligonucleotide
attcgccgcacttttgacgttacttgatcccactga

SEQ ID NO: 11216 - DNA, 35 bp, Artificial Sequence
  Synthetic oligonucleotide
tccctgccgataggcatataatgtaaccataccac

SEQ ID NO: 11217 - DNA, 35 bp, Artificial Sequence
  Synthetic oligonucleotide
attcaatcaatggggctggggacggggggggcggt

SEQ ID NO: 11218 - DNA, 38 bp, Artificial Sequence
  Synthetic oligonucleotide
aaccgctacccacacttgttttcccagctcacctgtga

SEQ ID NO: 11219 - DNA, 36 bp, Artificial Sequence
  Synthetic oligonucleotide
tgactgggggagtttggtacatggggtttggggata

SEQ ID NO: 11220 - DNA, 35 bp, Artificial Sequence
  Synthetic oligonucleotide
atgcactgctgcctctaagccactccatctcttat

SEQ ID NO: 11221 - DNA, 36 bp, Artificial Sequence
  Synthetic oligonucleotide
tttgccctcacctatgcgccctttaaccagtgcaca

SEQ ID NO: 11222 - DNA, 36 bp, Artificial Sequence
  Synthetic oligonucleotide
tgcgacgcatactctgtcccccgtacacatttccca

SEQ ID NO: 11223 - DNA, 36 bp, Artificial Sequence
  Synthetic oligonucleotide
tccccccgcggcccgcttatgaactcgcccaactca

SEQ ID NO: 11224 - DNA, 35 bp, Artificial Sequence
  Synthetic oligonucleotide
gcacccatcactatgcttgctgatacttgtacgcc

SEQ ID NO: 11225 - DNA, 35 bp, Artificial Sequence
  Synthetic oligonucleotide
gcctctgcaagcactctacactttgagctaaatct

SEQ ID NO: 11226 - DNA, 35 bp, Artificial Sequence
  Synthetic oligonucleotide
acatctcccgggccataagcgcgctccaacacgca

SEQ ID NO: 11227 - DNA, 35 bp, Artificial Sequence
  Synthetic oligonucleotide
gtcgacggacacccgcacgcaccattcaatgcctc

SEQ ID NO: 11228 - DNA, 36 bp, Artificial Sequence
  Synthetic oligonucleotide
atgcccttccaccatcactttggacccatgttacca

SEQ ID NO: 11229 - DNA, 37 bp, Artificial Sequence
  Synthetic oligonucleotide
acaccccgcctttccactttgcacgtcccaggaggga

SEQ ID NO: 11230 - DNA, 38 bp, Artificial Sequence
  Synthetic oligonucleotide
tacgtcaaccgtgccgttgacgattgactcattcctga

SEQ ID NO: 11231 - DNA, 34 bp, Artificial Sequence
  Synthetic oligonucleotide
acaccactgaatgagctctatcaactcggttaca

SEQ ID NO: 11232 - DNA, 35 bp, Artificial Sequence
  Synthetic oligonucleotide
gatgccgcaatcaatgtagcacattgctgccttcc

SEQ ID NO: 11233 - DNA, 35 bp, Artificial Sequence
  Synthetic oligonucleotide
agccccctctctgcgtccttagttccgctcccggc

SEQ ID NO: 11234 - DNA, 35 bp, Artificial Sequence
  Synthetic oligonucleotide
gtccgccgttgtttttcttctgttggcctgtcttc

SEQ ID NO: 11235 - DNA, 38 bp, Artificial Sequence
  Synthetic oligonucleotide
gacacacctcccgctctgtccaataccctgtcaagtga

SEQ ID NO: 11236 - DNA, 38 bp, Artificial Sequence
  Synthetic oligonucleotide
gatcccaccgacgcttaatgccttctctgctgacgtga

SEQ ID NO: 11237 - DNA, 35 bp, Artificial Sequence
  Synthetic oligonucleotide
gtgagcactccccgagttatgcatctttcccgtga

SEQ ID NO: 11238 - DNA, 36 bp, Artificial Sequence
  Synthetic oligonucleotide
ttgcaaccacatttaccaccccacataggcacccta

SEQ ID NO: 11239 - DNA, 37 bp, Artificial Sequence
  Synthetic oligonucleotide
atccgacccctaccgaccttagactgtatgttaatca

SEQ ID NO: 11240 - DNA, 35 bp, Artificial Sequence
  Synthetic oligonucleotide
gcactgtctcctgatttagccacctgatatgctcc

SEQ ID NO: 11241 - DNA, 35 bp, Artificial Sequence
  Synthetic oligonucleotide
aacattccatccgatcagatggcctccgtaccctt

SEQ ID NO: 11242 - DNA, 38 bp, Artificial Sequence
  Synthetic oligonucleotide
tcacccccgcctaactacattagagtactcttgcctga

SEQ ID NO: 11243 - DNA, 35 bp, Artificial Sequence
  Synthetic oligonucleotide
tccgcggtccagtcatcattcctagccgtcattcc

SEQ ID NO: 11244 - DNA, 35 bp, Artificial Sequence
  Synthetic oligonucleotide
cttaccctgcaacactttgagacaggacgagcata

SEQ ID NO: 11245 - DNA, 35 bp, Artificial Sequence
  Synthetic oligonucleotide
agacacctaccggatcttttatctacaccgccact

SEQ ID NO: 11246 - DNA, 36 bp, Artificial Sequence
  Synthetic oligonucleotide
gccaactggttgtcttcccgtctctgttgcccctaa

SEQ ID NO: 11247 - DNA, 35 bp, Artificial Sequence
  Synthetic oligonucleotide
atgcctctgcgaacctcccttgccggcccctccca

SEQ ID NO: 11248 - DNA, 37 bp, Artificial Sequence
  Synthetic oligonucleotide
acacactgaccgaacgcccgtagagagccttactcga

SEQ ID NO: 11249 - DNA, 35 bp, Artificial Sequence
  Synthetic oligonucleotide
aaccacctaactcccggtcctgtgttcctatggtc

SEQ ID NO: 11250 - DNA, 35 bp, Artificial Sequence
  Synthetic oligonucleotide
acgcacacctgcccgattacagtaaacgttcttgt

SEQ ID NO: 11251 - DNA, 35 bp, Artificial Sequence
  Synthetic oligonucleotide
accacacagtcactaggttcctttcgtctttttag

SEQ ID NO: 11252 - DNA, 35 bp, Artificial Sequence
  Synthetic oligonucleotide
tccccacctcgcataccacttagatgacagtagga

SEQ ID NO: 11253 - DNA, 38 bp, Artificial Sequence
  Synthetic oligonucleotide
tacgcccccttatcgcttatactgagtacctccgttga

SEQ ID NO: 11254 - DNA, 36 bp, Artificial Sequence
  Synthetic oligonucleotide
tcaactgtcaggctgaacatcccactcatacgctca

SEQ ID NO: 11255 - DNA, 35 bp, Artificial Sequence
  Synthetic oligonucleotide
tcctcccatggggcccctcttccgtgtagtctcgc

SEQ ID NO: 11256 - DNA, 35 bp, Artificial Sequence
  Synthetic oligonucleotide
gtcctgcaaccacctccaccttcgtaacgtagtta

SEQ ID NO: 11257 - DNA, 34 bp, Artificial Sequence
  Synthetic oligonucleotide
gcgaccttgcctccatgtcgccccactaggttac

SEQ ID NO: 11258 - DNA, 38 bp, Artificial Sequence
  Synthetic oligonucleotide
atcgcaacacccacactgaccgcctagtccccttgtga

SEQ ID NO: 11259 - DNA, 35 bp, Artificial Sequence
  Synthetic oligonucleotide
accctcaaacctgcatgcattcaacgcttaccgct

SEQ ID NO: 11260 - DNA, 37 bp, Artificial Sequence
  Synthetic oligonucleotide
tgtaaagtcagccaaagtcttcgtccctgcttcccga

SEQ ID NO: 11261 - DNA, 35 bp, Artificial Sequence
  Synthetic oligonucleotide
gttgcacaccacataatcgaacccgaccgctgtac

SEQ ID NO: 11262 - DNA, 34 bp, Artificial Sequence
  Synthetic oligonucleotide
gttagcactgccttgtcagtgcccacgattcctc

SEQ ID NO: 11263 - DNA, 35 bp, Artificial Sequence
  Synthetic oligonucleotide
tcctccccgcacctatatgaagctatcgcgaatca

SEQ ID NO: 11264 - DNA, 37 bp, Artificial Sequence
  Synthetic oligonucleotide
aggacagaaggcatagggctataggggggtgaggtga

SEQ ID NO: 11265 - DNA, 37 bp, Artificial Sequence
  Synthetic oligonucleotide
gccgatagctgcttgacgcccgtaatccttccattga

SEQ ID NO: 11266 - DNA, 36 bp, Artificial Sequence
  Synthetic oligonucleotide
accaaccgtaccaccatcagtccgtgttctcctgaa

SEQ ID NO: 11267 - DNA, 36 bp, Artificial Sequence
  Synthetic oligonucleotide
gagggaaaggggaggggctgtgggcgggggccggga

SEQ ID NO: 11268 - DNA, 35 bp, Artificial Sequence
  Synthetic oligonucleotide
agacctgcaggaagggggagggggaggagccatcg

SEQ ID NO: 11269 - DNA, 35 bp, Artificial Sequence
  Synthetic oligonucleotide
tcccaatgcagaattgtgcctttttttgctgtcca

SEQ ID NO: 11270 - DNA, 35 bp, Artificial Sequence
  Synthetic oligonucleotide
tgcccacaaacggtcgtcccccccgtgactcgctc

SEQ ID NO: 11271 - DNA, 36 bp, Artificial Sequence
  Synthetic oligonucleotide
tatacccccgtcacctttcgttcactcctgactgca

SEQ ID NO: 11272 - DNA, 37 bp, Artificial Sequence
  Synthetic oligonucleotide
atcctccacgtgctgactgccatcttgttacatctga

SEQ ID NO: 11273 - DNA, 35 bp, Artificial Sequence
  Synthetic oligonucleotide
atgcgcctgatcgccgacacccttccaagcccccc

SEQ ID NO: 11274 - DNA, 36 bp, Artificial Sequence
  Synthetic oligonucleotide
tcctccacaccggtctatctcatgctgcgtagccca

SEQ ID NO: 11275 - DNA, 35 bp, Artificial Sequence
  Synthetic oligonucleotide
acatcccacgtcgcacccccgcgtcccaggtacta

SEQ ID NO: 11276 - DNA, 35 bp, Artificial Sequence
  Synthetic oligonucleotide
gacaaccacaactatgcacctctctgtatttgcaa

SEQ ID NO: 11277 - DNA, 38 bp, Artificial Sequence
  Synthetic oligonucleotide
acatggccccccgctttgcatcatttcacccgtggtga

SEQ ID NO: 11278 - DNA, 35 bp, Artificial Sequence
  Synthetic oligonucleotide
gtcaaacagtctagacgtcccactcacccttccgc

SEQ ID NO: 11279 - DNA, 37 bp, Artificial Sequence
  Synthetic oligonucleotide
ccgcaccccagcgttaccgtaccattgcctccgccga

SEQ ID NO: 11280 - DNA, 35 bp, Artificial Sequence
  Synthetic oligonucleotide
tcatcacgggtggtgtctcagctcatccggccctc

SEQ ID NO: 11281 - DNA, 36 bp, Artificial Sequence
  Synthetic oligonucleotide
tccgttcgccatatctcttttgttgacactatcaca

SEQ ID NO: 11282 - DNA, 37 bp, Artificial Sequence
  Synthetic oligonucleotide
tgccacccgacccaggtgttccgctgccctcttacga

SEQ ID NO: 11283 - DNA, 35 bp, Artificial Sequence
  Synthetic oligonucleotide
tgtgttgcaggtctagttgcgattcctctcaccct

SEQ ID NO: 11284 - DNA, 38 bp, Artificial Sequence
  Synthetic oligonucleotide
atgcccacccgctccatgatccgttctaccaattttga

SEQ ID NO: 11285 - DNA, 36 bp, Artificial Sequence
  Synthetic oligonucleotide
cactgcccctgtgcttattctctctcgcccttacga

SEQ ID NO: 11286 - DNA, 37 bp, Artificial Sequence
  Synthetic oligonucleotide
agtaggggggggtgagagtcaacgagggacaaaggga

SEQ ID NO: 11287 - DNA, 35 bp, Artificial Sequence
  Synthetic oligonucleotide
gccacaattgtgcccctggcctactgttccccatt

SEQ ID NO: 11288 - DNA, 35 bp, Artificial Sequence
  Synthetic oligonucleotide
tcccgccacatcttcggttcattggtcgtaatttt

SEQ ID NO: 11289 - DNA, 37 bp, Artificial Sequence
  Synthetic oligonucleotide
agcggagactgactggggggcatgggggagtgaggga

SEQ ID NO: 11290 - DNA, 35 bp, Artificial Sequence
  Synthetic oligonucleotide
acctacactcccgactggtgcagccatccgcttga

SEQ ID NO: 11291 - DNA, 36 bp, Artificial Sequence
  Synthetic oligonucleotide
acgaatactccacctgctcgtcgtcgaccgtttcaa

SEQ ID NO: 11292 - DNA, 35 bp, Artificial Sequence
  Synthetic oligonucleotide
tactgctacggtaccgcgtgcccccgttgttcatc

SEQ ID NO: 11293 - DNA, 34 bp, Artificial Sequence
  Synthetic oligonucleotide
acacgcaaggaagtttcactggttgttccctcct

SEQ ID NO: 11294 - DNA, 35 bp, Artificial Sequence
  Synthetic oligonucleotide
tcacaggacgggaaatcggaatgagggaaggacag

SEQ ID NO: 11295 - DNA, 35 bp, Artificial Sequence
  Synthetic oligonucleotide
gacgtctgcatacgtctgctccatccatcccttcc

SEQ ID NO: 11296 - DNA, 35 bp, Artificial Sequence
  Synthetic oligonucleotide
tccgccccgtttcatcgccttctcttatcgctagc

SEQ ID NO: 11297 - DNA, 35 bp, Artificial Sequence
  Synthetic oligonucleotide
tacgaatgccctcccgcggtgagccactaacctgc

SEQ ID NO: 11298 - DNA, 35 bp, Artificial Sequence
  Synthetic oligonucleotide
gcgattgttgcagtgggaaaagggggggtatgggg

SEQ ID NO: 11299 - DNA, 36 bp, Artificial Sequence
  Synthetic oligonucleotide
gcccctgcccggacacgtgcgccccattcgcttcta

SEQ ID NO: 11300 - DNA, 35 bp, Artificial Sequence
  Synthetic oligonucleotide
tcttgccagcactcttttcccgccgccgtaccagc

SEQ ID NO: 11301 - DNA, 34 bp, Artificial Sequence
  Synthetic oligonucleotide
gagacaggggctcctctgttcgcctacccatgct

SEQ ID NO: 11302 - DNA, 35 bp, Artificial Sequence
  Synthetic oligonucleotide
acgataagccactctcattagtctagtcatccact

SEQ ID NO: 11303 - DNA, 35 bp, Artificial Sequence
  Synthetic oligonucleotide
gacaatctaccgagcagcatcccgcacttctgtcc

SEQ ID NO: 11304 - DNA, 35 bp, Artificial Sequence
  Synthetic oligonucleotide
agtacaaccgattctgttttccgaccacgactttc

SEQ ID NO: 11305 - DNA, 37 bp, Artificial Sequence
  Synthetic oligonucleotide
tcagagtgctccaactgaagctgcccgcaccctatga

SEQ ID NO: 11306 - DNA, 38 bp, Artificial Sequence
  Synthetic oligonucleotide
tccaatcccctccgatctcgttcttgtcgtcatcctga

SEQ ID NO: 11307 - DNA, 37 bp, Artificial Sequence
  Synthetic oligonucleotide
tagcccccaccaagcgattatgcccctttcgttttga

SEQ ID NO: 11308 - DNA, 37 bp, Artificial Sequence
  Synthetic oligonucleotide
tatggtgcggaggaggaggcatgccggactggggcga

SEQ ID NO: 11309 - DNA, 38 bp, Artificial Sequence
  Synthetic oligonucleotide
tccccaccttacgccccacgcggtttcgatcccgttga

SEQ ID NO: 11310 - DNA, 37 bp, Artificial Sequence
  Synthetic oligonucleotide
gtcctgcccggacgtacatccatgcctctaaatgacg

SEQ ID NO: 11311 - DNA, 35 bp, Artificial Sequence
  Synthetic oligonucleotide
gtgagcgggggagattttgcggagtgaggtgggcg

SEQ ID NO: 11312 - DNA, 35 bp, Artificial Sequence
  Synthetic oligonucleotide
tccggaaaacggcagaaatcgttcccatcacccgt

SEQ ID NO: 11313 - DNA, 37 bp, Artificial Sequence
  Synthetic oligonucleotide
tgacgctctattgcgctggttcacattttctctctga

SEQ ID NO: 11314 - DNA, 38 bp, Artificial Sequence
  Synthetic oligonucleotide
acgacgcacccgcaactccgtatacatagcctccgtga

SEQ ID NO: 11315 - DNA, 35 bp, Artificial Sequence
  Synthetic oligonucleotide
tacacggacagataaaacacatgattccccttccg

SEQ ID NO: 11316 - DNA, 35 bp, Artificial Sequence
  Synthetic oligonucleotide
gccggaaggtgaagtagggggaatgatgcagcttg

SEQ ID NO: 11317 - DNA, 35 bp, Artificial Sequence
  Synthetic oligonucleotide
gacgcccccccacctgctgagtacctgatcgcaga

SEQ ID NO: 11318 - DNA, 36 bp, Artificial Sequence
  Synthetic oligonucleotide
ttcgaaaccctgcgagccactcccgttgccacccga

SEQ ID NO: 11319 - DNA, 35 bp, Artificial Sequence
  Synthetic oligonucleotide
tgatgcttagccgaacgcacactcctccgcatacg

SEQ ID NO: 11320 - DNA, 36 bp, Artificial Sequence
  Synthetic oligonucleotide
tcaacaccctgccctgtgaacgcgtaccgtaccgta

SEQ ID NO: 11321 - DNA, 35 bp, Artificial Sequence
  Synthetic oligonucleotide
gagccaccttagccctgattttgacgttacgtggt

SEQ ID NO: 11322 - DNA, 35 bp, Artificial Sequence
  Synthetic oligonucleotide
gtgcgccgacactgtctcattcctaccggctctta

SEQ ID NO: 11323 - DNA, 35 bp, Artificial Sequence
  Synthetic oligonucleotide
tgcttcccccattgtaaaggcctgcaacctattcc

SEQ ID NO: 11324 - DNA, 35 bp, Artificial Sequence
  Synthetic oligonucleotide
tatctgcggcctagcctctattgttcgcacccctc

SEQ ID NO: 11325 - DNA, 35 bp, Artificial Sequence
  Synthetic oligonucleotide
tactccaacactgaattgatagaaccaccgaccct

SEQ ID NO: 11326 - DNA, 35 bp, Artificial Sequence
  Synthetic oligonucleotide
gaccccattaagttgtgcctcctttccccgtacac

SEQ ID NO: 11327 - DNA, 35 bp, Artificial Sequence
  Synthetic oligonucleotide
atcccatcagtagaccatataaccccctgcctccg

SEQ ID NO: 11328 - DNA, 36 bp, Artificial Sequence
  Synthetic oligonucleotide
ttcgggcgcaattcctttgtctttcatcgctgacca

SEQ ID NO: 11329 - DNA, 35 bp, Artificial Sequence
  Synthetic oligonucleotide
tgccctccccgccccatgtccttacaatgcaccag

SEQ ID NO: 11330 - DNA, 36 bp, Artificial Sequence
  Synthetic oligonucleotide
tcccgccccgcctgccacctgtcgcataaatacgaa

SEQ ID NO: 11331 - DNA, 38 bp, Artificial Sequence
  Synthetic oligonucleotide
accccacgccccatgaactccgccccgcggctgtgtga

SEQ ID NO: 11332 - DNA, 37 bp, Artificial Sequence
  Synthetic oligonucleotide
ttaacacgccttaggacgctcccaacatccattccga

SEQ ID NO: 11333 - DNA, 35 bp, Artificial Sequence
  Synthetic oligonucleotide
ggacccgccctgtgccaattcgctcactcatactc

SEQ ID NO: 11334 - DNA, 35 bp, Artificial Sequence
  Synthetic oligonucleotide
ggaatgatcaagccatccgtccgctgcctccctat

SEQ ID NO: 11335 - DNA, 36 bp, Artificial Sequence
  Synthetic oligonucleotide
gtgtcggtgtaggtggcaattatggggtggagcgga

SEQ ID NO: 11336 - DNA, 35 bp, Artificial Sequence
  Synthetic oligonucleotide
acctcctcatcaccacaccccttgcaccgagttgt

SEQ ID NO: 11337 - DNA, 38 bp, Artificial Sequence
  Synthetic oligonucleotide
actcacgcacccggtgccatcctacgccctggctttga

SEQ ID NO: 11338 - DNA, 35 bp, Artificial Sequence
  Synthetic oligonucleotide
gtcgaggccgcatgccgccttttattccttatccg

SEQ ID NO: 11339 - DNA, 37 bp, Artificial Sequence
  Synthetic oligonucleotide
atgcatgagagctggagggcacgggggggtaaatgga

SEQ ID NO: 11340 - DNA, 36 bp, Artificial Sequence
  Synthetic oligonucleotide
gaccacaccccattacatgcacagaccttatggtga

SEQ ID NO: 11341 - DNA, 35 bp, Artificial Sequence
  Synthetic oligonucleotide
tcttggctcccacgttgttattctacctgtcccca

SEQ ID NO: 11342 - DNA, 35 bp, Artificial Sequence
  Synthetic oligonucleotide
tccatatcccacgccaccaccggttgcccgtccat

SEQ ID NO: 11343 - DNA, 35 bp, Artificial Sequence
  Synthetic oligonucleotide
gaccgcactcatggcatcgactcttccggcccatc

SEQ ID NO: 11344 - DNA, 35 bp, Artificial Sequence
  Synthetic oligonucleotide
gacgaaaggagggaaaatgagttatggggaggacg

SEQ ID NO: 11345 - DNA, 34 bp, Artificial Sequence
  Synthetic oligonucleotide
gacaccgccgcattcgaattacggtccaaccccg

SEQ ID NO: 11346 - DNA, 35 bp, Artificial Sequence
  Synthetic oligonucleotide
acccacactcctgggcctgcgccgtacccgcgcaa

SEQ ID NO: 11347 - DNA, 35 bp, Artificial Sequence
  Synthetic oligonucleotide
gaagcccgatacttcgcttgacacgcgccccccac

SEQ ID NO: 11348 - DNA, 35 bp, Artificial Sequence
  Synthetic oligonucleotide
accgtcccacacggtctcactaatccagcttatac

SEQ ID NO: 11349 - DNA, 36 bp, Artificial Sequence
  Synthetic oligonucleotide
tcagccagagtctcgaccccccccagcatggcacaa

SEQ ID NO: 11350 - DNA, 36 bp, Artificial Sequence
  Synthetic oligonucleotide
ttcgccctcacgcacgattcgcgctaaacataacca

SEQ ID NO: 11351 - DNA, 37 bp, Artificial Sequence
  Synthetic oligonucleotide
tccactcgcacatccttactaactggtcaagttacga

SEQ ID NO: 11352 - DNA, 35 bp, Artificial Sequence
  Synthetic oligonucleotide
actcgccctccacccaggacactgaactgaaccga

SEQ ID NO: 11353 - DNA, 37 bp, Artificial Sequence
  Synthetic oligonucleotide
ttgctccaggtggtggtgtgggttatggtggttggga

SEQ ID NO: 11354 - DNA, 35 bp, Artificial Sequence
  Synthetic oligonucleotide
acacaacaatcttcgcgcttcctgttggtactttc

SEQ ID NO: 11355 - DNA, 35 bp, Artificial Sequence
  Synthetic oligonucleotide
tcgcactcagtaatgtcttccattgccctccccag

SEQ ID NO: 11356 - DNA, 35 bp, Artificial Sequence
  Synthetic oligonucleotide
tcccggtcacgccttctgccactatattctcatgc

SEQ ID NO: 11357 - DNA, 35 bp, Artificial Sequence
  Synthetic oligonucleotide
ttgagcgcagtggtcactcttcatctgccaaagtt

SEQ ID NO: 11358 - DNA, 35 bp, Artificial Sequence
  Synthetic oligonucleotide
ttgtaccaccctctttatgcactaggcggaatttt

SEQ ID NO: 11359 - DNA, 38 bp, Artificial Sequence
  Synthetic oligonucleotide
gtgtcaccgacacaggcctagctcgccccttatcctga

SEQ ID NO: 11360 - DNA, 37 bp, Artificial Sequence
  Synthetic oligonucleotide
acccgagtgcccgccgcccaatgatcgcctaacccga

SEQ ID NO: 11361 - DNA, 35 bp, Artificial Sequence
  Synthetic oligonucleotide
atcccccacatatgccacgatgcttgcacaaatac

SEQ ID NO: 11362 - DNA, 35 bp, Artificial Sequence
  Synthetic oligonucleotide
tcacaacacctatcgccggcgattacccagttccc

SEQ ID NO: 11363 - DNA, 35 bp, Artificial Sequence
  Synthetic oligonucleotide
accaaccgtatcgctagaattgctcatcctgccga

SEQ ID NO: 11364 - DNA, 35 bp, Artificial Sequence
  Synthetic oligonucleotide
gactaccccgcgactacgactgccactcaccactg

SEQ ID NO: 11365 - DNA, 35 bp, Artificial Sequence
  Synthetic oligonucleotide
tcattgtccctcacgttgtatcgcctgtttctcac

SEQ ID NO: 11366 - DNA, 35 bp, Artificial Sequence
  Synthetic oligonucleotide
aataccgcgtggagttttctgcccacacttagccc

SEQ ID NO: 11367 - DNA, 35 bp, Artificial Sequence
  Synthetic oligonucleotide
tccgccgttccgtgcggacccggaccatccctcct

SEQ ID NO: 11368 - DNA, 36 bp, Artificial Sequence
  Synthetic oligonucleotide
acccccgcccccggatttgccttaatcagaatccga

SEQ ID NO: 11369 - DNA, 36 bp, Artificial Sequence
  Synthetic oligonucleotide
tgcgggccccttctgagactcgaccgtcccttctta

SEQ ID NO: 11370 - DNA, 35 bp, Artificial Sequence
  Synthetic oligonucleotide
tctgcgcccacagcatttcgtgtacactcttcacc

SEQ ID NO: 11371 - DNA, 35 bp, Artificial Sequence
  Synthetic oligonucleotide
gagccggtccgttccacaccttttctattatcata

SEQ ID NO: 11372 - DNA, 32 bp, Artificial Sequence
  Synthetic oligonucleotide
tggaccaccggacaccctaccccgccattagc

SEQ ID NO: 11373 - DNA, 38 bp, Artificial Sequence
  Synthetic oligonucleotide
aacgcagaggcggggaagggctttggtaggtaggatga

SEQ ID NO: 11374 - DNA, 37 bp, Artificial Sequence
  Synthetic oligonucleotide
tgctcggcaaaggagggcgggtgagggaactatcgga

SEQ ID NO: 11375 - DNA, 36 bp, Artificial Sequence
  Synthetic oligonucleotide
atcaggggaaggccgaggagaaggaagggctttgga

SEQ ID NO: 11376 - DNA, 35 bp, Artificial Sequence
  Synthetic oligonucleotide
gaccgtgatgttgcatcctccctagcctcccgtcg

SEQ ID NO: 11377 - DNA, 37 bp, Artificial Sequence
  Synthetic oligonucleotide
ggaccatgcctagtgctaacacccagccttccaccga

SEQ ID NO: 11378 - DNA, 35 bp, Artificial Sequence
  Synthetic oligonucleotide
acatcacctccgttatcttaagatttggttcttcc

SEQ ID NO: 11379 - DNA, 35 bp, Artificial Sequence
  Synthetic oligonucleotide
gggacctactcactgtgcgcgttccttcatgcact

SEQ ID NO: 11380 - DNA, 35 bp, Artificial Sequence
  Synthetic oligonucleotide
gtcgccccccctatccctggtgtcaactatttagt

SEQ ID NO: 11381 - DNA, 37 bp, Artificial Sequence
  Synthetic oligonucleotide
gccccatctgacagcacctgacgcaactcttccacga

SEQ ID NO: 11382 - DNA, 35 bp, Artificial Sequence
  Synthetic oligonucleotide
gaacccaacccccggagcgctgccttgccccaccg

SEQ ID NO: 11383 - DNA, 35 bp, Artificial Sequence
  Synthetic oligonucleotide
tcatcccgcccggtgcatgatcggaactacctttt

SEQ ID NO: 11384 - DNA, 37 bp, Artificial Sequence
  Synthetic oligonucleotide
gttggaagggggcgaagggtcaacaaagttgaggaga

SEQ ID NO: 11385 - DNA, 35 bp, Artificial Sequence
  Synthetic oligonucleotide
tccattgcaccaagttatcttcacgatctgtaacc

SEQ ID NO: 11386 - DNA, 35 bp, Artificial Sequence
  Synthetic oligonucleotide
gtatgccccccttgacccacatccgccttacctgg

SEQ ID NO: 11387 - DNA, 37 bp, Artificial Sequence
  Synthetic oligonucleotide
agaggaggggtaggagggttactgtgaggaaaaacga

SEQ ID NO: 11388 - DNA, 37 bp, Artificial Sequence
  Synthetic oligonucleotide
ttgccacatacacttgcccgccccacgttttccgtga

SEQ ID NO: 11389 - DNA, 36 bp, Artificial Sequence
  Synthetic oligonucleotide
gagacaggaccctatcgcacaaagacaccaccccta

SEQ ID NO: 11390 - DNA, 34 bp, Artificial Sequence
  Synthetic oligonucleotide
ttccacacgaggttgtgctcagcgccctgtccct

SEQ ID NO: 11391 - DNA, 37 bp, Artificial Sequence
  Synthetic oligonucleotide
gcacccaccgtattacgtgtgtttttcgtactatcga

SEQ ID NO: 11392 - DNA, 37 bp, Artificial Sequence
  Synthetic oligonucleotide
aagaacgagaggtgggatggatggggtaagtagcgga

SEQ ID NO: 11393 - DNA, 34 bp, Artificial Sequence
  Synthetic oligonucleotide
tgccgaccccccgcctccgatacataccccgtga

SEQ ID NO: 11394 - DNA, 35 bp, Artificial Sequence
  Synthetic oligonucleotide
gccgaatgccggcacgcccatcaatacgaatccgc

SEQ ID NO: 11395 - DNA, 35 bp, Artificial Sequence
  Synthetic oligonucleotide
ttctaccgagccatcactgacacatcccgggacct

SEQ ID NO: 11396 - DNA, 35 bp, Artificial Sequence
  Synthetic oligonucleotide
acccacactccgctcttttacgacacccgcgcaaa

SEQ ID NO: 11397 - DNA, 35 bp, Artificial Sequence
  Synthetic oligonucleotide
tcgcggacgcgcgacgtctcctacataatgccccc

SEQ ID NO: 11398 - DNA, 38 bp, Artificial Sequence
  Synthetic oligonucleotide
tagaccacccgcctccatctcgtgtccgctcaacgtga

SEQ ID NO: 11399 - DNA, 38 bp, Artificial Sequence
  Synthetic oligonucleotide
aacgccgtcgcactggaattatgtttttctccacttga

SEQ ID NO: 11400 - DNA, 35 bp, Artificial Sequence
  Synthetic oligonucleotide
gatcagctatatcctcacgcgacgtccccctggcc

SEQ ID NO: 11401 - DNA, 36 bp, Artificial Sequence
  Synthetic oligonucleotide
acacactcgatcgacttactcgccagtcctcctcca

SEQ ID NO: 11402 - DNA, 35 bp, Artificial Sequence
  Synthetic oligonucleotide
gtgcgccgccacccccaccatattgtaacggacag

SEQ ID NO: 11403 - DNA, 35 bp, Artificial Sequence
  Synthetic oligonucleotide
atacgtagccagcactgcgttccttattcatgcat

SEQ ID NO: 11404 - DNA, 38 bp, Artificial Sequence
  Synthetic oligonucleotide
tcatcccacaggcctctgcgctggtttcctttcactga

SEQ ID NO: 11405 - DNA, 35 bp, Artificial Sequence
  Synthetic oligonucleotide
taactccgcctgtgcctacttccctggtgtaactg

SEQ ID NO: 11406 - DNA, 35 bp, Artificial Sequence
  Synthetic oligonucleotide
ttacagggggccggggagtgggagggatggcacgg

SEQ ID NO: 11407 - DNA, 36 bp, Artificial Sequence
  Synthetic oligonucleotide
ggttccgccatcccccctcacctgacgtgccactca

SEQ ID NO: 11408 - DNA, 37 bp, Artificial Sequence
  Synthetic oligonucleotide
acgctgtgtcgatgtcctattctcccaacccccgcga

SEQ ID NO: 11409 - DNA, 37 bp, Artificial Sequence
  Synthetic oligonucleotide
aacaggggcggagaggagagggtcgtagggcccagga

SEQ ID NO: 11410 - DNA, 37 bp, Artificial Sequence
  Synthetic oligonucleotide
tccgacatcccccttttgctgatcattgactcttgga

SEQ ID NO: 11411 - DNA, 35 bp, Artificial Sequence
  Synthetic oligonucleotide
tgcattgggcgctcacggtcccgttgtcacttctt

SEQ ID NO: 11412 - DNA, 37 bp, Artificial Sequence
  Synthetic oligonucleotide
agggagggggaggcacggggtgggacgggaaggtgga

SEQ ID NO: 11413 - DNA, 38 bp, Artificial Sequence
  Synthetic oligonucleotide
tccacccgctggtacttatattaaatctggtcacctga

SEQ ID NO: 11414 - DNA, 35 bp, Artificial Sequence
  Synthetic oligonucleotide
tcaacacgcgatgggcgaaggtgttgaacggactg

SEQ ID NO: 11415 - DNA, 35 bp, Artificial Sequence
  Synthetic oligonucleotide
gcatgaacatccgcagtcctctgaactaagcccct

SEQ ID NO: 11416 - DNA, 33 bp, Artificial Sequence
  Synthetic oligonucleotide
acatgttcgctacctggttcccccccgtggact

SEQ ID NO: 11417 - DNA, 35 bp, Artificial Sequence
  Synthetic oligonucleotide
atcggtgagggaaggtcctgggtgagggtgggggt

SEQ ID NO: 11418 - DNA, 35 bp, Artificial Sequence
  Synthetic oligonucleotide
gcctgaccaactgtaattcctctgtcgaccctgac

SEQ ID NO: 11419 - DNA, 36 bp, Artificial Sequence
  Synthetic oligonucleotide
gcgactcacgcacgtcagcttaacgcctttcatcca

SEQ ID NO: 11420 - DNA, 36 bp, Artificial Sequence
  Synthetic oligonucleotide
gtgtcgtccatctgcatcttggcccgagctttgtta

SEQ ID NO: 11421 - DNA, 35 bp, Artificial Sequence
  Synthetic oligonucleotide
atcccccgaccaacagacacacgccgagagccgca

SEQ ID NO: 11422 - DNA, 35 bp, Artificial Sequence
  Synthetic oligonucleotide
ttcagccgtagccttctctcacacccttcctacac

SEQ ID NO: 11423 - DNA, 37 bp, Artificial Sequence
  Synthetic oligonucleotide
tgccaggggcagttaagcttccattccccttccccga

SEQ ID NO: 11424 - DNA, 38 bp, Artificial Sequence
  Synthetic oligonucleotide
atgctcgccacaccactgcgttccattccacacattga

SEQ ID NO: 11425 - DNA, 35 bp, Artificial Sequence
  Synthetic oligonucleotide
tagcatggtcacgaaccgatttagtcctgctttcc

SEQ ID NO: 11426 - DNA, 35 bp, Artificial Sequence
  Synthetic oligonucleotide
tgcgtatgctctgcccgcccgtttttgtccatcct

SEQ ID NO: 11427 - DNA, 36 bp, Artificial Sequence
  Synthetic oligonucleotide
accgctgatgtgccgtctgctctttatcttccccga

SEQ ID NO: 11428 - DNA, 37 bp, Artificial Sequence
  Synthetic oligonucleotide
gagaggtggggggcggaaaagaaaagatgattagtga

SEQ ID NO: 11429 - DNA, 38 bp, Artificial Sequence
  Synthetic oligonucleotide
aaccgcacaccgattgatcactcccccccgcgatatga

SEQ ID NO: 11430 - DNA, 35 bp, Artificial Sequence
  Synthetic oligonucleotide
atgcacatcggccttatatgcacgtgacctcccac

SEQ ID NO: 11431 - DNA, 35 bp, Artificial Sequence
  Synthetic oligonucleotide
gaacctccgccggacacacacatgcgatatttacg

SEQ ID NO: 11432 - DNA, 35 bp, Artificial Sequence
  Synthetic oligonucleotide
gaccccgctacgtatgacctacaaaattgccccgt

SEQ ID NO: 11433 - DNA, 35 bp, Artificial Sequence
  Synthetic oligonucleotide
gtggaggccctatccctgctgctgttcgtacgctt

SEQ ID NO: 11434 - DNA, 36 bp, Artificial Sequence
  Synthetic oligonucleotide
gttgccccatcaatgcgaaaaatccactacatcgaa

SEQ ID NO: 11435 - DNA, 38 bp, Artificial Sequence
  Synthetic oligonucleotide
tagggggggtgggaacgggataagaaagggttatctga

SEQ ID NO: 11436 - DNA, 37 bp, Artificial Sequence
  Synthetic oligonucleotide
gtcgcactgccctccttctcgaaacgagacccattga

SEQ ID NO: 11437 - DNA, 36 bp, Artificial Sequence
  Synthetic oligonucleotide
aacgaatgtccccgccctgtttgacctgcacactca

SEQ ID NO: 11438 - DNA, 36 bp, Artificial Sequence
  Synthetic oligonucleotide
gcacccaccattcgacggcctaagagtctggccgca

SEQ ID NO: 11439 - DNA, 35 bp, Artificial Sequence
  Synthetic oligonucleotide
gtgacatcccggtatgaggttccctgcccaccttt

SEQ ID NO: 11440 - DNA, 37 bp, Artificial Sequence
  Synthetic oligonucleotide
tacgcaacaactagcatcttagctgctcactcctgga

SEQ ID NO: 11441 - DNA, 38 bp, Artificial Sequence
  Synthetic oligonucleotide
gatccgccctcgctgtaaattgcttgaccaacatatga

SEQ ID NO: 11442 - DNA, 35 bp, Artificial Sequence
  Synthetic oligonucleotide
gccaaatgccaaatctgtcacacacgtcccatagc

SEQ ID NO: 11443 - DNA, 35 bp, Artificial Sequence
  Synthetic oligonucleotide
tccacccctatcatgtgcaatccttaacgattatc

SEQ ID NO: 11444 - DNA, 37 bp, Artificial Sequence
  Synthetic oligonucleotide
aacgagggaaggtggggaaaagactggacggtgggga

SEQ ID NO: 11445 - DNA, 38 bp, Artificial Sequence
  Synthetic oligonucleotide
tcacagggaaggaggaggggaacaaataccgacgctga

SEQ ID NO: 11446 - DNA, 35 bp, Artificial Sequence
  Synthetic oligonucleotide
aaaccaggcacgccaggacctctgcacatcccacc

SEQ ID NO: 11447 - DNA, 35 bp, Artificial Sequence
  Synthetic oligonucleotide
gagatggccccggtccgtgatttctgttctctcct

SEQ ID NO: 11448 - DNA, 35 bp, Artificial Sequence
  Synthetic oligonucleotide
tgtatcccccccgcccgacattaagggcccacgaa

SEQ ID NO: 11449 - DNA, 36 bp, Artificial Sequence
  Synthetic oligonucleotide
tccctgccggactccatggcctgatcatttttcaaa

SEQ ID NO: 11450 - DNA, 37 bp, Artificial Sequence
  Synthetic oligonucleotide
ggatgtgcgaattgggtgggaaaggggtggagggcga

SEQ ID NO: 11451 - DNA, 36 bp, Artificial Sequence
  Synthetic oligonucleotide
tcaccgcgtgcattttggccggattccatttttcta

SEQ ID NO: 11452 - DNA, 35 bp, Artificial Sequence
  Synthetic oligonucleotide
accgtgcaaacccgtatggaccgctggttgcccct

SEQ ID NO: 11453 - DNA, 36 bp, Artificial Sequence
  Synthetic oligonucleotide
gcgcccaacttgctgtgctgctcccctcctacttca

SEQ ID NO: 11454 - DNA, 35 bp, Artificial Sequence
  Synthetic oligonucleotide
atgggcggaacgggggggagggcaagttgagttac

SEQ ID NO: 11455 - DNA, 35 bp, Artificial Sequence
  Synthetic oligonucleotide
gaccattgcctagctgccccgaccacaggccgctc

SEQ ID NO: 11456 - DNA, 36 bp, Artificial Sequence
  Synthetic oligonucleotide
gagggcgtagggggaaagggctgagcagctggcaga

SEQ ID NO: 11457 - DNA, 37 bp, Artificial Sequence
  Synthetic oligonucleotide
ataccacccccctgtgcgattaaaaccaccccgtaga

SEQ ID NO: 11458 - DNA, 37 bp, Artificial Sequence
  Synthetic oligonucleotide
acaccgtaccactccctgctattcctcgcgtgagcga

SEQ ID NO: 11459 - DNA, 35 bp, Artificial Sequence
  Synthetic oligonucleotide
tcccgcgccgtccctctacactccatggcgaacat

SEQ ID NO: 11460 - DNA, 35 bp, Artificial Sequence
  Synthetic oligonucleotide
atgtgcatcctttcgtgcatgttacctaccaccca

SEQ ID NO: 11461 - DNA, 37 bp, Artificial Sequence
  Synthetic oligonucleotide
actaacgagagcataggtgggatggaacggaggggga

SEQ ID NO: 11462 - DNA, 35 bp, Artificial Sequence
  Synthetic oligonucleotide
accgttaccactgactcatgtctttccgccccccg

SEQ ID NO: 11463 - DNA, 35 bp, Artificial Sequence
  Synthetic oligonucleotide
gcccttaccacctaatctatgacgtacacccttcg

SEQ ID NO: 11464 - DNA, 36 bp, Artificial Sequence
  Synthetic oligonucleotide
gttcgctcacgtccacggtttgatcccttctgcgca

SEQ ID NO: 11465 - DNA, 37 bp, Artificial Sequence
  Synthetic oligonucleotide
gatgctgtgccgacactccccccttggacatggccga

SEQ ID NO: 11466 - DNA, 37 bp, Artificial Sequence
  Synthetic oligonucleotide
ggacggagggccacgaagggttgggaggagcaacgga

SEQ ID NO: 11467 - DNA, 37 bp, Artificial Sequence
  Synthetic oligonucleotide
gacacctccacgtaacttgcatcttttattcacatga

SEQ ID NO: 11468 - DNA, 35 bp, Artificial Sequence
  Synthetic oligonucleotide
gcactcgccgttaccatatgaatctgctctatgcc

SEQ ID NO: 11469 - DNA, 36 bp, Artificial Sequence
  Synthetic oligonucleotide
actctggtaggtggaattatgggatgggggggggaa

SEQ ID NO: 11470 - DNA, 37 bp, Artificial Sequence
  Synthetic oligonucleotide
aaggatgagggaggggcgggtagggatgattgtcaga

SEQ ID NO: 11471 - DNA, 37 bp, Artificial Sequence
  Synthetic oligonucleotide
atggggataggaacgcaaggaattagggaacacagga

SEQ ID NO: 11472 - DNA, 35 bp, Artificial Sequence
  Synthetic oligonucleotide
gtgactccatgcgtggctctctctccatcccaacg

SEQ ID NO: 11473 - DNA, 36 bp, Artificial Sequence
  Synthetic oligonucleotide
gaacgaaaggaaagggctgatagggtcgggcatggg

SEQ ID NO: 11474 - DNA, 35 bp, Artificial Sequence
  Synthetic oligonucleotide
tcttcatcccccgagagtttgcactccctattggt

SEQ ID NO: 11475 - DNA, 36 bp, Artificial Sequence
  Synthetic oligonucleotide
actcagcacggtctcgttcctactacacacctacca

SEQ ID NO: 11476 - DNA, 37 bp, Artificial Sequence
  Synthetic oligonucleotide
gtgaacgaggtggaatagtacggcataaaacgagaga

SEQ ID NO: 11477 - DNA, 36 bp, Artificial Sequence
  Synthetic oligonucleotide
cccgagaacgctccacgttcatacagtcccctgtga

SEQ ID NO: 11478 - DNA, 36 bp, Artificial Sequence
  Synthetic oligonucleotide
tgccatccccggtatataccgcccccttcggcctca

SEQ ID NO: 11479 - DNA, 35 bp, Artificial Sequence
  Synthetic oligonucleotide
ggacccaccgtgttatctatatgattctcctgtca

SEQ ID NO: 11480 - DNA, 37 bp, Artificial Sequence
  Synthetic oligonucleotide
gaacgagggcactgtggagtaggcggctaggaaagga

SEQ ID NO: 11481 - DNA, 38 bp, Artificial Sequence
  Synthetic oligonucleotide
gctgcccagccctgtctctatcgatttccctcagctga

SEQ ID NO: 11482 - DNA, 38 bp, Artificial Sequence
  Synthetic oligonucleotide
tacgcgacctgagcggtactccacacacctcccgttga

SEQ ID NO: 11483 - DNA, 38 bp, Artificial Sequence
  Synthetic oligonucleotide
gcaccacgccaccaactcccgtttctaccaccgggtga

SEQ ID NO: 11484 - DNA, 35 bp, Artificial Sequence
  Synthetic oligonucleotide
ttcatccgccgggccctaatggtccagggcttttc

SEQ ID NO: 11485 - DNA, 35 bp, Artificial Sequence
  Synthetic oligonucleotide
tcgcatttgcaccatcctgacatgtcccttcatct

SEQ ID NO: 11486 - DNA, 38 bp, Artificial Sequence
  Synthetic oligonucleotide
tcaccacccggccctatcgaacacagcgtcaaccctga

SEQ ID NO: 11487 - DNA, 35 bp, Artificial Sequence
  Synthetic oligonucleotide
atgaccccgccaactatatcgctactcatggttac

SEQ ID NO: 11488 - DNA, 35 bp, Artificial Sequence
  Synthetic oligonucleotide
aagccaccagtagccacgctcatgaccttgcaccc

SEQ ID NO: 11489 - DNA, 35 bp, Artificial Sequence
  Synthetic oligonucleotide
tttcgggcgcaaactcgtttactctgcttttctcc

SEQ ID NO: 11490 - DNA, 35 bp, Artificial Sequence
  Synthetic oligonucleotide
gcattcactcgctcccaaccccgtcggtgccccgc

SEQ ID NO: 11491 - DNA, 35 bp, Artificial Sequence
  Synthetic oligonucleotide
tccccccgctaccctgcggagaaagttacttcctc

SEQ ID NO: 11492 - DNA, 36 bp, Artificial Sequence
  Synthetic oligonucleotide
gcctccccggccagtgcgtactatacttacatcgga

SEQ ID NO: 11493 - DNA, 35 bp, Artificial Sequence
  Synthetic oligonucleotide
gtgcgccttgactgcctgtctccttcgcccgtatt

SEQ ID NO: 11494 - DNA, 35 bp, Artificial Sequence
  Synthetic oligonucleotide
gggacgctggggaaaacacagaggggtcaagaggg

SEQ ID NO: 11495 - DNA, 38 bp, Artificial Sequence
  Synthetic oligonucleotide
acacacctcccagtattataaccgccgattgtcgctga

SEQ ID NO: 11496 - DNA, 35 bp, Artificial Sequence
  Synthetic oligonucleotide
acccaactctcacatgggcttatcttcccagactt

SEQ ID NO: 11497 - DNA, 35 bp, Artificial Sequence
  Synthetic oligonucleotide
taccccaaccgctcgatataaacacgtgtccattt

SEQ ID NO: 11498 - DNA, 36 bp, Artificial Sequence
  Synthetic oligonucleotide
aaccccccaaagtgtcatgaccaccccccctgttca

SEQ ID NO: 11499 - DNA, 37 bp, Artificial Sequence
  Synthetic oligonucleotide
tccgttccccgcatcacatactcgacgtaagtaccga

SEQ ID NO: 11500 - DNA, 38 bp, Artificial Sequence
  Synthetic oligonucleotide
accatcacaagctggctatcgccacatacactcactga

SEQ ID NO: 11501 - DNA, 37 bp, Artificial Sequence
  Synthetic oligonucleotide
gtcacgcacttcctttgcgttagcttcccatccttga

SEQ ID NO: 11502 - DNA, 35 bp, Artificial Sequence
  Synthetic oligonucleotide
gtgtgattccgcccgatcgtctcctgtaccaaaac

SEQ ID NO: 11503 - DNA, 35 bp, Artificial Sequence
  Synthetic oligonucleotide
ggacacgtgctaccaggtttctgcgctttctctgt

SEQ ID NO: 11504 - DNA, 36 bp, Artificial Sequence
  Synthetic oligonucleotide
accatactcccgccgattgccagtttccaggtcaca

SEQ ID NO: 11505 - DNA, 35 bp, Artificial Sequence
  Synthetic oligonucleotide
ggatcgccactcgcgttccaccaatctcattttga

SEQ ID NO: 11506 - DNA, 35 bp, Artificial Sequence
  Synthetic oligonucleotide
acgacgacgcaaacttgcactccttccccaacgtt

SEQ ID NO: 11507 - DNA, 34 bp, Artificial Sequence
  Synthetic oligonucleotide
tcccagcgcttaggccagaccccacatattacac

SEQ ID NO: 11508 - DNA, 38 bp, Artificial Sequence
  Synthetic oligonucleotide
gccgcaaaaccgctggtgattgccccttctcctactga

SEQ ID NO: 11509 - DNA, 35 bp, Artificial Sequence
  Synthetic oligonucleotide
tcgatcggggccctcattgtctccacacgcctcta

SEQ ID NO: 11510 - DNA, 35 bp, Artificial Sequence
  Synthetic oligonucleotide
gcgccgctgccccgaacttccatcattttgcccag

SEQ ID NO: 11511 - DNA, 36 bp, Artificial Sequence
  Synthetic oligonucleotide
gataagagggaggcggtgtggtggggagcttgaaaa

SEQ ID NO: 11512 - DNA, 37 bp, Artificial Sequence
  Synthetic oligonucleotide
aaacggtcaacaggaggaagggtgatcggctggggga

SEQ ID NO: 11513 - DNA, 38 bp, Artificial Sequence
  Synthetic oligonucleotide
gctcaagaaccggaaaggagggggagcgagactgctga

SEQ ID NO: 11514 - DNA, 36 bp, Artificial Sequence
  Synthetic oligonucleotide
gagaactggccaatatgtaacgccccctattccata

SEQ ID NO: 11515 - DNA, 35 bp, Artificial Sequence
  Synthetic oligonucleotide
gacccgtcttggcctccctactctgtcctccagac

SEQ ID NO: 11516 - DNA, 35 bp, Artificial Sequence
  Synthetic oligonucleotide
atgctccatcctgccgttgaaatacgcatgttttg

SEQ ID NO: 11517 - DNA, 35 bp, Artificial Sequence
  Synthetic oligonucleotide
gatgatgacgccaccagataatcgccctgcccgtt

SEQ ID NO: 11518 - DNA, 35 bp, Artificial Sequence
  Synthetic oligonucleotide
atccccactacacgtcgcataggcataatgcgcca

SEQ ID NO: 11519 - DNA, 37 bp, Artificial Sequence
  Synthetic oligonucleotide
gcatgtggcccctgttcgccagccctcccctccgaga

SEQ ID NO: 11520 - DNA, 35 bp, Artificial Sequence
  Synthetic oligonucleotide
tccgtcgtccaggccctccggaagcttcttaccct

SEQ ID NO: 11521 - DNA, 37 bp, Artificial Sequence
  Synthetic oligonucleotide
gacaccctccatgtccccgattcgcgttctttcccga

SEQ ID NO: 11522 - DNA, 36 bp, Artificial Sequence
  Synthetic oligonucleotide
actccccactcgcgtgctcctacggaatgtcttcga

SEQ ID NO: 11523 - DNA, 36 bp, Artificial Sequence
  Synthetic oligonucleotide
gatagccagtgcgggcggagggagcgggcggaagga

SEQ ID NO: 11524 - DNA, 35 bp, Artificial Sequence
  Synthetic oligonucleotide
tgatccactccgagggcattaccttattgtgcttc

SEQ ID NO: 11525 - DNA, 35 bp, Artificial Sequence
  Synthetic oligonucleotide
ttaccgtctcacgcttttctcctcgccgccctctg

SEQ ID NO: 11526 - DNA, 35 bp, Artificial Sequence
  Synthetic oligonucleotide
gaccacgggggtagtgggcgggggggttgatgcaa

SEQ ID NO: 11527 - DNA, 35 bp, Artificial Sequence
  Synthetic oligonucleotide
tgccacgacgtgatctcacacgaatagtttcccat

SEQ ID NO: 11528 - DNA, 35 bp, Artificial Sequence
  Synthetic oligonucleotide
ttgacacgctgacttagcgctttacacttttactt

SEQ ID NO: 11529 - DNA, 35 bp, Artificial Sequence
  Synthetic oligonucleotide
acgagacgcagccgttcgtacccctattcctccca

SEQ ID NO: 11530 - DNA, 35 bp, Artificial Sequence
  Synthetic oligonucleotide
ggactgtgcatgcgtgcgccggttccctgtttttc

SEQ ID NO: 11531 - DNA, 36 bp, Artificial Sequence
  Synthetic oligonucleotide
tcgaacgacccgacttgtctatctttctcttctcta

SEQ ID NO: 11532 - DNA, 35 bp, Artificial Sequence
  Synthetic oligonucleotide
acagcatggtctaaatgttgtgtgtgtgtgtgtgt

SEQ ID NO: 11533 - DNA, 36 bp, Artificial Sequence
  Synthetic oligonucleotide
accgatgccgccgctgaattcccaccttaccgtcca

SEQ ID NO: 11534 - DNA, 35 bp, Artificial Sequence
  Synthetic oligonucleotide
gaacctgcccttcttgatcgtttaaatcctttcaa

SEQ ID NO: 11535 - DNA, 35 bp, Artificial Sequence
  Synthetic oligonucleotide
tcctcgttgtgccacgatctataccactgttacct

SEQ ID NO: 11536 - DNA, 37 bp, Artificial Sequence
  Synthetic oligonucleotide
tactctcgaccatcacttgccacagccaccctcgcga

SEQ ID NO: 11537 - DNA, 37 bp, Artificial Sequence
  Synthetic oligonucleotide
ttcacacccgcctggaaatcatctacccctactggga

SEQ ID NO: 11538 - DNA, 36 bp, Artificial Sequence
  Synthetic oligonucleotide
atttgggacaggagagtgggcggaaagggcgggata

SEQ ID NO: 11539 - DNA, 35 bp, Artificial Sequence
  Synthetic oligonucleotide
tcctagccattctcgcgctatttgttccgctctca

SEQ ID NO: 11540 - DNA, 38 bp, Artificial Sequence
  Synthetic oligonucleotide
ttcacatcaggtagatcaacccaccaccgtccacctga

SEQ ID NO: 11541 - DNA, 36 bp, Artificial Sequence
  Synthetic oligonucleotide
gactgtacagacgtcgtcctggtccttccacttcca

SEQ ID NO: 11542 - DNA, 38 bp, Artificial Sequence
  Synthetic oligonucleotide
atccgccctccctccaagggttatcccgacgttactga

SEQ ID NO: 11543 - DNA, 37 bp, Artificial Sequence
  Synthetic oligonucleotide
atccgcacgccacgcaatggaccactctccgacctga

SEQ ID NO: 11544 - DNA, 34 bp, Artificial Sequence
  Synthetic oligonucleotide
acacccatttattaccgaaccctctgctgtggcc

SEQ ID NO: 11545 - DNA, 35 bp, Artificial Sequence
  Synthetic oligonucleotide
tcatagctgacctggcattcgcaccttctcccgtt

SEQ ID NO: 11546 - DNA, 36 bp, Artificial Sequence
  Synthetic oligonucleotide
acacctggttctccgagtacctcttgccccttggaa

SEQ ID NO: 11547 - DNA, 35 bp, Artificial Sequence
  Synthetic oligonucleotide
tgacccacccctcgatttttcgtattggcctgact

SEQ ID NO: 11548 - DNA, 38 bp, Artificial Sequence
  Synthetic oligonucleotide
accgattccgcgtccattgcccctctcgttttgtctga

SEQ ID NO: 11549 - DNA, 36 bp, Artificial Sequence
  Synthetic oligonucleotide
actccgcctcgcgccacgggtcgtgttaaatcttta

SEQ ID NO: 11550 - DNA, 35 bp, Artificial Sequence
  Synthetic oligonucleotide
gcccgccgccctcaccggtaagtagctacctggct

SEQ ID NO: 11551 - DNA, 35 bp, Artificial Sequence
  Synthetic oligonucleotide
gcggaaagccccgccatgtaacgccctctcccgcc

SEQ ID NO: 11552 - DNA, 35 bp, Artificial Sequence
  Synthetic oligonucleotide
gagagcatgcgccacaaggtaccgtcccgcccaat

SEQ ID NO: 11553 - DNA, 37 bp, Artificial Sequence
  Synthetic oligonucleotide
tccagtgcgctgagttgctgccattattttcctctga

SEQ ID NO: 11554 - DNA, 35 bp, Artificial Sequence
  Synthetic oligonucleotide
accactatccgttctcgtgctcctcccctgagcaa

SEQ ID NO: 11555 - DNA, 37 bp, Artificial Sequence
  Synthetic oligonucleotide
atcccgatgccccagcctttttatgtcgctacgacga

SEQ ID NO: 11556 - DNA, 37 bp, Artificial Sequence
  Synthetic oligonucleotide
gagagaccaggtaaagaatgacgggtagtgggaggga

SEQ ID NO: 11557 - DNA, 35 bp, Artificial Sequence
  Synthetic oligonucleotide
gcacaccgcgctctgttatccacctccgtctatta

SEQ ID NO: 11558 - DNA, 36 bp, Artificial Sequence
  Synthetic oligonucleotide
agatgggaccagccgtttatcactcccacaattcca

SEQ ID NO: 11559 - DNA, 35 bp, Artificial Sequence
  Synthetic oligonucleotide
tctccccgtgttcgctcttctcgcctgacttttgc

SEQ ID NO: 11560 - DNA, 35 bp, Artificial Sequence
  Synthetic oligonucleotide
taggtccaacccagcttttacctcttgactgcttt

SEQ ID NO: 11561 - DNA, 36 bp, Artificial Sequence
  Synthetic oligonucleotide
tcacaggcgtgactcatgctacacctgaccatttca

SEQ ID NO: 11562 - DNA, 36 bp, Artificial Sequence
  Synthetic oligonucleotide
tgcctaccctctatagtatgtcgcgatcctgctaac

SEQ ID NO: 11563 - DNA, 35 bp, Artificial Sequence
  Synthetic oligonucleotide
gaaactcgtcccggcttatttgcgcacatccctct

SEQ ID NO: 11564 - DNA, 37 bp, Artificial Sequence
  Synthetic oligonucleotide
agaccagccccaccgcctgtgattgtgctacctccga

SEQ ID NO: 11565 - DNA, 36 bp, Artificial Sequence
  Synthetic oligonucleotide
acccataccattgtccaattgcttcttgacacgaca

SEQ ID NO: 11566 - DNA, 37 bp, Artificial Sequence
  Synthetic oligonucleotide
atcgaacggcccgcagctccactgttcatcgcttaga

SEQ ID NO: 11567 - DNA, 37 bp, Artificial Sequence
  Synthetic oligonucleotide
tgaccgagtgacggattttttgagtgggtggtgcgga

SEQ ID NO: 11568 - DNA, 35 bp, Artificial Sequence
  Synthetic oligonucleotide
tctatgcgcgcctcggctccttgtacttttattgt

SEQ ID NO: 11569 - DNA, 37 bp, Artificial Sequence
  Synthetic oligonucleotide
gaggatcacgtaggcaaagatcgaggaggggatcgga

SEQ ID NO: 11570 - DNA, 37 bp, Artificial Sequence
  Synthetic oligonucleotide
agatggcgcaggtacgggataatacgggaatgaggga

SEQ ID NO: 11571 - DNA, 35 bp, Artificial Sequence
  Synthetic oligonucleotide
gattacgctttccctgcctcccttgttcgggtttc

SEQ ID NO: 11572 - DNA, 36 bp, Artificial Sequence
  Synthetic oligonucleotide
gagagagggaggggcgtaaccgtggctttaggatgg

SEQ ID NO: 11573 - DNA, 35 bp, Artificial Sequence
  Synthetic oligonucleotide
gagactgcggcaaatacaacccacctgtcactctg

SEQ ID NO: 11574 - DNA, 35 bp, Artificial Sequence
  Synthetic oligonucleotide
gtggggaggaacaaatggctcgtgatggtggcggt

SEQ ID NO: 11575 - DNA, 37 bp, Artificial Sequence
  Synthetic oligonucleotide
atagtggtgtggggcaaaaggcaaaacgggatgggga

SEQ ID NO: 11576 - DNA, 36 bp, Artificial Sequence
  Synthetic oligonucleotide
ttacccgcccgtaacgtgcccgaccgccttttcgta

SEQ ID NO: 11577 - DNA, 35 bp, Artificial Sequence
  Synthetic oligonucleotide
tgccactcccccttatcattttcacggccgtgacc

SEQ ID NO: 11578 - DNA, 37 bp, Artificial Sequence
  Synthetic oligonucleotide
gggtgaggggtgtgggaagggtgtcgtggcgatagga

SEQ ID NO: 11579 - DNA, 36 bp, Artificial Sequence
  Synthetic oligonucleotide
agccccacccgacgacccgattagagccgcctttta

SEQ ID NO: 11580 - DNA, 36 bp, Artificial Sequence
  Synthetic oligonucleotide
ttccccagcccaccctagcctttacagccccacgaa

SEQ ID NO: 11581 - DNA, 35 bp, Artificial Sequence
  Synthetic oligonucleotide
gacaactcagccttacttgcgacctcatataccct

SEQ ID NO: 11582 - DNA, 37 bp, Artificial Sequence
  Synthetic oligonucleotide
aatcgaaggtgccgtgagggttggcggagggggagga

SEQ ID NO: 11583 - DNA, 35 bp, Artificial Sequence
  Synthetic oligonucleotide
atgctgcaggaccggaagtgcccccctgtttcatc

SEQ ID NO: 11584 - DNA, 35 bp, Artificial Sequence
  Synthetic oligonucleotide
agaggacggggaggatcgggcgacgacaataaaca

SEQ ID NO: 11585 - DNA, 36 bp, Artificial Sequence
  Synthetic oligonucleotide
tcatgcgctctcccgtccctcggccatatgctaaca

SEQ ID NO: 11586 - DNA, 35 bp, Artificial Sequence
  Synthetic oligonucleotide
gtgccttgcatgccgtaacttactttgtgccccca

SEQ ID NO: 11587 - DNA, 38 bp, Artificial Sequence
  Synthetic oligonucleotide
tcccacctctgttcgtcagtatcgcatccacctactga

SEQ ID NO: 11588 - DNA, 35 bp, Artificial Sequence
  Synthetic oligonucleotide
gcgtccctgcaccgtaccaccccatcagcttcacc

SEQ ID NO: 11589 - DNA, 35 bp, Artificial Sequence
  Synthetic oligonucleotide
tagtaggggtgaacggaagatagggtgggcgggtg

SEQ ID NO: 11590 - DNA, 35 bp, Artificial Sequence
  Synthetic oligonucleotide
tcccccgcactctgtctaaaatgctacggttacct

SEQ ID NO: 11591 - DNA, 36 bp, Artificial Sequence
  Synthetic oligonucleotide
ttcggacccccacatcatggactcacgttccaccca

SEQ ID NO: 11592 - DNA, 37 bp, Artificial Sequence
  Synthetic oligonucleotide
ttacacaccgctctaccctgctgctccatgccagtga

SEQ ID NO: 11593 - DNA, 38 bp, Artificial Sequence
  Synthetic oligonucleotide
acgtaacgggagggagggggattgggaccagccgttga

SEQ ID NO: 11594 - DNA, 37 bp, Artificial Sequence
  Synthetic oligonucleotide
gtcaatcgcacgatatgcactttcgtttcatcttgga

SEQ ID NO: 11595 - DNA, 36 bp, Artificial Sequence
  Synthetic oligonucleotide
ttagaccatccctatcctgcttatcaagtgcctata

SEQ ID NO: 11596 - DNA, 35 bp, Artificial Sequence
  Synthetic oligonucleotide
gatcaccgtcacccatcgatcgcaatccgtttatc

SEQ ID NO: 11597 - DNA, 35 bp, Artificial Sequence
  Synthetic oligonucleotide
gtcgtaagcggaaggggcggaaggggggcgtatgg

SEQ ID NO: 11598 - DNA, 35 bp, Artificial Sequence
  Synthetic oligonucleotide
gacaaaccgcatgcccccagctggtcgtgccccat

SEQ ID NO: 11599 - DNA, 35 bp, Artificial Sequence
  Synthetic oligonucleotide
tcactgccgggcttactctcatgttccacttttga

SEQ ID NO: 11600 - DNA, 35 bp, Artificial Sequence
  Synthetic oligonucleotide
taacgcactccccttagctcacgcagactcgacac

SEQ ID NO: 11601 - DNA, 35 bp, Artificial Sequence
  Synthetic oligonucleotide
atgcccaagaatcgaacccgcctaggcccttgctc

SEQ ID NO: 11602 - DNA, 35 bp, Artificial Sequence
  Synthetic oligonucleotide
gtcccggtccctcctcaattgatcatattggtctc

SEQ ID NO: 11603 - DNA, 35 bp, Artificial Sequence
  Synthetic oligonucleotide
ggacaactacgcagctacactcgaccttccacgat

SEQ ID NO: 11604 - DNA, 37 bp, Artificial Sequence
  Synthetic oligonucleotide
gcccccatcggtgtgctgcctatcaccctctcaagga

SEQ ID NO: 11605 - DNA, 38 bp, Artificial Sequence
  Synthetic oligonucleotide
gagacccctgccaacctctgtactggatgctccagtga

SEQ ID NO: 11606 - DNA, 37 bp, Artificial Sequence
  Synthetic oligonucleotide
tcagcgaacttcgactgccttacgatcacctgcttga

SEQ ID NO: 11607 - DNA, 35 bp, Artificial Sequence
  Synthetic oligonucleotide
tgtgtccgacttcaccttggcttttggctcgattc

SEQ ID NO: 11608 - DNA, 35 bp, Artificial Sequence
  Synthetic oligonucleotide
gtcgatgtctgtctgttgccgtttcatgccctttt

SEQ ID NO: 11609 - DNA, 35 bp, Artificial Sequence
  Synthetic oligonucleotide
gtgccacatttcctgatctgctgccattgcagccc

SEQ ID NO: 11610 - DNA, 35 bp, Artificial Sequence
  Synthetic oligonucleotide
tgcctccgcgggtattgcccctgtacccacacttc

SEQ ID NO: 11611 - DNA, 35 bp, Artificial Sequence
  Synthetic oligonucleotide
gccatccacaacaatcgtatagcaatatcaccgta

SEQ ID NO: 11612 - DNA, 35 bp, Artificial Sequence
  Synthetic oligonucleotide
tctgtccagactccacatgtctcactacaaccttt

SEQ ID NO: 11613 - DNA, 35 bp, Artificial Sequence
  Synthetic oligonucleotide
gcccccccgcgtgttagactctgctcctccgtaaa

SEQ ID NO: 11614 - DNA, 38 bp, Artificial Sequence
  Synthetic oligonucleotide
gaggacatggagtacggaggaggacaaggtaggtttga

SEQ ID NO: 11615 - DNA, 37 bp, Artificial Sequence
  Synthetic oligonucleotide
aaacgtaggaggggaatggatggaactgaaacagcga

SEQ ID NO: 11616 - DNA, 35 bp, Artificial Sequence
  Synthetic oligonucleotide
actccctgttctatggcccttccaggcatattcgc

SEQ ID NO: 11617 - DNA, 35 bp, Artificial Sequence
  Synthetic oligonucleotide
gttaaccgtagcctcgacccgccgcactcacgcct

SEQ ID NO: 11618 - DNA, 38 bp, Artificial Sequence
  Synthetic oligonucleotide
taccgccagggtaccgcccctctccgttttgagcctga

SEQ ID NO: 11619 - DNA, 35 bp, Artificial Sequence
  Synthetic oligonucleotide
ttggtgtccctcccgccgtcggccttgtacctttc

SEQ ID NO: 11620 - DNA, 36 bp, Artificial Sequence
  Synthetic oligonucleotide
tcgcccctccgttatgccatcttgacttagacttaa

SEQ ID NO: 11621 - DNA, 36 bp, Artificial Sequence
  Synthetic oligonucleotide
tacccccttccagcctgtttggtgctgctccgctga

SEQ ID NO: 11622 - DNA, 37 bp, Artificial Sequence
  Synthetic oligonucleotide
gacgttcaccacgtgtgcgcctgttccatcttgctga

SEQ ID NO: 11623 - DNA, 37 bp, Artificial Sequence
  Synthetic oligonucleotide
ggaacgaggagggaggggtagggaggtttgaacttga

SEQ ID NO: 11624 - DNA, 35 bp, Artificial Sequence
  Synthetic oligonucleotide
tcgtcacaagtccttctgttgctgccacactgccc

SEQ ID NO: 11625 - DNA, 35 bp, Artificial Sequence
  Synthetic oligonucleotide
actcacccgtttcatcgctcattaagtgtccccgt

SEQ ID NO: 11626 - DNA, 35 bp, Artificial Sequence
  Synthetic oligonucleotide
tgccccactcaagttacccacaaagccacaccgcg

SEQ ID NO: 11627 - DNA, 36 bp, Artificial Sequence
  Synthetic oligonucleotide
ttcgcctcccacagccaatctaatcatcagcctcga

SEQ ID NO: 11628 - DNA, 37 bp, Artificial Sequence
  Synthetic oligonucleotide
acgagagggatggggggtggtggtaaatcgtacagga

SEQ ID NO: 11629 - DNA, 36 bp, Artificial Sequence
  Synthetic oligonucleotide
tacacgtgcactccgccacccattctttgtgcctta

SEQ ID NO: 11630 - DNA, 35 bp, Artificial Sequence
  Synthetic oligonucleotide
tccacgcaccgcaacccgacacatcccgtgacctc

SEQ ID NO: 11631 - DNA, 35 bp, Artificial Sequence
  Synthetic oligonucleotide
tatccaccgttagaccgcgatgcaccaacaccctt

SEQ ID NO: 11632 - DNA, 35 bp, Artificial Sequence
  Synthetic oligonucleotide
tgtgtcctcagccgcttgtcgttcgcactgctttt

SEQ ID NO: 11633 - DNA, 35 bp, Artificial Sequence
  Synthetic oligonucleotide
aagtcaagcctcctgttctggttcactcttgtact

SEQ ID NO: 11634 - DNA, 37 bp, Artificial Sequence
  Synthetic oligonucleotide
gtggtccctgtctgtcttccagcttctacgtttccga

SEQ ID NO: 11635 - DNA, 36 bp, Artificial Sequence
  Synthetic oligonucleotide
atccacgccaaatgcgttgcgtgtcatcttcctcta

SEQ ID NO: 11636 - DNA, 36 bp, Artificial Sequence
  Synthetic oligonucleotide
taccccgtgaccctgccgacataagccatattaaca

SEQ ID NO: 11637 - DNA, 35 bp, Artificial Sequence
  Synthetic oligonucleotide
gcacagacctccgctggggagctgcccgttatcct

SEQ ID NO: 11638 - DNA, 36 bp, Artificial Sequence
  Synthetic oligonucleotide
ttcatacctcagtctgtcaccacgctcgcacaccaa

SEQ ID NO: 11639 - DNA, 35 bp, Artificial Sequence
  Synthetic oligonucleotide
atgggtgggaaggcggggagggactaaaacgatta

SEQ ID NO: 11640 - DNA, 35 bp, Artificial Sequence
  Synthetic oligonucleotide
ttatacacgatcacaagccgaattcccccgtgccc

SEQ ID NO: 11641 - DNA, 35 bp, Artificial Sequence
  Synthetic oligonucleotide
tatgacccgcattcttcctcagatctcgttacccg

SEQ ID NO: 11642 - DNA, 35 bp, Artificial Sequence
  Synthetic oligonucleotide
tccgccgtgcccttgtcgctgcagactctctctcc

SEQ ID NO: 11643 - DNA, 35 bp, Artificial Sequence
  Synthetic oligonucleotide
gttgagcgtacactccattccctcacaccgtatgt

SEQ ID NO: 11644 - DNA, 37 bp, Artificial Sequence
  Synthetic oligonucleotide
taccgtacccacgcctctgagcccgttatcgaatcga

SEQ ID NO: 11645 - DNA, 37 bp, Artificial Sequence
  Synthetic oligonucleotide
actcaactctccgtagacatcttcttgcccattggga

SEQ ID NO: 11646 - DNA, 35 bp, Artificial Sequence
  Synthetic oligonucleotide
ggttgacgcattggaacctacagcacctataccat

SEQ ID NO: 11647 - DNA, 35 bp, Artificial Sequence
  Synthetic oligonucleotide
tccacatgtccaccaccccatctccgcaccgctaa

SEQ ID NO: 11648 - DNA, 36 bp, Artificial Sequence
  Synthetic oligonucleotide
taacaccactgccgctactatgatcctgctggacga

SEQ ID NO: 11649 - DNA, 35 bp, Artificial Sequence
  Synthetic oligonucleotide
ttatcggcccgccccgacctgcgctgaactcgtcc

SEQ ID NO: 11650 - DNA, 35 bp, Artificial Sequence
  Synthetic oligonucleotide
gatagcggccgcctttcatacgccacctcccgtgc

SEQ ID NO: 11651 - DNA, 35 bp, Artificial Sequence
  Synthetic oligonucleotide
gaccctctgtgtgcagccgattcagcctcgctcca

SEQ ID NO: 11652 - DNA, 37 bp, Artificial Sequence
  Synthetic oligonucleotide
gcgacatcgcagttctgccccccaacaccatcactga

SEQ ID NO: 11653 - DNA, 34 bp, Artificial Sequence
  Synthetic oligonucleotide
aacccctgccttcaatgataccgtcgtttctata

SEQ ID NO: 11654 - DNA, 35 bp, Artificial Sequence
  Synthetic oligonucleotide
gcgcaagtccatcatctgtccccacacccctgaac

SEQ ID NO: 11655 - DNA, 36 bp, Artificial Sequence
  Synthetic oligonucleotide
accggtgctctccttgaactgctcgtcgcatactca

SEQ ID NO: 11656 - DNA, 35 bp, Artificial Sequence
  Synthetic oligonucleotide
gaaccgcgcctagggtttcccttctttcgccctgc

SEQ ID NO: 11657 - DNA, 37 bp, Artificial Sequence
  Synthetic oligonucleotide
gaggatcacacgggtggaggaattacgggatgacgga

SEQ ID NO: 11658 - DNA, 36 bp, Artificial Sequence
  Synthetic oligonucleotide
ggtgccacgtgcctaccgtgtcgcttcgaacctcta

SEQ ID NO: 11659 - DNA, 35 bp, Artificial Sequence
  Synthetic oligonucleotide
gactcctcaccatccaaggacacgcttttaatagc

SEQ ID NO: 11660 - DNA, 38 bp, Artificial Sequence
  Synthetic oligonucleotide
ttcggtccagttccacatgcccgtttaccttgtcctga

SEQ ID NO: 11661 - DNA, 37 bp, Artificial Sequence
  Synthetic oligonucleotide
acccccccacctgtttatgtgtgctacttttggctga

SEQ ID NO: 11662 - DNA, 36 bp, Artificial Sequence
  Synthetic oligonucleotide
gacccgccaatctgtagatctccgttttcctggtta

SEQ ID NO: 11663 - DNA, 37 bp, Artificial Sequence
  Synthetic oligonucleotide
gcatgggtaaaaggcggaacaaaaggtaagtgggaga

SEQ ID NO: 11664 - DNA, 38 bp, Artificial Sequence
  Synthetic oligonucleotide
acaccttcgccccagcttgctcaatttgagtccattga

SEQ ID NO: 11665 - DNA, 35 bp, Artificial Sequence
  Synthetic oligonucleotide
gactccccctaaggcttcaagtgcctgaatccata

SEQ ID NO: 11666 - DNA, 35 bp, Artificial Sequence
  Synthetic oligonucleotide
tcagtccgagctccctcacgtactattatgctgtt

SEQ ID NO: 11667 - DNA, 38 bp, Artificial Sequence
  Synthetic oligonucleotide
tgcgggaccgcaccttccttatcgtacgcaccttttga

SEQ ID NO: 11668 - DNA, 35 bp, Artificial Sequence
  Synthetic oligonucleotide
accgccccgatggccacctcattgacctcacactc

SEQ ID NO: 11669 - DNA, 36 bp, Artificial Sequence
  Synthetic oligonucleotide
accgtcaggctcacccggtccgtaatcgaaatcaca

SEQ ID NO: 11670 - DNA, 36 bp, Artificial Sequence
  Synthetic oligonucleotide
tacacgtgagaaccgttcctatctttcgctgcacca

SEQ ID NO: 11671 - DNA, 38 bp, Artificial Sequence
  Synthetic oligonucleotide
acccccgcccctagcacgcgcaactagtacctgcctga

SEQ ID NO: 11672 - DNA, 35 bp, Artificial Sequence
  Synthetic oligonucleotide
tacactccccttccgagcctcattagagcgggact

SEQ ID NO: 11673 - DNA, 35 bp, Artificial Sequence
  Synthetic oligonucleotide
acttccacctccgttcacgtttgctaactgtgcta

SEQ ID NO: 11674 - DNA, 36 bp, Artificial Sequence
  Synthetic oligonucleotide
tccatatcgcctccctttcgtgctagccgtagttta

SEQ ID NO: 11675 - DNA, 35 bp, Artificial Sequence
  Synthetic oligonucleotide
tcaccagtgtcgcatatccacacgtccctttgcat

SEQ ID NO: 11676 - DNA, 38 bp, Artificial Sequence
  Synthetic oligonucleotide
gacagtcgcctcgccctgaataaaatatcgccctctga

SEQ ID NO: 11677 - DNA, 35 bp, Artificial Sequence
  Synthetic oligonucleotide
ttgtaccgacgtgtctactattgccgtcactcccc

SEQ ID NO: 11678 - DNA, 37 bp, Artificial Sequence
  Synthetic oligonucleotide
tccccccctcattgaaaccctacagtcgtacttcaga

SEQ ID NO: 11679 - DNA, 38 bp, Artificial Sequence
  Synthetic oligonucleotide
aatgcagtgcggagggaaaggaatggcggggatagtga

SEQ ID NO: 11680 - DNA, 36 bp, Artificial Sequence
  Synthetic oligonucleotide
acgacgaacgccctgcattaagccattacatcatta

SEQ ID NO: 11681 - DNA, 35 bp, Artificial Sequence
  Synthetic oligonucleotide
gagagcaacacgagtcccttatggcctaccaccgc

SEQ ID NO: 11682 - DNA, 35 bp, Artificial Sequence
  Synthetic oligonucleotide
gcggaaagctcaagcctgctaatttcacgtcctcc

SEQ ID NO: 11683 - DNA, 35 bp, Artificial Sequence
  Synthetic oligonucleotide
tgatgcccctagtgtcccgccatcccatgccttcc

SEQ ID NO: 11684 - DNA, 35 bp, Artificial Sequence
  Synthetic oligonucleotide
acacccctgtgtgccccccctgacaaggcgcaccg

SEQ ID NO: 11685 - DNA, 35 bp, Artificial Sequence
  Synthetic oligonucleotide
acgcgctttcctcctgggcctcacgctaatgcctt

SEQ ID NO: 11686 - DNA, 35 bp, Artificial Sequence
  Synthetic oligonucleotide
atccctcctccgctgtaactgtggtatcccatgtt

SEQ ID NO: 11687 - DNA, 35 bp, Artificial Sequence
  Synthetic oligonucleotide
gaaccacctgtcacacctactgcatgccgttctaa

SEQ ID NO: 11688 - DNA, 35 bp, Artificial Sequence
  Synthetic oligonucleotide
aacacacatcctgcgttgatgaccccggatctaca

SEQ ID NO: 11689 - DNA, 38 bp, Artificial Sequence
  Synthetic oligonucleotide
ttgtcaccctgcccgttgtaccctagttctcccgttga

SEQ ID NO: 11690 - DNA, 38 bp, Artificial Sequence
  Synthetic oligonucleotide
tcacgtgcaacttgcttggatccacttcctctctctga

SEQ ID NO: 11691 - DNA, 35 bp, Artificial Sequence
  Synthetic oligonucleotide
gcccgacccaccgaggcaattgtaccgcctgcacc

SEQ ID NO: 11692 - DNA, 35 bp, Artificial Sequence
  Synthetic oligonucleotide
tacgccgacacgccggtctcgtttttccgcatttc

SEQ ID NO: 11693 - DNA, 35 bp, Artificial Sequence
  Synthetic oligonucleotide
ttagcctgccactgcgtttctacctctctttactg

SEQ ID NO: 11694 - DNA, 35 bp, Artificial Sequence
  Synthetic oligonucleotide
tgaagcactcgcctcgattacccctctatccatac

SEQ ID NO: 11695 - DNA, 35 bp, Artificial Sequence
  Synthetic oligonucleotide
tcaccacgatcccctctaccttccgagtcacacga

SEQ ID NO: 11696 - DNA, 35 bp, Artificial Sequence
  Synthetic oligonucleotide
ttttcaggccacctactgttccgtccacacctgcc

SEQ ID NO: 11697 - DNA, 35 bp, Artificial Sequence
  Synthetic oligonucleotide
ataccgagcgccaccttccgtcatggatgcaccct

SEQ ID NO: 11698 - DNA, 37 bp, Artificial Sequence
  Synthetic oligonucleotide
tcacccatcaccagtcctgaggatctcgttctaacga

SEQ ID NO: 11699 - DNA, 37 bp, Artificial Sequence
  Synthetic oligonucleotide
atgcctcgccacactagccccaacatccatacctcga

SEQ ID NO: 11700 - DNA, 35 bp, Artificial Sequence
  Synthetic oligonucleotide
gcgacgtcggaatctcgcgcgcacccctatccgta

SEQ ID NO: 11701 - DNA, 35 bp, Artificial Sequence
  Synthetic oligonucleotide
aacccttgatcatgtcgcctgccagacctccgttc

SEQ ID NO: 11702 - DNA, 35 bp, Artificial Sequence
  Synthetic oligonucleotide
gacatgcaaggggggtgcggggagggtggttgcgt

SEQ ID NO: 11703 - DNA, 35 bp, Artificial Sequence
  Synthetic oligonucleotide
tcaccccatcacgcccagtgaggtcctggttacca

SEQ ID NO: 11704 - DNA, 35 bp, Artificial Sequence
  Synthetic oligonucleotide
atggccgtagtgccgccatctttgtttttctctgc

SEQ ID NO: 11705 - DNA, 35 bp, Artificial Sequence
  Synthetic oligonucleotide
gttacctcgttgtagttctttagtgtccctcccct

SEQ ID NO: 11706 - DNA, 35 bp, Artificial Sequence
  Synthetic oligonucleotide
tccgtaccccgcaatatgctcctgcacccattttt

SEQ ID NO: 11707 - DNA, 35 bp, Artificial Sequence
  Synthetic oligonucleotide
tggtctaagctgtaaagcctcctgtcccatccgca

SEQ ID NO: 11708 - DNA, 35 bp, Artificial Sequence
  Synthetic oligonucleotide
gcaccaccatcgcgtaacccttgggcacctgttac

SEQ ID NO: 11709 - DNA, 36 bp, Artificial Sequence
  Synthetic oligonucleotide
tgacatccaccgcctatttcttctctgacccttgca

SEQ ID NO: 11710 - DNA, 34 bp, Artificial Sequence
  Synthetic oligonucleotide
acaacgttcacgccttcctcactccagacccgta

SEQ ID NO: 11711 - DNA, 35 bp, Artificial Sequence
  Synthetic oligonucleotide
ttacccccttgccctgcctttcgtgaccctggaac

SEQ ID NO: 11712 - DNA, 36 bp, Artificial Sequence
  Synthetic oligonucleotide
tcccccccgctctgccttgtagctccgctgcgaaca

SEQ ID NO: 11713 - DNA, 36 bp, Artificial Sequence
  Synthetic oligonucleotide
aagaccaatcgcctcaatcggttccacgtacttcca

SEQ ID NO: 11714 - DNA, 36 bp, Artificial Sequence
  Synthetic oligonucleotide
tcaacgcacggctctgctcattgtcaccggatcgca

SEQ ID NO: 11715 - DNA, 35 bp, Artificial Sequence
  Synthetic oligonucleotide
acaggccgcccgaccaccaccacgtagcaacacgc

SEQ ID NO: 11716 - DNA, 36 bp, Artificial Sequence
  Synthetic oligonucleotide
gcgctccgtaccccgccccatcttcaagctggctca

SEQ ID NO: 11717 - DNA, 36 bp, Artificial Sequence
  Synthetic oligonucleotide
gcccccctagtgacaccccgcctgacatgacccgta

SEQ ID NO: 11718 - DNA, 35 bp, Artificial Sequence
  Synthetic oligonucleotide
accaccccgcgttgcttgtactacatccattcatt

SEQ ID NO: 11719 - DNA, 36 bp, Artificial Sequence
  Synthetic oligonucleotide
tttacgactggctcgtatcgaccatattcttccaca

SEQ ID NO: 11720 - DNA, 38 bp, Artificial Sequence
  Synthetic oligonucleotide
agatggacacggggggtggaattgtgcaagggcggtga

SEQ ID NO: 11721 - DNA, 35 bp, Artificial Sequence
  Synthetic oligonucleotide
agttgccaccgatcgtacgcatcctatacctgtac

SEQ ID NO: 11722 - DNA, 35 bp, Artificial Sequence
  Synthetic oligonucleotide
gccgcacacatccaagcccccgggggatcccacgc

SEQ ID NO: 11723 - DNA, 35 bp, Artificial Sequence
  Synthetic oligonucleotide
ttgtgattccgcaccatctgcataatggtaccatc

SEQ ID NO: 11724 - DNA, 35 bp, Artificial Sequence
  Synthetic oligonucleotide
tgaaaaagcccgccgtctccctccagtccaccccg

SEQ ID NO: 11725 - DNA, 38 bp, Artificial Sequence
  Synthetic oligonucleotide
tgctgccgcctggacctcgtgcctcgaccctaacatga

SEQ ID NO: 11726 - DNA, 35 bp, Artificial Sequence
  Synthetic oligonucleotide
tccactccaggctgacctattacattgcttatttt

SEQ ID NO: 11727 - DNA, 35 bp, Artificial Sequence
  Synthetic oligonucleotide
aacccacccctctaatcacccgtacctcgtccgga

SEQ ID NO: 11728 - DNA, 35 bp, Artificial Sequence
  Synthetic oligonucleotide
tcaccctctcctttgctgttgacactatccctgga

SEQ ID NO: 11729 - DNA, 36 bp, Artificial Sequence
  Synthetic oligonucleotide
gacgagccctctgttcccgccgtttcaagctgaata

SEQ ID NO: 11730 - DNA, 36 bp, Artificial Sequence
  Synthetic oligonucleotide
aacacagagggctggggggtggaatatggggctgta

SEQ ID NO: 11731 - DNA, 35 bp, Artificial Sequence
  Synthetic oligonucleotide
gctgccctcaccctaggccactcatagtacctgct

SEQ ID NO: 11732 - DNA, 36 bp, Artificial Sequence
  Synthetic oligonucleotide
gtccccgctcacctcccattcgcgtgcaccgaatta

SEQ ID NO: 11733 - DNA, 36 bp, Artificial Sequence
  Synthetic oligonucleotide
gccatcactcgcactgcatcacgtcctcttcaacaa

SEQ ID NO: 11734 - DNA, 36 bp, Artificial Sequence
  Synthetic oligonucleotide
tgcccggaaatcccacgctctacaagccactgcaca

SEQ ID NO: 11735 - DNA, 36 bp, Artificial Sequence
  Synthetic oligonucleotide
aatgcgcaccaagctgttctgataccgcacccacca

SEQ ID NO: 11736 - DNA, 35 bp, Artificial Sequence
  Synthetic oligonucleotide
ttgtccatctacagcgcgctccaggcgcaccttcc

SEQ ID NO: 11737 - DNA, 35 bp, Artificial Sequence
  Synthetic oligonucleotide
tactatcgatccaatggtctctacctgccccgctt

SEQ ID NO: 11738 - DNA, 37 bp, Artificial Sequence
  Synthetic oligonucleotide
acggaagggcggggagggtggtgtggtatcattggga

SEQ ID NO: 11739 - DNA, 35 bp, Artificial Sequence
  Synthetic oligonucleotide
accccgaaccgtactttagatgctcacaccgctgt

SEQ ID NO: 11740 - DNA, 35 bp, Artificial Sequence
  Synthetic oligonucleotide
gtggtcctccgttcgttattgtcttccgcgttatt

SEQ ID NO: 11741 - DNA, 35 bp, Artificial Sequence
  Synthetic oligonucleotide
tgatcgcaatcccgttctacgagtagccccctccc

SEQ ID NO: 11742 - DNA, 35 bp, Artificial Sequence
  Synthetic oligonucleotide
aagaggaacgggaaaatggggaatggtaggagttg

SEQ ID NO: 11743 - DNA, 35 bp, Artificial Sequence
  Synthetic oligonucleotide
agagtgccatccaccctgttccatttgcctaggct

SEQ ID NO: 11744 - DNA, 35 bp, Artificial Sequence
  Synthetic oligonucleotide
ccaggcacgcttttgcctctgtaacctttattgtc

SEQ ID NO: 11745 - DNA, 37 bp, Artificial Sequence
  Synthetic oligonucleotide
ggaaagaaggagggtgactgggggtaagggagagcga

SEQ ID NO: 11746 - DNA, 35 bp, Artificial Sequence
  Synthetic oligonucleotide
accgccgaccacagtgcgccacgagtgctttttcc

SEQ ID NO: 11747 - DNA, 37 bp, Artificial Sequence
  Synthetic oligonucleotide
gaaacgagcgtgggtaagggatggggcatacaaagga

SEQ ID NO: 11748 - DNA, 35 bp, Artificial Sequence
  Synthetic oligonucleotide
tcaaccagccgcaatcacgttcaaagctcacacgc

SEQ ID NO: 11749 - DNA, 35 bp, Artificial Sequence
  Synthetic oligonucleotide
gtagatcgtcccgagtcgccccccaactaccgtgc

SEQ ID NO: 11750 - DNA, 35 bp, Artificial Sequence
  Synthetic oligonucleotide
ttgtgtgcgctcaatctcgatcctacgtgctccct

SEQ ID NO: 11751 - DNA, 35 bp, Artificial Sequence
  Synthetic oligonucleotide
taccatgactcatggtcgccgagccaactctttca

SEQ ID NO: 11752 - DNA, 36 bp, Artificial Sequence
  Synthetic oligonucleotide
atacagcccgacgacctatatcacatgcctacccga

SEQ ID NO: 11753 - DNA, 37 bp, Artificial Sequence
  Synthetic oligonucleotide
gtctcacccgattatggctatttgtcacaccttccga

SEQ ID NO: 11754 - DNA, 35 bp, Artificial Sequence
  Synthetic oligonucleotide
gcgccgcatgcacggtcttctgccccctcagccgc

SEQ ID NO: 11755 - DNA, 35 bp, Artificial Sequence
  Synthetic oligonucleotide
aacgaatcccacccgctgtgcgacgaaacccatca

SEQ ID NO: 11756 - DNA, 35 bp, Artificial Sequence
  Synthetic oligonucleotide
accccacttatacacgccccattgcacggtgaccc

SEQ ID NO: 11757 - DNA, 35 bp, Artificial Sequence
  Synthetic oligonucleotide
tacgcatgcgattacacctgtcattgtccgcgcca

SEQ ID NO: 11758 - DNA, 35 bp, Artificial Sequence
  Synthetic oligonucleotide
gtgcggggttctcaaggaaggggaagggcaatggt

SEQ ID NO: 11759 - DNA, 35 bp, Artificial Sequence
  Synthetic oligonucleotide
attggccggtgaccccctgctctcctaccattgtt

SEQ ID NO: 11760 - DNA, 35 bp, Artificial Sequence
  Synthetic oligonucleotide
gattcctcctccaccacaggcacatgcccgtatgc

SEQ ID NO: 11761 - DNA, 35 bp, Artificial Sequence
  Synthetic oligonucleotide
gcccatcctgtacctgcttcaagagtattcctcca

SEQ ID NO: 11762 - DNA, 36 bp, Artificial Sequence
  Synthetic oligonucleotide
gcccaccctgccgtaagccgctccctgcctcggcta

SEQ ID NO: 11763 - DNA, 35 bp, Artificial Sequence
  Synthetic oligonucleotide
aacccaccacttgtcttgttttccgactgataacc

SEQ ID NO: 11764 - DNA, 35 bp, Artificial Sequence
  Synthetic oligonucleotide
tgcaacgagttgcttccatgaacctgtcaccccgt

SEQ ID NO: 11765 - DNA, 36 bp, Artificial Sequence
  Synthetic oligonucleotide
gtgccgccctgtcccaccgctatattgcgcccgtaa

SEQ ID NO: 11766 - DNA, 35 bp, Artificial Sequence
  Synthetic oligonucleotide
gaatgcggtcaatcccttggcctgtttcgttctcc

SEQ ID NO: 11767 - DNA, 33 bp, Artificial Sequence
  Synthetic oligonucleotide
acccatcggtcattctgttacatcacgtacttc

SEQ ID NO: 11768 - DNA, 37 bp, Artificial Sequence
  Synthetic oligonucleotide
gtgggtcgcgccgatcgggtaattcctagggtgggga

SEQ ID NO: 11769 - DNA, 35 bp, Artificial Sequence
  Synthetic oligonucleotide
gccccccggcacctctcatccaggacacgccttac

SEQ ID NO: 11770 - DNA, 35 bp, Artificial Sequence
  Synthetic oligonucleotide
ggtcccaccctcaatactcaagtcaggtccacatc

SEQ ID NO: 11771 - DNA, 36 bp, Artificial Sequence
  Synthetic oligonucleotide
tcatctcgccctctgttctgctcgttaattggtcca

SEQ ID NO: 11772 - DNA, 37 bp, Artificial Sequence
  Synthetic oligonucleotide
gcaacaaaaagtaaggagtagggggaacggtgggcga

SEQ ID NO: 11773 - DNA, 35 bp, Artificial Sequence
  Synthetic oligonucleotide
tctagcccccatatgtcacgtcatcgtccactggc

SEQ ID NO: 11774 - DNA, 35 bp, Artificial Sequence
  Synthetic oligonucleotide
tgaagcggtgcctagcctgctgtcctgttcctttg

SEQ ID NO: 11775 - DNA, 35 bp, Artificial Sequence
  Synthetic oligonucleotide
tgaacaatccccactctcgcgtgcgactccttcac

SEQ ID NO: 11776 - DNA, 35 bp, Artificial Sequence
  Synthetic oligonucleotide
gttatgcggggtgtgcgggtagggttgggtgtagg

SEQ ID NO: 11777 - DNA, 35 bp, Artificial Sequence
  Synthetic oligonucleotide
gccgaaacgggcataaattctacgatcctcacctg

SEQ ID NO: 11778 - DNA, 35 bp, Artificial Sequence
  Synthetic oligonucleotide
tgcctcccgtagtccccgcacatttcccttgtaga

SEQ ID NO: 11779 - DNA, 38 bp, Artificial Sequence
  Synthetic oligonucleotide
tcactgcgccgttcatagcacctgcccagctgccttga

SEQ ID NO: 11780 - DNA, 35 bp, Artificial Sequence
  Synthetic oligonucleotide
tacaggcactcagtcgtgtgccttccccctctgtg

SEQ ID NO: 11781 - DNA, 35 bp, Artificial Sequence
  Synthetic oligonucleotide
aagcccggtccccgttcttagtgctttccagccct

SEQ ID NO: 11782 - DNA, 35 bp, Artificial Sequence
  Synthetic oligonucleotide
acatccccctgcaatgtactgttcccctcaatcga

SEQ ID NO: 11783 - DNA, 35 bp, Artificial Sequence
  Synthetic oligonucleotide
tacgaccagccgccttgctctacttcacgcttaat

SEQ ID NO: 11784 - DNA, 35 bp, Artificial Sequence
  Synthetic oligonucleotide
gtaccctaccccgccgccctgaccgtacatcaccc

SEQ ID NO: 11785 - DNA, 35 bp, Artificial Sequence
  Synthetic oligonucleotide
tgccccctcgtacggctggttggtcccattcatgt

SEQ ID NO: 11786 - DNA, 35 bp, Artificial Sequence
  Synthetic oligonucleotide
tcacgcctcactttcgattacgtcacgcaggcatt

SEQ ID NO: 11787 - DNA, 36 bp, Artificial Sequence
  Synthetic oligonucleotide
gtgactacggcgctgtgcaccacgctctattgccca

SEQ ID NO: 11788 - DNA, 38 bp, Artificial Sequence
  Synthetic oligonucleotide
tacatccgccatctggcttcgggaattctgtcctctga

SEQ ID NO: 11789 - DNA, 36 bp, Artificial Sequence
  Synthetic oligonucleotide
acacccaccacccgtgcccagtaagagcaaggataa

SEQ ID NO: 11790 - DNA, 37 bp, Artificial Sequence
  Synthetic oligonucleotide
tagtccgttcagagtcgaacccacgctctcatactga

SEQ ID NO: 11791 - DNA, 36 bp, Artificial Sequence
  Synthetic oligonucleotide
gttagggacacggacgggatgaataggatggagtga

SEQ ID NO: 11792 - DNA, 35 bp, Artificial Sequence
  Synthetic oligonucleotide
attacgcctgtttgcctgatcccactacttggtgc

SEQ ID NO: 11793 - DNA, 35 bp, Artificial Sequence
  Synthetic oligonucleotide
acaccccgcttgtttactctgcgcctgacgctatt

SEQ ID NO: 11794 - DNA, 38 bp, Artificial Sequence
  Synthetic oligonucleotide
tcccaccccccaccatttgcgttatgtgagatcgttga

SEQ ID NO: 11795 - DNA, 35 bp, Artificial Sequence
  Synthetic oligonucleotide
ggatacccctctatgctctttgttgcctagcacgc

SEQ ID NO: 11796 - DNA, 35 bp, Artificial Sequence
  Synthetic oligonucleotide
aaacactcagggtcagcccctgttacgccccatct

SEQ ID NO: 11797 - DNA, 34 bp, Artificial Sequence
  Synthetic oligonucleotide
gtgccccccccgttgattaattgcatcgctcatt

SEQ ID NO: 11798 - DNA, 35 bp, Artificial Sequence
  Synthetic oligonucleotide
tctccacccactatgcatctggacatcaatgttaa

SEQ ID NO: 11799 - DNA, 37 bp, Artificial Sequence
  Synthetic oligonucleotide
gcgacgggtcgaaagggggttatttacgggaggggga

SEQ ID NO: 11800 - DNA, 36 bp, Artificial Sequence
  Synthetic oligonucleotide
gcgaggagaggggggactgggtggtagctttcggta

SEQ ID NO: 11801 - DNA, 36 bp, Artificial Sequence
  Synthetic oligonucleotide
tgtggggaggaacgggtggcaaagcagggagcgcaa

SEQ ID NO: 11802 - DNA, 35 bp, Artificial Sequence
  Synthetic oligonucleotide
attgaaccacaacacgtttcgtatgcgccccccca

SEQ ID NO: 11803 - DNA, 35 bp, Artificial Sequence
  Synthetic oligonucleotide
cccatgcgtccctctgctatttgccatctaacgtg

SEQ ID NO: 11804 - DNA, 36 bp, Artificial Sequence
  Synthetic oligonucleotide
ggtgcacctgagttctgccacctctgtcctgttcca

SEQ ID NO: 11805 - DNA, 35 bp, Artificial Sequence
  Synthetic oligonucleotide
tcatccagaatgtccattttttgtcactccacgga

SEQ ID NO: 11806 - DNA, 35 bp, Artificial Sequence
  Synthetic oligonucleotide
aaatcgcacgcatcccgcccccgcaagagattact

SEQ ID NO: 11807 - DNA, 35 bp, Artificial Sequence
  Synthetic oligonucleotide
gcgccctacgtccacgccatctcagtgaacactct

SEQ ID NO: 11808 - DNA, 35 bp, Artificial Sequence
  Synthetic oligonucleotide
tgcgcccatcgacccacccgcattgcttcttgcca

SEQ ID NO: 11809 - DNA, 35 bp, Artificial Sequence
  Synthetic oligonucleotide
tgttccctctttgtacgccttccagctttgtgccc

SEQ ID NO: 11810 - DNA, 35 bp, Artificial Sequence
  Synthetic oligonucleotide
ttgtcactacgccattgtttgcatcccagtcatcc

SEQ ID NO: 11811 - DNA, 35 bp, Artificial Sequence
  Synthetic oligonucleotide
gccactcccactggtattacctatcatcgtactgg

SEQ ID NO: 11812 - DNA, 35 bp, Artificial Sequence
  Synthetic oligonucleotide
gtcccatgcctcatcacccgtcaccccactgtaaa

SEQ ID NO: 11813 - DNA, 37 bp, Artificial Sequence
  Synthetic oligonucleotide
acccgcgcctccgttccctccgtttctagtcattaga

SEQ ID NO: 11814 - DNA, 35 bp, Artificial Sequence
  Synthetic oligonucleotide
ggagacgcctcctctgacccgttcgattttttgtc

SEQ ID NO: 11815 - DNA, 36 bp, Artificial Sequence
  Synthetic oligonucleotide
acgatgcaaagcggaatgcctctcacgccacccgaa

SEQ ID NO: 11816 - DNA, 35 bp, Artificial Sequence
  Synthetic oligonucleotide
tacccccactgtggtatggccgcatagcacacttc

SEQ ID NO: 11817 - DNA, 37 bp, Artificial Sequence
  Synthetic oligonucleotide
gatctgccaaacatccgcttattcgacccgataggga

SEQ ID NO: 11818 - DNA, 36 bp, Artificial Sequence
  Synthetic oligonucleotide
ttgactgcgcagtttagccctgttttcactatctta

SEQ ID NO: 11819 - DNA, 36 bp, Artificial Sequence
  Synthetic oligonucleotide
cagtaacagccgtcacacctttcaagcaaccggaaa

SEQ ID NO: 11820 - DNA, 35 bp, Artificial Sequence
  Synthetic oligonucleotide
tgttccctccttgtcggcttaacaccggatttacc

SEQ ID NO: 11821 - DNA, 35 bp, Artificial Sequence
  Synthetic oligonucleotide
tccttgatcgccaccggtttcccatcctgcaccca

SEQ ID NO: 11822 - DNA, 35 bp, Artificial Sequence
  Synthetic oligonucleotide
gaccgtgccccgcccgtttacccttcctgtctcca

SEQ ID NO: 11823 - DNA, 36 bp, Artificial Sequence
  Synthetic oligonucleotide
gcagtgaagcagggaaggactacaaggtaggaggga

SEQ ID NO: 11824 - DNA, 35 bp, Artificial Sequence
  Synthetic oligonucleotide
tttacacatccagtgccctgtcatacgaaatctgc

SEQ ID NO: 11825 - DNA, 35 bp, Artificial Sequence
  Synthetic oligonucleotide
gtacccccgcacgccaatagccttaccggaccctc

SEQ ID NO: 11826 - DNA, 35 bp, Artificial Sequence
  Synthetic oligonucleotide
aaccacttcgccacctccgagttatcttccgaact

SEQ ID NO: 11827 - DNA, 36 bp, Artificial Sequence
  Synthetic oligonucleotide
tcatcctggtgacacgggtagggagggaccgggcaa

SEQ ID NO: 11828 - DNA, 38 bp, Artificial Sequence
  Synthetic oligonucleotide
gccaaaggaggagtgaaagggtggagaaactggactga

SEQ ID NO: 11829 - DNA, 35 bp, Artificial Sequence
  Synthetic oligonucleotide
gacacaacaggccttacgtgcgttcgcttacctca

SEQ ID NO: 11830 - DNA, 37 bp, Artificial Sequence
  Synthetic oligonucleotide
tcccatcacgacgcctatcacccagctacacctgtga

SEQ ID NO: 11831 - DNA, 35 bp, Artificial Sequence
  Synthetic oligonucleotide
tggatggggaggggggtttggcgtgggtctggcaa

SEQ ID NO: 11832 - DNA, 35 bp, Artificial Sequence
  Synthetic oligonucleotide
gggccccccgaccgcccacttcctgcgccttccca

SEQ ID NO: 11833 - DNA, 36 bp, Artificial Sequence
  Synthetic oligonucleotide
acgccgttcacactcctgtctaggcctaccctgtca

SEQ ID NO: 11834 - DNA, 34 bp, Artificial Sequence
  Synthetic oligonucleotide
tcgctaacgcagtgccgtcctttagccactccta

SEQ ID NO: 11835 - DNA, 35 bp, Artificial Sequence
  Synthetic oligonucleotide
gtgatacacggcgtcccctcccgtctggtcttatc

SEQ ID NO: 11836 - DNA, 36 bp, Artificial Sequence
  Synthetic oligonucleotide
ttcccccaccgcaccttagcgattcttacgaaccca

SEQ ID NO: 11837 - DNA, 37 bp, Artificial Sequence
  Synthetic oligonucleotide
tctacctcggggcggcggtcgcgggtttgaggaagga

SEQ ID NO: 11838 - DNA, 38 bp, Artificial Sequence
  Synthetic oligonucleotide
acccttcgccaccccgcaccctggtctttaccccgtga

SEQ ID NO: 11839 - DNA, 35 bp, Artificial Sequence
  Synthetic oligonucleotide
gcgttacaccgcccgaccgagcgcctggtcattcc

SEQ ID NO: 11840 - DNA, 35 bp, Artificial Sequence
  Synthetic oligonucleotide
atggacaatacaccccagccttctagtgcctgcct

SEQ ID NO: 11841 - DNA, 35 bp, Artificial Sequence
  Synthetic oligonucleotide
tgacacccacctgcccgtgaacgcatagaccgtct

SEQ ID NO: 11842 - DNA, 36 bp, Artificial Sequence
  Synthetic oligonucleotide
tagagggggagtggaggtatattatgttggtgcgga

SEQ ID NO: 11843 - DNA, 36 bp, Artificial Sequence
  Synthetic oligonucleotide
tgacccctggcccttgtctcgctaaatccgtgctga

SEQ ID NO: 11844 - DNA, 35 bp, Artificial Sequence
  Synthetic oligonucleotide
tctaccgtcgcaagccgcttgcccgttttttgctc

SEQ ID NO: 11845 - DNA, 36 bp, Artificial Sequence
  Synthetic oligonucleotide
gagaccccgcacgtcacgcgcctcacctaatgccca

SEQ ID NO: 11846 - DNA, 37 bp, Artificial Sequence
  Synthetic oligonucleotide
tacacccagagggtggatcgcaaaggggggagggaga

SEQ ID NO: 11847 - DNA, 38 bp, Artificial Sequence
  Synthetic oligonucleotide
gcctccaccatcccgtcaccgacagaacacgttagtga

SEQ ID NO: 11848 - DNA, 36 bp, Artificial Sequence
  Synthetic oligonucleotide
atacaccgccgagaaatagttccccggtccgcctta

SEQ ID NO: 11849 - DNA, 35 bp, Artificial Sequence
  Synthetic oligonucleotide
atccccccgctagcatacggtgaaacaccactcca

SEQ ID NO: 11850 - DNA, 37 bp, Artificial Sequence
  Synthetic oligonucleotide
tcttgcacggtgggggggaggggcacggaatggagga

SEQ ID NO: 11851 - DNA, 35 bp, Artificial Sequence
  Synthetic oligonucleotide
ttgtctgcctcaccgcttctttgtacttttgcttt

SEQ ID NO: 11852 - DNA, 35 bp, Artificial Sequence
  Synthetic oligonucleotide
ggatgcacctccatgccaagccattcctgctatac

SEQ ID NO: 11853 - DNA, 35 bp, Artificial Sequence
  Synthetic oligonucleotide
gctcccgtccgttttgacgcataacgccctacccc

SEQ ID NO: 11854 - DNA, 35 bp, Artificial Sequence
  Synthetic oligonucleotide
tacgcgcgcgtaaatcgtttcaatttttttgggtt

SEQ ID NO: 11855 - DNA, 36 bp, Artificial Sequence
  Synthetic oligonucleotide
ttgtagcacctcccacccatgcgctcctttggtcaa

SEQ ID NO: 11856 - DNA, 36 bp, Artificial Sequence
  Synthetic oligonucleotide
tacgctgccccggatcccctgcttcacttgggcaca

SEQ ID NO: 11857 - DNA, 36 bp, Artificial Sequence
  Synthetic oligonucleotide
ttagcacgctgctcgtacaattccaggcctcctaca

SEQ ID NO: 11858 - DNA, 35 bp, Artificial Sequence
  Synthetic oligonucleotide
ttccccgtccctctcagatactgttctgcttcctc

SEQ ID NO: 11859 - DNA, 37 bp, Artificial Sequence
  Synthetic oligonucleotide
tgtatacccccggattctatcgacctgtcacctccga

SEQ ID NO: 11860 - DNA, 35 bp, Artificial Sequence
  Synthetic oligonucleotide
ggaacccttcaccatgcgattgttgccacgctttt

SEQ ID NO: 11861 - DNA, 38 bp, Artificial Sequence
  Synthetic oligonucleotide
tacgtcccaccaccccgcagctctcttcgctgacttga

SEQ ID NO: 11862 - DNA, 35 bp, Artificial Sequence
  Synthetic oligonucleotide
ttccccccgcccatcctggtgtctgcaaacgctac

SEQ ID NO: 11863 - DNA, 35 bp, Artificial Sequence
  Synthetic oligonucleotide
tgccgatcccccatggtcacctttccgtcgccgaa

SEQ ID NO: 11864 - DNA, 36 bp, Artificial Sequence
  Synthetic oligonucleotide
ttgtccccacgcaccagaactttcattatgcagcca

SEQ ID NO: 11865 - DNA, 36 bp, Artificial Sequence
  Synthetic oligonucleotide
aatggtccacggtctaatcatgccagcccaccccta

SEQ ID NO: 11866 - DNA, 35 bp, Artificial Sequence
  Synthetic oligonucleotide
accgcatcggtgctcgttccttgctcctggccgcc

SEQ ID NO: 11867 - DNA, 35 bp, Artificial Sequence
  Synthetic oligonucleotide
tcctctcacccattgttacacgtgtctgttactcc

SEQ ID NO: 11868 - DNA, 35 bp, Artificial Sequence
  Synthetic oligonucleotide
tacgaccatgccatagctctctacctttggggaat

SEQ ID NO: 11869 - DNA, 37 bp, Artificial Sequence
  Synthetic oligonucleotide
taacacggcggttaggggaggtacgggtgggaatgga

SEQ ID NO: 11870 - DNA, 38 bp, Artificial Sequence
  Synthetic oligonucleotide
tcgcaaagtagcatgcctacacaacacctgcccaatga

SEQ ID NO: 11871 - DNA, 38 bp, Artificial Sequence
  Synthetic oligonucleotide
aaggagggacgggagggacatggggcgcacctttgtga

SEQ ID NO: 11872 - DNA, 37 bp, Artificial Sequence
  Synthetic oligonucleotide
gaacgccctcctgctttgtttttgtatgactacttga

SEQ ID NO: 11873 - DNA, 32 bp, Artificial Sequence
  Synthetic oligonucleotide
agtacgccctttccccccctgccggatacgca

SEQ ID NO: 11874 - DNA, 35 bp, Artificial Sequence
  Synthetic oligonucleotide
tcacgccccctcacatccccaaaatctgcaaagtg

SEQ ID NO: 11875 - DNA, 35 bp, Artificial Sequence
  Synthetic oligonucleotide
agccccccagccgcgtggtccctacctactatccc

SEQ ID NO: 11876 - DNA, 35 bp, Artificial Sequence
  Synthetic oligonucleotide
gttccgcctccgacctgtcacgattcgtgcttcgc

SEQ ID NO: 11877 - DNA, 35 bp, Artificial Sequence
  Synthetic oligonucleotide
gcccatccaggtgcacgctaagcgcctccaccact

SEQ ID NO: 11878 - DNA, 36 bp, Artificial Sequence
  Synthetic oligonucleotide
ttggccaagcctgcagcaattaccgctccctccgta

SEQ ID NO: 11879 - DNA, 35 bp, Artificial Sequence
  Synthetic oligonucleotide
atctctctcgttacctcgccagccatttctgcctg

SEQ ID NO: 11880 - DNA, 36 bp, Artificial Sequence
  Synthetic oligonucleotide
tgaggggcacacgttactgcacttatctccaacaca

SEQ ID NO: 11881 - DNA, 35 bp, Artificial Sequence
  Synthetic oligonucleotide
tgaggtactccacccgtacctcgcatgtttacacc

SEQ ID NO: 11882 - DNA, 35 bp, Artificial Sequence
  Synthetic oligonucleotide
tgtcatgccctcatcccccccacgtagttgcactg

SEQ ID NO: 11883 - DNA, 35 bp, Artificial Sequence
  Synthetic oligonucleotide
tcaacatgccctctgaaattgctacacattgtcga

SEQ ID NO: 11884 - DNA, 37 bp, Artificial Sequence
  Synthetic oligonucleotide
ttcacaggcaaccctctcctcccccgtccagtcagga

SEQ ID NO: 11885 - DNA, 38 bp, Artificial Sequence
  Synthetic oligonucleotide
gccatggccggatgtctctttttggtttgtgcacttga

SEQ ID NO: 11886 - DNA, 35 bp, Artificial Sequence
  Synthetic oligonucleotide
tcacgagcctctcgcccgttgccaccgcccgttta

SEQ ID NO: 11887 - DNA, 35 bp, Artificial Sequence
  Synthetic oligonucleotide
gtaccgctcgctacgtcactccgtccatcccgcgc

SEQ ID NO: 11888 - DNA, 35 bp, Artificial Sequence
  Synthetic oligonucleotide
atcgccccttcaccgcttaatgcaggctctcatag

SEQ ID NO: 11889 - DNA, 36 bp, Artificial Sequence
  Synthetic oligonucleotide
gatgccatcagccactctgccaattatccgcataca

SEQ ID NO: 11890 - DNA, 35 bp, Artificial Sequence
  Synthetic oligonucleotide
ttaccctacactgttctatacgaccaacttgtggc

SEQ ID NO: 11891 - DNA, 35 bp, Artificial Sequence
  Synthetic oligonucleotide
tccttacggagcgcccggctactcactcaccttca

SEQ ID NO: 11892 - DNA, 35 bp, Artificial Sequence
  Synthetic oligonucleotide
gagcaagcgcgattactctcctgttgctgcccacc

SEQ ID NO: 11893 - DNA, 35 bp, Artificial Sequence
  Synthetic oligonucleotide
tcagtgcaactccaacctcccaatcggtacacgcg

SEQ ID NO: 11894 - DNA, 35 bp, Artificial Sequence
  Synthetic oligonucleotide
tgccatgtcaccacgtcttcctgtctatgtactgt

SEQ ID NO: 11895 - DNA, 35 bp, Artificial Sequence
  Synthetic oligonucleotide
tcagtcatcccagcaacactcttggttaggtccta

SEQ ID NO: 11896 - DNA, 36 bp, Artificial Sequence
  Synthetic oligonucleotide
tgccatcttccggtctgcctaactagtcacgtctta

SEQ ID NO: 11897 - DNA, 35 bp, Artificial Sequence
  Synthetic oligonucleotide
aatggcccgccccctcgcacggttccggtggcacc

SEQ ID NO: 11898 - DNA, 35 bp, Artificial Sequence
  Synthetic oligonucleotide
actcactccttcagctccaccccgcccggtagacc

SEQ ID NO: 11899 - DNA, 35 bp, Artificial Sequence
  Synthetic oligonucleotide
acatcaacgaccgcgcgaactccccctcattggac

SEQ ID NO: 11900 - DNA, 35 bp, Artificial Sequence
  Synthetic oligonucleotide
ttgataggcacatggctacctcgctttacgctacc

SEQ ID NO: 11901 - DNA, 35 bp, Artificial Sequence
  Synthetic oligonucleotide
tccccacgtgtgctatctccaccagcgagttttcc

SEQ ID NO: 11902 - DNA, 35 bp, Artificial Sequence
  Synthetic oligonucleotide
taagccaggcccgccgtttgtgcgccatccttact

SEQ ID NO: 11903 - DNA, 38 bp, Artificial Sequence
  Synthetic oligonucleotide
actccacacaggacatctgctgaatatgccccacttga

SEQ ID NO: 11904 - DNA, 36 bp, Artificial Sequence
  Synthetic oligonucleotide
tgttcggaagggagggagagggtagggataatatga

SEQ ID NO: 11905 - DNA, 35 bp, Artificial Sequence
  Synthetic oligonucleotide
accgttcgtacgccgactcccctttgccctgtgag

SEQ ID NO: 11906 - DNA, 35 bp, Artificial Sequence
  Synthetic oligonucleotide
acctgatgcatgcattcaccaccagtcacaccttt

SEQ ID NO: 11907 - DNA, 35 bp, Artificial Sequence
  Synthetic oligonucleotide
ttagccacacgttgaacatccctttccttcctggt

SEQ ID NO: 11908 - DNA, 37 bp, Artificial Sequence
  Synthetic oligonucleotide
gcgcacccgctgcacctcgacaccgctgtaaaaccga

SEQ ID NO: 11909 - DNA, 35 bp, Artificial Sequence
  Synthetic oligonucleotide
tcacctgcgtccctttattaggtcacgtttcttcc

SEQ ID NO: 11910 - DNA, 35 bp, Artificial Sequence
  Synthetic oligonucleotide
ttattcgcactcaggcctctctgtcacactcgttt

SEQ ID NO: 11911 - DNA, 34 bp, Artificial Sequence
  Synthetic oligonucleotide
tgtaacccatttgttcacgccgaacccttgcccc

SEQ ID NO: 11912 - DNA, 36 bp, Artificial Sequence
  Synthetic oligonucleotide
gtgtgcctcaccgcctcttagcatgacttgacgaca

SEQ ID NO: 11913 - DNA, 36 bp, Artificial Sequence
  Synthetic oligonucleotide
ttcaccactgcccgtcgcggaaccaagtccacctca

SEQ ID NO: 11914 - DNA, 37 bp, Artificial Sequence
  Synthetic oligonucleotide
tgtcgccacacgcctcaacggccacagaactctctga

SEQ ID NO: 11915 - DNA, 35 bp, Artificial Sequence
  Synthetic oligonucleotide
agtgtccgcgattagcctgtcctttgtcaccacca

SEQ ID NO: 11916 - DNA, 35 bp, Artificial Sequence
  Synthetic oligonucleotide
tccactgcacggacccgcaccgtccattctcatca

SEQ ID NO: 11917 - DNA, 38 bp, Artificial Sequence
  Synthetic oligonucleotide
atcgccacggccgactcctttacaccgtgttccactga

SEQ ID NO: 11918 - DNA, 38 bp, Artificial Sequence
  Synthetic oligonucleotide
gcacgggagcacattcaagagggagcgggggagggtga

SEQ ID NO: 11919 - DNA, 35 bp, Artificial Sequence
  Synthetic oligonucleotide
atctaactgctcgcaagccctacgtccctgctgcc

SEQ ID NO: 11920 - DNA, 35 bp, Artificial Sequence
  Synthetic oligonucleotide
tcattgccccaatcctacctgtgagaaccaaatgt

SEQ ID NO: 11921 - DNA, 36 bp, Artificial Sequence
  Synthetic oligonucleotide
gcctcaccgactgtctactgcaactagctccgccta

SEQ ID NO: 11922 - DNA, 35 bp, Artificial Sequence
  Synthetic oligonucleotide
gttttgaccgctgccacgccttcttctagttactc

SEQ ID NO: 11923 - DNA, 35 bp, Artificial Sequence
  Synthetic oligonucleotide
atcggacatacctacactgcctcctcacctactgg

SEQ ID NO: 11924 - DNA, 35 bp, Artificial Sequence
  Synthetic oligonucleotide
ttcgacgacacaatttctgcctcacggcctccgtg

SEQ ID NO: 11925 - DNA, 35 bp, Artificial Sequence
  Synthetic oligonucleotide
accccctccgttaggcaaactgctgagcccctaca

SEQ ID NO: 11926 - DNA, 38 bp, Artificial Sequence
  Synthetic oligonucleotide
ggaggtcgccacctacccgattgcctgcattactttga

SEQ ID NO: 11927 - DNA, 37 bp, Artificial Sequence
  Synthetic oligonucleotide
gattgcaaggaaaggaaagaggtggaggttggccaga

SEQ ID NO: 11928 - DNA, 35 bp, Artificial Sequence
  Synthetic oligonucleotide
cctaccgctaacccgcctggggtacacctattgca

SEQ ID NO: 11929 - DNA, 37 bp, Artificial Sequence
  Synthetic oligonucleotide
taccacggcggggtgaagggaggccgggtaagaggga

SEQ ID NO: 11930 - DNA, 38 bp, Artificial Sequence
  Synthetic oligonucleotide
atcaactgccaccgcacgtaccttataatcatgtatga

SEQ ID NO: 11931 - DNA, 35 bp, Artificial Sequence
  Synthetic oligonucleotide
tatgcaccctaacatctgttccatttccgagtgac

SEQ ID NO: 11932 - DNA, 35 bp, Artificial Sequence
  Synthetic oligonucleotide
gccccccacgttcgttttcaggccctttatccttt

SEQ ID NO: 11933 - DNA, 36 bp, Artificial Sequence
  Synthetic oligonucleotide
gtcgacgaggtgtagtgggtgggcggagaggaatga

SEQ ID NO: 11934 - DNA, 36 bp, Artificial Sequence
  Synthetic oligonucleotide
gttgggcctctgtaactgtacgtctactgcttccca

SEQ ID NO: 11935 - DNA, 37 bp, Artificial Sequence
  Synthetic oligonucleotide
tttacgccacacatgccaactacgacaccagcaacga

SEQ ID NO: 11936 - DNA, 36 bp, Artificial Sequence
  Synthetic oligonucleotide
acccacacacctgtcgccaatgcccgttacattgta

SEQ ID NO: 11937 - DNA, 35 bp, Artificial Sequence
  Synthetic oligonucleotide
acaccctcccattcgggctacgacgacgaggttct

SEQ ID NO: 11938 - DNA, 36 bp, Artificial Sequence
  Synthetic oligonucleotide
tccactacccaacagtgacctgcacagccctccgca

SEQ ID NO: 11939 - DNA, 35 bp, Artificial Sequence
  Synthetic oligonucleotide
gcatggccccgaagagcgtcaacatcctcctgcac

SEQ ID NO: 11940 - DNA, 35 bp, Artificial Sequence
  Synthetic oligonucleotide
tcctgacgttcggtctctgtttgcctttcagaaat

SEQ ID NO: 11941 - DNA, 35 bp, Artificial Sequence
  Synthetic oligonucleotide
acacagccctggaacttctcttgaaccggaccctt

SEQ ID NO: 11942 - DNA, 36 bp, Artificial Sequence
  Synthetic oligonucleotide
agatcccccgacgccacacctgtagttgtcccatca

SEQ ID NO: 11943 - DNA, 35 bp, Artificial Sequence
  Synthetic oligonucleotide
tcacgcacaggcgatagcaccatttattactgttt

SEQ ID NO: 11944 - DNA, 36 bp, Artificial Sequence
  Synthetic oligonucleotide
gttgtaaggccgagaagagaaggagtggatggcgga

SEQ ID NO: 11945 - DNA, 35 bp, Artificial Sequence
  Synthetic oligonucleotide
gccgccacaaagcctcattatagctaaacttgccc

SEQ ID NO: 11946 - DNA, 36 bp, Artificial Sequence
  Synthetic oligonucleotide
gacccgctctacctgtctctcgttttgggtaaccga

SEQ ID NO: 11947 - DNA, 37 bp, Artificial Sequence
  Synthetic oligonucleotide
gcaaaaggggtggtggaaatggtgctagtaaaggtga

SEQ ID NO: 11948 - DNA, 37 bp, Artificial Sequence
  Synthetic oligonucleotide
taacaaccgggtagacgggtaggggggggtgtttcga

SEQ ID NO: 11949 - DNA, 35 bp, Artificial Sequence
  Synthetic oligonucleotide
atcgtgccctcctacctgtaccaaaatctgtcttc

SEQ ID NO: 11950 - DNA, 38 bp, Artificial Sequence
  Synthetic oligonucleotide
atcccacgcattggcgttgtaccctcacctccctgtga

SEQ ID NO: 11951 - DNA, 35 bp, Artificial Sequence
  Synthetic oligonucleotide
ttgaattgctccttacatgccgcctggcccccgtc

SEQ ID NO: 11952 - DNA, 35 bp, Artificial Sequence
  Synthetic oligonucleotide
tacaccgtgccctattcacccatatcgcctaatgg

SEQ ID NO: 11953 - DNA, 35 bp, Artificial Sequence
  Synthetic oligonucleotide
agtcccatccggcactcactcagttcaactcccgt

SEQ ID NO: 11954 - DNA, 35 bp, Artificial Sequence
  Synthetic oligonucleotide
tgtccaccacgttttgcttgcgaggcaattcttac

SEQ ID NO: 11955 - DNA, 35 bp, Artificial Sequence
  Synthetic oligonucleotide
tgaccctcctcatagcgccgacaccaggtcgcgtt

SEQ ID NO: 11956 - DNA, 35 bp, Artificial Sequence
  Synthetic oligonucleotide
atgacccgcaccaattccgtgtgccattacccgaa

SEQ ID NO: 11957 - DNA, 36 bp, Artificial Sequence
  Synthetic oligonucleotide
agccaaccacgtcgacctttatttgctgttctacca

SEQ ID NO: 11958 - DNA, 38 bp, Artificial Sequence
  Synthetic oligonucleotide
gtacactccatggttactcacccctcattcttgattga

SEQ ID NO: 11959 - DNA, 38 bp, Artificial Sequence
  Synthetic oligonucleotide
gaagggaggccgggggggggatacgtcatttgacttga

SEQ ID NO: 11960 - DNA, 35 bp, Artificial Sequence
  Synthetic oligonucleotide
tccacactaacccgttgagtccttcccctgccgcg

SEQ ID NO: 11961 - DNA, 35 bp, Artificial Sequence
  Synthetic oligonucleotide
accgcactccgtacaacttccccatccatgttcgt

SEQ ID NO: 11962 - DNA, 35 bp, Artificial Sequence
  Synthetic oligonucleotide
gccttcaccgttagcctcttgaaccaatcctgtcg

SEQ ID NO: 11963 - DNA, 35 bp, Artificial Sequence
  Synthetic oligonucleotide
atcccccctactccgccctggatgtgccctactac

SEQ ID NO: 11964 - DNA, 35 bp, Artificial Sequence
  Synthetic oligonucleotide
tttgagtcgccctgttacgtcgagtccctactttc

SEQ ID NO: 11965 - DNA, 35 bp, Artificial Sequence
  Synthetic oligonucleotide
ttgacccccccgcaggcgttcgctatactgccgct

SEQ ID NO: 11966 - DNA, 36 bp, Artificial Sequence
  Synthetic oligonucleotide
accgccgagcccatctcttaacgtcgtttgtcctca

SEQ ID NO: 11967 - DNA, 37 bp, Artificial Sequence
  Synthetic oligonucleotide
aagggtgaggtggttaacaaatgaggcggggcgggga

SEQ ID NO: 11968 - DNA, 38 bp, Artificial Sequence
  Synthetic oligonucleotide
acacgccgcccgccgtatcaatttttctgtttgggtga

SEQ ID NO: 11969 - DNA, 35 bp, Artificial Sequence
  Synthetic oligonucleotide
atccatgccttcgattctacgacgctcaccttatc

SEQ ID NO: 11970 - DNA, 35 bp, Artificial Sequence
  Synthetic oligonucleotide
gccggaggaaaggggaatggaagaggtcgactagg

SEQ ID NO: 11971 - DNA, 35 bp, Artificial Sequence
  Synthetic oligonucleotide
accttcacccgttttcatcgagctcctgcccatat

SEQ ID NO: 11972 - DNA, 35 bp, Artificial Sequence
  Synthetic oligonucleotide
tgttcgccgcccatcttcggtgtcggtccatgccc

SEQ ID NO: 11973 - DNA, 35 bp, Artificial Sequence
  Synthetic oligonucleotide
tgcactcgggtcgccggtctgccccctactgaact

SEQ ID NO: 11974 - DNA, 36 bp, Artificial Sequence
  Synthetic oligonucleotide
ttcagcacaacctcgctggtcttcttacactatgca

SEQ ID NO: 11975 - DNA, 36 bp, Artificial Sequence
  Synthetic oligonucleotide
acattaccatgccaccactgacctgactcaagagta

SEQ ID NO: 11976 - DNA, 35 bp, Artificial Sequence
  Synthetic oligonucleotide
agcacccagacccgtaattaccgtcccattttgtg

SEQ ID NO: 11977 - DNA, 36 bp, Artificial Sequence
  Synthetic oligonucleotide
gcggtcgacgcccctccttgtcctctgccaatccga

SEQ ID NO: 11978 - DNA, 38 bp, Artificial Sequence
  Synthetic oligonucleotide
gacctccaccatttacctatcagcacagaccacgctga

SEQ ID NO: 11979 - DNA, 35 bp, Artificial Sequence
  Synthetic oligonucleotide
tcccacctttaccctggaacaaggtacacctttgc

SEQ ID NO: 11980 - DNA, 35 bp, Artificial Sequence
  Synthetic oligonucleotide
acacttgccccacgtacaccacgagacgcttctag

SEQ ID NO: 11981 - DNA, 36 bp, Artificial Sequence
  Synthetic oligonucleotide
acatagcacgcccttggtccgccccactgctttcga

SEQ ID NO: 11982 - DNA, 37 bp, Artificial Sequence
  Synthetic oligonucleotide
gcagagtgaaacggtgagggggcgggcgagggattga

SEQ ID NO: 11983 - DNA, 36 bp, Artificial Sequence
  Synthetic oligonucleotide
tacaacgtcacccctggtctagtctgctttctataa

SEQ ID NO: 11984 - DNA, 36 bp, Artificial Sequence
  Synthetic oligonucleotide
acccctgcaccatctatttccggaccgtaccctaga

SEQ ID NO: 11985 - DNA, 38 bp, Artificial Sequence
  Synthetic oligonucleotide
acgcccccccctccaccgtcctgactagtgctaactga

SEQ ID NO: 11986 - DNA, 35 bp, Artificial Sequence
  Synthetic oligonucleotide
tgatagggccgagcacgctttcaatctaccctttc

SEQ ID NO: 11987 - DNA, 36 bp, Artificial Sequence
  Synthetic oligonucleotide
gaacacatcggggaggtaaggggggttgagctcgca

SEQ ID NO: 11988 - DNA, 37 bp, Artificial Sequence
  Synthetic oligonucleotide
agaatcacaagggggactgggtagacagaggcggaga

SEQ ID NO: 11989 - DNA, 35 bp, Artificial Sequence
  Synthetic oligonucleotide
taaccccgcacgctgtttcgttgatcccgtcaccc

SEQ ID NO: 11990 - DNA, 35 bp, Artificial Sequence
  Synthetic oligonucleotide
acgaccccacccagtacccaaggaacgtattacaa

SEQ ID NO: 11991 - DNA, 37 bp, Artificial Sequence
  Synthetic oligonucleotide
gacgatgcccagttttgtctttcctttcccagttcga

SEQ ID NO: 11992 - DNA, 35 bp, Artificial Sequence
  Synthetic oligonucleotide
tctaccctgcctcaggactgccacagtacgcttct

SEQ ID NO: 11993 - DNA, 36 bp, Artificial Sequence
  Synthetic oligonucleotide
gtttgtgaccttggtcaaagtgctacaccttaccta

SEQ ID NO: 11994 - DNA, 35 bp, Artificial Sequence
  Synthetic oligonucleotide
acgcggtacaattgccattcatgcttcacattctt

SEQ ID NO: 11995 - DNA, 36 bp, Artificial Sequence
  Synthetic oligonucleotide
aacgcgcccacccccaccgcttcaacttttcgtgga

SEQ ID NO: 11996 - DNA, 37 bp, Artificial Sequence
  Synthetic oligonucleotide
gccgaaactacgctcccttatctctcagcactgctga

SEQ ID NO: 11997 - DNA, 35 bp, Artificial Sequence
  Synthetic oligonucleotide
tactcccccacttacccagactctgctggagacta

SEQ ID NO: 11998 - DNA, 35 bp, Artificial Sequence
  Synthetic oligonucleotide
taactgcgcttcgtgcttcgtcacccccccttgtc

SEQ ID NO: 11999 - DNA, 34 bp, Artificial Sequence
  Synthetic oligonucleotide
gatcaacgacttagttgataggacccaccttccg

SEQ ID NO: 12000 - DNA, 35 bp, Artificial Sequence
  Synthetic oligonucleotide
tgatgtacggggggcgggactatgggaaaatggtg

SEQ ID NO: 12001 - DNA, 35 bp, Artificial Sequence
  Synthetic oligonucleotide
gcttgtgcctgccctcgtttttttgtgatcaccta

SEQ ID NO: 12002 - DNA, 35 bp, Artificial Sequence
  Synthetic oligonucleotide
aacaccgtcacaaccctgctctctcacgattcggc

SEQ ID NO: 12003 - DNA, 35 bp, Artificial Sequence
  Synthetic oligonucleotide
atgtgacgcgaacgttattattctattagtcgacg

SEQ ID NO: 12004 - DNA, 35 bp, Artificial Sequence
  Synthetic oligonucleotide
atgcaccagcccgcttgaacttggaccctgccgat

SEQ ID NO: 12005 - DNA, 35 bp, Artificial Sequence
  Synthetic oligonucleotide
gatagccatccgcttcctctatgaccaccctaatt

SEQ ID NO: 12006 - DNA, 35 bp, Artificial Sequence
  Synthetic oligonucleotide
gagcaaacggtccgttcgctaccacagtttaccca

SEQ ID NO: 12007 - DNA, 35 bp, Artificial Sequence
  Synthetic oligonucleotide
acatcggtgagcgctgctttgccctcgttccccca

SEQ ID NO: 12008 - DNA, 35 bp, Artificial Sequence
  Synthetic oligonucleotide
acacctgccgaaacttcccctctgagcacactaac

SEQ ID NO: 12009 - DNA, 35 bp, Artificial Sequence
  Synthetic oligonucleotide
gcagacctctgctacttatcgggaaccgggccctc

SEQ ID NO: 12010 - DNA, 36 bp, Artificial Sequence
  Synthetic oligonucleotide
caccgcctcctgcccgtatccactagcctcgttcca

SEQ ID NO: 12011 - DNA, 35 bp, Artificial Sequence
  Synthetic oligonucleotide
acacggtggagcaatcgtcgacccccgccctttac

SEQ ID NO: 12012 - DNA, 35 bp, Artificial Sequence
  Synthetic oligonucleotide
tctgaacgggaaggggtagggggttgcgaaggcga

SEQ ID NO: 12013 - DNA, 35 bp, Artificial Sequence
  Synthetic oligonucleotide
tgtacccactgcgagcacactgccatatgtcctgc

SEQ ID NO: 12014 - DNA, 36 bp, Artificial Sequence
  Synthetic oligonucleotide
ttgcaagtcccttgttccgaccgcataccatcccga

SEQ ID NO: 12015 - DNA, 37 bp, Artificial Sequence
  Synthetic oligonucleotide
tcacctgtccccccgctgcccacctggctaattttga

SEQ ID NO: 12016 - DNA, 36 bp, Artificial Sequence
  Synthetic oligonucleotide
tgtctgagcacatctcccctcctttaggccgcttta

SEQ ID NO: 12017 - DNA, 35 bp, Artificial Sequence
  Synthetic oligonucleotide
acctcggtccaggtcctgtcctaacttagttgctc

SEQ ID NO: 12018 - DNA, 35 bp, Artificial Sequence
  Synthetic oligonucleotide
gccatctgcgccgattactgcacccatgtacctgt

SEQ ID NO: 12019 - DNA, 35 bp, Artificial Sequence
  Synthetic oligonucleotide
tgccaatgaagccacacagctcgccgcccttctgt

SEQ ID NO: 12020 - DNA, 36 bp, Artificial Sequence
  Synthetic oligonucleotide
actgagggtggaacgcatttataacagggggggaga

SEQ ID NO: 12021 - DNA, 35 bp, Artificial Sequence
  Synthetic oligonucleotide
gacatgcggtatgttctccccgtgcccccgtgttc

SEQ ID NO: 12022 - DNA, 36 bp, Artificial Sequence
  Synthetic oligonucleotide
tgtacgctccgtttccctgtgcgagtctactttcca

SEQ ID NO: 12023 - DNA, 36 bp, Artificial Sequence
  Synthetic oligonucleotide
gcgaagaaaggggggatgggtagggacggagggcga

SEQ ID NO: 12024 - DNA, 36 bp, Artificial Sequence
  Synthetic oligonucleotide
acctacggcgccagtaaattgcaatcccacccgctc

SEQ ID NO: 12025 - DNA, 35 bp, Artificial Sequence
  Synthetic oligonucleotide
gaatgacgggggataggaccggctgggagggattg

SEQ ID NO: 12026 - DNA, 37 bp, Artificial Sequence
  Synthetic oligonucleotide
gaagccccccttgctgatttcgccgttgtcctaacga

SEQ ID NO: 12027 - DNA, 37 bp, Artificial Sequence
  Synthetic oligonucleotide
tgtccgtccgtgcgccctcgcctcctgatatttcgga

SEQ ID NO: 12028 - DNA, 35 bp, Artificial Sequence
  Synthetic oligonucleotide
acgtgctaacccacacgtgattgtgcctgatcctc

SEQ ID NO: 12029 - DNA, 36 bp, Artificial Sequence
  Synthetic oligonucleotide
ttgactgcactcacttggttccgctttgaccttcga

SEQ ID NO: 12030 - DNA, 35 bp, Artificial Sequence
  Synthetic oligonucleotide
gatggcccgccgggtctcgttgttctttgctctac

SEQ ID NO: 12031 - DNA, 37 bp, Artificial Sequence
  Synthetic oligonucleotide
ggaaaggccggtgagggggggtggaaatataaaggga

SEQ ID NO: 12032 - DNA, 37 bp, Artificial Sequence
  Synthetic oligonucleotide
atcccccctgcattcattcgccaagcacttccggtga

SEQ ID NO: 12033 - DNA, 35 bp, Artificial Sequence
  Synthetic oligonucleotide
tgctgactgggttctggcctgttgtgcaccttttc

SEQ ID NO: 12034 - DNA, 36 bp, Artificial Sequence
  Synthetic oligonucleotide
aaaacggagaagggaggagtgtggggagggaagaga

SEQ ID NO: 12035 - DNA, 38 bp, Artificial Sequence
  Synthetic oligonucleotide
gtgcctcccgtgtctcgtgcctggcctcactcccatga

SEQ ID NO: 12036 - DNA, 35 bp, Artificial Sequence
  Synthetic oligonucleotide
tttgccctcccttctttggtccttgcccgctatga

SEQ ID NO: 12037 - DNA, 37 bp, Artificial Sequence
  Synthetic oligonucleotide
ggggagtttgaacgggcacaaggggggtgggggaaga

SEQ ID NO: 12038 - DNA, 37 bp, Artificial Sequence
  Synthetic oligonucleotide
tgccacgttctgcaaaatcctgccccactacctcgga

SEQ ID NO: 12039 - DNA, 35 bp, Artificial Sequence
  Synthetic oligonucleotide
tatgggggtagggagcaaaggagaggggtgacaaa

SEQ ID NO: 12040 - DNA, 37 bp, Artificial Sequence
  Synthetic oligonucleotide
gtgcccacctgttcgattcgtgcgcttccatcccgga

SEQ ID NO: 12041 - DNA, 35 bp, Artificial Sequence
  Synthetic oligonucleotide
tactacgcccttcctagtgccctgataaacacgta

SEQ ID NO: 12042 - DNA, 35 bp, Artificial Sequence
  Synthetic oligonucleotide
tgcctcactgccgaggtcaccatcgtaacctaacc

SEQ ID NO: 12043 - DNA, 35 bp, Artificial Sequence
  Synthetic oligonucleotide
gtaacacctgacgtcttgcgaacacggcttctcct

SEQ ID NO: 12044 - DNA, 36 bp, Artificial Sequence
  Synthetic oligonucleotide
actcccccagccgccggttcacttagtagggctaca

SEQ ID NO: 12045 - DNA, 35 bp, Artificial Sequence
  Synthetic oligonucleotide
ggattgctgtccgtttcagcccctcgactccaccg

SEQ ID NO: 12046 - DNA, 37 bp, Artificial Sequence
  Synthetic oligonucleotide
actccaatcccccgtccagcgccggccccaaacccga

SEQ ID NO: 12047 - DNA, 37 bp, Artificial Sequence
  Synthetic oligonucleotide
atcacgccggaagccgttccctttgctaacctctcga

SEQ ID NO: 12048 - DNA, 36 bp, Artificial Sequence
  Synthetic oligonucleotide
gttccaacccccatgattcgttgctttttacagaca

SEQ ID NO: 12049 - DNA, 36 bp, Artificial Sequence
  Synthetic oligonucleotide
accctgacacagtcgcatcatacgacaacaagccca

SEQ ID NO: 12050 - DNA, 35 bp, Artificial Sequence
  Synthetic oligonucleotide
aatgcctacgcgggggctactacgtctcttccacc

SEQ ID NO: 12051 - DNA, 35 bp, Artificial Sequence
  Synthetic oligonucleotide
acccgagccatccttacgtgaaacttcaacgcatg

SEQ ID NO: 12052 - DNA, 35 bp, Artificial Sequence
  Synthetic oligonucleotide
aatgacccgtgcgttctcattgccgtagtttcttt

SEQ ID NO: 12053 - DNA, 35 bp, Artificial Sequence
  Synthetic oligonucleotide
tcaacacatcacactcggtatagaccgcccgggca

SEQ ID NO: 12054 - DNA, 37 bp, Artificial Sequence
  Synthetic oligonucleotide
aagcgggtggggtgagggaaaggcggtatagtgagga

SEQ ID NO: 12055 - DNA, 38 bp, Artificial Sequence
  Synthetic oligonucleotide
gccactagggtgggacttggttacaaggggaggggtga

SEQ ID NO: 12056 - DNA, 35 bp, Artificial Sequence
  Synthetic oligonucleotide
tgacccacgtatttctctgtctgcggttgctattc

SEQ ID NO: 12057 - DNA, 35 bp, Artificial Sequence
  Synthetic oligonucleotide
gctgggtcaacgtacacactccccctctagcataa

SEQ ID NO: 12058 - DNA, 37 bp, Artificial Sequence
  Synthetic oligonucleotide
ttacggcccctgttacgctcgacctcgtcccacccga

SEQ ID NO: 12059 - DNA, 37 bp, Artificial Sequence
  Synthetic oligonucleotide
tgcccaccatcatttttcgacgtagacctgctgacga

SEQ ID NO: 12060 - DNA, 36 bp, Artificial Sequence
  Synthetic oligonucleotide
gccgggccacattccgctatgttatctcacacgcca

SEQ ID NO: 12061 - DNA, 37 bp, Artificial Sequence
  Synthetic oligonucleotide
accaccatcactcctcttattgcgaagccgcatacga

SEQ ID NO: 12062 - DNA, 36 bp, Artificial Sequence
  Synthetic oligonucleotide
gtatgtaccacccgcaacgacgtactgctttcccta

SEQ ID NO: 12063 - DNA, 36 bp, Artificial Sequence
  Synthetic oligonucleotide
atccacaaccaccacagtcatagaaagtaccatgta

SEQ ID NO: 12064 - DNA, 37 bp, Artificial Sequence
  Synthetic oligonucleotide
accatgttcaatccgtctgcatcaccgcttcctgcga

SEQ ID NO: 12065 - DNA, 36 bp, Artificial Sequence
  Synthetic oligonucleotide
acgcatccctgcactggtatagttctctttctgcta

SEQ ID NO: 12066 - DNA, 37 bp, Artificial Sequence
  Synthetic oligonucleotide
gccaccctccggggtgaggcctatccatgttcaccga

SEQ ID NO: 12067 - DNA, 36 bp, Artificial Sequence
  Synthetic oligonucleotide
tcagtcgcacgccatgccctgattgaacgatttcta

SEQ ID NO: 12068 - DNA, 34 bp, Artificial Sequence
  Synthetic oligonucleotide
actcacatccagcacactcggctctctctcgacg

SEQ ID NO: 12069 - DNA, 35 bp, Artificial Sequence
  Synthetic oligonucleotide
tatagacccccgctgtttgtaactccacgatccac

SEQ ID NO: 12070 - DNA, 36 bp, Artificial Sequence
  Synthetic oligonucleotide
gcccaccgcgttacgccgtatgtcctatccctctca

SEQ ID NO: 12071 - DNA, 37 bp, Artificial Sequence
  Synthetic oligonucleotide
gccactgtccctgtcccgattatcatctaccgcctga

SEQ ID NO: 12072 - DNA, 35 bp, Artificial Sequence
  Synthetic oligonucleotide
gtcgcccacaccccaccatttcgatgctgacatac

SEQ ID NO: 12073 - DNA, 35 bp, Artificial Sequence
  Synthetic oligonucleotide
tatcacgcccctttcgttcttgacagttgcgcttc

SEQ ID NO: 12074 - DNA, 37 bp, Artificial Sequence
  Synthetic oligonucleotide
tcaccacctctcccagcaatgtatcactgccagacac

SEQ ID NO: 12075 - DNA, 35 bp, Artificial Sequence
  Synthetic oligonucleotide
gtaacaccatcaacccccgtccgtctggtaatacc

SEQ ID NO: 12076 - DNA, 35 bp, Artificial Sequence
  Synthetic oligonucleotide
tgagtgccgccgccatctacgccacccacgtgttt

SEQ ID NO: 12077 - DNA, 35 bp, Artificial Sequence
  Synthetic oligonucleotide
tgcccccttgtcctcgtaatgatctgtctgtcgca

SEQ ID NO: 12078 - DNA, 35 bp, Artificial Sequence
  Synthetic oligonucleotide
catccgtccaacgattgcggcataactcaacctta

SEQ ID NO: 12079 - DNA, 37 bp, Artificial Sequence
  Synthetic oligonucleotide
tccagcacccgccctccgtggaatacacttagaacga

SEQ ID NO: 12080 - DNA, 35 bp, Artificial Sequence
  Synthetic oligonucleotide
ccgatgggaaggatgagggaaagggaggggtgcat

SEQ ID NO: 12081 - DNA, 35 bp, Artificial Sequence
  Synthetic oligonucleotide
gttgcatgacgctgcccacgtaactccacctagct

SEQ ID NO: 12082 - DNA, 36 bp, Artificial Sequence
  Synthetic oligonucleotide
tttgcccacacgcctctggttcatcgataagcccca

SEQ ID NO: 12083 - DNA, 35 bp, Artificial Sequence
  Synthetic oligonucleotide
acaaccagttcgccgctctcgacacgcctccatca

SEQ ID NO: 12084 - DNA, 38 bp, Artificial Sequence
  Synthetic oligonucleotide
aagccaacgcccgagtccaagcacaccaccgcctctga

SEQ ID NO: 12085 - DNA, 36 bp, Artificial Sequence
  Synthetic oligonucleotide
acagccaccgcttccatagataactgttctttctca

SEQ ID NO: 12086 - DNA, 37 bp, Artificial Sequence
  Synthetic oligonucleotide
gatccccgctgtgtccggcaccccgttcttgattcga

SEQ ID NO: 12087 - DNA, 35 bp, Artificial Sequence
  Synthetic oligonucleotide
agtacccgtgagaatctgccttctgttccttctct

SEQ ID NO: 12088 - DNA, 38 bp, Artificial Sequence
  Synthetic oligonucleotide
tgtagggccgatggggagggaatgggatgggcgggtga

SEQ ID NO: 12089 - DNA, 36 bp, Artificial Sequence
  Synthetic oligonucleotide
accccaacctgaccatggcctatatacctggcaaca

SEQ ID NO: 12090 - DNA, 35 bp, Artificial Sequence
  Synthetic oligonucleotide
gcacacgcttgaccgaatcgccatcagactgcact

SEQ ID NO: 12091 - DNA, 37 bp, Artificial Sequence
  Synthetic oligonucleotide
gcctccatccacctgcacctgtctcccactgaaggga

SEQ ID NO: 12092 - DNA, 36 bp, Artificial Sequence
  Synthetic oligonucleotide
atccccgctcacactttgccgtcaaaaacagcctga

SEQ ID NO: 12093 - DNA, 35 bp, Artificial Sequence
  Synthetic oligonucleotide
ttcgaagggggtgggagctattatatggtgggtcg

SEQ ID NO: 12094 - DNA, 35 bp, Artificial Sequence
  Synthetic oligonucleotide
ttcggaaccaccaatgcaatcgcccgcccctctgg

SEQ ID NO: 12095 - DNA, 37 bp, Artificial Sequence
  Synthetic oligonucleotide
gaatccaccacactgtttttttcctgactcgccccga

SEQ ID NO: 12096 - DNA, 37 bp, Artificial Sequence
  Synthetic oligonucleotide
gtgactgctcccgtcctctgttcctgcttcctctcga

SEQ ID NO: 12097 - DNA, 35 bp, Artificial Sequence
  Synthetic oligonucleotide
gcacctaacccgattgtcatgttcccgtcatcgcc

SEQ ID NO: 12098 - DNA, 35 bp, Artificial Sequence
  Synthetic oligonucleotide
gtagcggacctcaaagttttctctccggtgtcctt

SEQ ID NO: 12099 - DNA, 35 bp, Artificial Sequence
  Synthetic oligonucleotide
gccgggactgcgatccttttgatacttaccccttc

SEQ ID NO: 12100 - DNA, 35 bp, Artificial Sequence
  Synthetic oligonucleotide
gttggagaagataaggggaatgggaaagggcgagt

SEQ ID NO: 12101 - DNA, 36 bp, Artificial Sequence
  Synthetic oligonucleotide
ggaccattcatctgaccatgctgcactgctattgca

SEQ ID NO: 12102 - DNA, 38 bp, Artificial Sequence
  Synthetic oligonucleotide
acgctcccgtccatctggtcctgccccggtcttactga

SEQ ID NO: 12103 - DNA, 35 bp, Artificial Sequence
  Synthetic oligonucleotide
tgtgaccagcccaggtctacattccctccacttta

SEQ ID NO: 12104 - DNA, 35 bp, Artificial Sequence
  Synthetic oligonucleotide
tgtccccaccctgctaatgtcctgccggctctgac

SEQ ID NO: 12105 - DNA, 35 bp, Artificial Sequence
  Synthetic oligonucleotide
tttcgtggcggtggtggggagtaaggatggagggg

SEQ ID NO: 12106 - DNA, 35 bp, Artificial Sequence
  Synthetic oligonucleotide
aactcgcgtgtggtggtcgtggggctggggtaact

SEQ ID NO: 12107 - DNA, 36 bp, Artificial Sequence
  Synthetic oligonucleotide
gatcccgggcctcacctaccgaatgttttctgcaca

SEQ ID NO: 12108 - DNA, 38 bp, Artificial Sequence
  Synthetic oligonucleotide
tgaaccccgccccaatcgtaacttaaagccctgcatga

SEQ ID NO: 12109 - DNA, 36 bp, Artificial Sequence
  Synthetic oligonucleotide
tacgtcgcccctgattgtgctcgtgcacacacctta

SEQ ID NO: 12110 - DNA, 35 bp, Artificial Sequence
  Synthetic oligonucleotide
tacccgtgaccgccttcctgaagaactctgggccc

SEQ ID NO: 12111 - DNA, 35 bp, Artificial Sequence
  Synthetic oligonucleotide
aaccccacaattaatgcagaccgccccgccgatac

SEQ ID NO: 12112 - DNA, 35 bp, Artificial Sequence
  Synthetic oligonucleotide
ttcatcaccaaccaaggccgccacaccgctccgac

SEQ ID NO: 12113 - DNA, 35 bp, Artificial Sequence
  Synthetic oligonucleotide
tgccatgcgctcattcgccgtccctcctgatcgac

SEQ ID NO: 12114 - DNA, 35 bp, Artificial Sequence
  Synthetic oligonucleotide
tcaacacggccattcctcgcgggaccctcctgtgc

SEQ ID NO: 12115 - DNA, 35 bp, Artificial Sequence
  Synthetic oligonucleotide
gaccgccatgacctttatatagttgccctcttaat

SEQ ID NO: 12116 - DNA, 35 bp, Artificial Sequence
  Synthetic oligonucleotide
aactgcgtccgcgccaacgtctgctcacacatcat

SEQ ID NO: 12117 - DNA, 36 bp, Artificial Sequence
  Synthetic oligonucleotide
gcccagaacgaccgaccgccccgcgtattcagcaca

SEQ ID NO: 12118 - DNA, 35 bp, Artificial Sequence
  Synthetic oligonucleotide
tcaaaccccccacgggacgcctgcccggactattt

SEQ ID NO: 12119 - DNA, 35 bp, Artificial Sequence
  Synthetic oligonucleotide
tccctgttgaccccccgcatattacaggctttaga

SEQ ID NO: 12120 - DNA, 37 bp, Artificial Sequence
  Synthetic oligonucleotide
gccgattcccgccctatgttcccctcggtatcttcga

SEQ ID NO: 12121 - DNA, 35 bp, Artificial Sequence
  Synthetic oligonucleotide
tttcctgcccgagtgccgtagtctagcccacttat

SEQ ID NO: 12122 - DNA, 35 bp, Artificial Sequence
  Synthetic oligonucleotide
accatcgcgcgcattgattggcatctatcccctct

SEQ ID NO: 12123 - DNA, 38 bp, Artificial Sequence
  Synthetic oligonucleotide
gtcaccgcatttagcttagctgtcactcacgcacttga

SEQ ID NO: 12124 - DNA, 35 bp, Artificial Sequence
  Synthetic oligonucleotide
tcacgctccaagcactagctacctcacggctcacg

SEQ ID NO: 12125 - DNA, 37 bp, Artificial Sequence
  Synthetic oligonucleotide
tcgcgaagggccggcctgttctaccaccttgtttcga

SEQ ID NO: 12126 - DNA, 37 bp, Artificial Sequence
  Synthetic oligonucleotide
ggttaaggtggaaggaaaaagggcgtgcaagacgaga

SEQ ID NO: 12127 - DNA, 35 bp, Artificial Sequence
  Synthetic oligonucleotide
tttggccacacctgggccgcccttcctacccactg

SEQ ID NO: 12128 - DNA, 37 bp, Artificial Sequence
  Synthetic oligonucleotide
atgtggagcaccgggtgtgcggggtggggggtactga

SEQ ID NO: 12129 - DNA, 36 bp, Artificial Sequence
  Synthetic oligonucleotide
attgcccaacctaatcctcacgtgcggtcccctgta

SEQ ID NO: 12130 - DNA, 35 bp, Artificial Sequence
  Synthetic oligonucleotide
taacaccagctaacttccgggcctgctgctcaccc

SEQ ID NO: 12131 - DNA, 35 bp, Artificial Sequence
  Synthetic oligonucleotide
gttcaaacacaatactcgccacttccgctatgccg

SEQ ID NO: 12132 - DNA, 37 bp, Artificial Sequence
  Synthetic oligonucleotide
gtgggcgggagggggaactcaagaggaacagccggga

SEQ ID NO: 12133 - DNA, 35 bp, Artificial Sequence
  Synthetic oligonucleotide
atccacactcaatcgtttggtcgttgcaacattta

SEQ ID NO: 12134 - DNA, 35 bp, Artificial Sequence
  Synthetic oligonucleotide
gtgccgcccttcacgttcccctcgccgtcttgttt

SEQ ID NO: 12135 - DNA, 37 bp, Artificial Sequence
  Synthetic oligonucleotide
atgaagggtgagggcggttgctgaaggggaggttgga

SEQ ID NO: 12136 - DNA, 37 bp, Artificial Sequence
  Synthetic oligonucleotide
gttgtagggccaggagggtgttgggtggtggggatga

SEQ ID NO: 12137 - DNA, 35 bp, Artificial Sequence
  Synthetic oligonucleotide
aaggccgaaccaccatgcggcgctctcttgatccc

SEQ ID NO: 12138 - DNA, 35 bp, Artificial Sequence
  Synthetic oligonucleotide
atgcacgcagttcgttctgcacccctttttttgtc

SEQ ID NO: 12139 - DNA, 34 bp, Artificial Sequence
  Synthetic oligonucleotide
ggggtcatgagaagttaggggagtgggggggagg

SEQ ID NO: 12140 - DNA, 36 bp, Artificial Sequence
  Synthetic oligonucleotide
acagtcgaaagggagggatgggaggtttgtgtccaa

SEQ ID NO: 12141 - DNA, 37 bp, Artificial Sequence
  Synthetic oligonucleotide
tccgaacaacatcacacctctgcatacggaccgctga

SEQ ID NO: 12142 - DNA, 36 bp, Artificial Sequence
  Synthetic oligonucleotide
ggagtacctcacgcgcgttatcactacacacatcta

SEQ ID NO: 12143 - DNA, 35 bp, Artificial Sequence
  Synthetic oligonucleotide
gccaccccccaggcatgaacaccctacggtactcc

SEQ ID NO: 12144 - DNA, 35 bp, Artificial Sequence
  Synthetic oligonucleotide
tcacacattcctgctacgggtcgccttggtggctc

SEQ ID NO: 12145 - DNA, 35 bp, Artificial Sequence
  Synthetic oligonucleotide
gctgttgcccagttctgtgacccagcgcacttccc

SEQ ID NO: 12146 - DNA, 35 bp, Artificial Sequence
  Synthetic oligonucleotide
actccgtccaacttgcaaggcactcccattccctc

SEQ ID NO: 12147 - DNA, 35 bp, Artificial Sequence
  Synthetic oligonucleotide
gtcactcctacctggggccatacacgctaatttaa

SEQ ID NO: 12148 - DNA, 35 bp, Artificial Sequence
  Synthetic oligonucleotide
aacacccccgtgttatgactggcttcttcctttac

SEQ ID NO: 12149 - DNA, 35 bp, Artificial Sequence
  Synthetic oligonucleotide
tccctcatccgatgcacccctcacaagtccctttc

SEQ ID NO: 12150 - DNA, 35 bp, Artificial Sequence
  Synthetic oligonucleotide
gttctcctacgccgtgccccccgagttcatgcccc

SEQ ID NO: 12151 - DNA, 36 bp, Artificial Sequence
  Synthetic oligonucleotide
gccctggcccctgaggccctaactcctgtaatatca

SEQ ID NO: 12152 - DNA, 36 bp, Artificial Sequence
  Synthetic oligonucleotide
tctgaagcgcctccgctctcgcatttgcaaacctca

SEQ ID NO: 12153 - DNA, 37 bp, Artificial Sequence
  Synthetic oligonucleotide
gtaaggggggaaggtgaaacgccaggacagtgaagga

SEQ ID NO: 12154 - DNA, 37 bp, Artificial Sequence
  Synthetic oligonucleotide
ggggagggatcggcgcgtaaggggtactagccgggga

SEQ ID NO: 12155 - DNA, 38 bp, Artificial Sequence
  Synthetic oligonucleotide
tacgagccacctcacccccgcatctagaactggtttga

SEQ ID NO: 12156 - DNA, 36 bp, Artificial Sequence
  Synthetic oligonucleotide
tacgcgtaccaatcggcttatttgcgaccccactta

SEQ ID NO: 12157 - DNA, 35 bp, Artificial Sequence
  Synthetic oligonucleotide
tatcccatcgcggctgccgcgaacccgtttccaac

SEQ ID NO: 12158 - DNA, 35 bp, Artificial Sequence
  Synthetic oligonucleotide
tgagtcgtcaaagtaaactctctttctaccatgcc

SEQ ID NO: 12159 - DNA, 35 bp, Artificial Sequence
  Synthetic oligonucleotide
aatatgccgccttggtctaatgcatttccacccgc

SEQ ID NO: 12160 - DNA, 35 bp, Artificial Sequence
  Synthetic oligonucleotide
tgatccatcaatctccacggttgccctcctcatcg

SEQ ID NO: 12161 - DNA, 36 bp, Artificial Sequence
  Synthetic oligonucleotide
acattgtcgcctgtcacatctttgacccgatcccaa

SEQ ID NO: 12162 - DNA, 36 bp, Artificial Sequence
  Synthetic oligonucleotide
gatccgacccgcctttcagtgtacttccagctagca

SEQ ID NO: 12163 - DNA, 36 bp, Artificial Sequence
  Synthetic oligonucleotide
atgcccatccgctgtaccccctcgtcatccggaata

SEQ ID NO: 12164 - DNA, 35 bp, Artificial Sequence
  Synthetic oligonucleotide
aactcggccacctgagtgactctacatacctattc

SEQ ID NO: 12165 - DNA, 36 bp, Artificial Sequence
  Synthetic oligonucleotide
tactccccccgtgccaggccatttaacgtggttact

SEQ ID NO: 12166 - DNA, 35 bp, Artificial Sequence
  Synthetic oligonucleotide
taccaacacatctgtgtggccagcccataccgcct

SEQ ID NO: 12167 - DNA, 35 bp, Artificial Sequence
  Synthetic oligonucleotide
tgcatcctcgtctctcctccagttcctagcctgca

SEQ ID NO: 12168 - DNA, 36 bp, Artificial Sequence
  Synthetic oligonucleotide
acgcgcgccccatcccttaccaggcggtctcattca

SEQ ID NO: 12169 - DNA, 38 bp, Artificial Sequence
  Synthetic oligonucleotide
taacgaaaagtggggttatggtgaagggaggggattga

SEQ ID NO: 12170 - DNA, 35 bp, Artificial Sequence
  Synthetic oligonucleotide
tgttcattgggtgggtagggtagggtacgagctag

SEQ ID NO: 12171 - DNA, 35 bp, Artificial Sequence
  Synthetic oligonucleotide
tagcaacacccacaggctcaatatcatcatcaact

SEQ ID NO: 12172 - DNA, 35 bp, Artificial Sequence
  Synthetic oligonucleotide
attagccgcccacgccatcagtcaattggtcccat

SEQ ID NO: 12173 - DNA, 35 bp, Artificial Sequence
  Synthetic oligonucleotide
ttgaaccagctgtgcgcttttatcttatcccttcc

SEQ ID NO: 12174 - DNA, 35 bp, Artificial Sequence
  Synthetic oligonucleotide
agtggaaaagggaacgaaggggatgaaacgggatg

SEQ ID NO: 12175 - DNA, 35 bp, Artificial Sequence
  Synthetic oligonucleotide
gacgtcgccgggctcatctaccttcctccgtactt

SEQ ID NO: 12176 - DNA, 35 bp, Artificial Sequence
  Synthetic oligonucleotide
atccccacccaacttcgtaagatcagaccgcgctt

SEQ ID NO: 12177 - DNA, 38 bp, Artificial Sequence
  Synthetic oligonucleotide
ttgctgtcacacacctaccatgccactcaagctcctga

SEQ ID NO: 12178 - DNA, 37 bp, Artificial Sequence
  Synthetic oligonucleotide
tagtgggtggtgggaaggggcgtggtgggcccgctga

SEQ ID NO: 12179 - DNA, 35 bp, Artificial Sequence
  Synthetic oligonucleotide
gcaaatcgacctatccgtgcttccgacccactccg

SEQ ID NO: 12180 - DNA, 36 bp, Artificial Sequence
  Synthetic oligonucleotide
tacccacccgtgaaatacgtgtccttgggatgccca

SEQ ID NO: 12181 - DNA, 36 bp, Artificial Sequence
  Synthetic oligonucleotide
gacgatgactccgtggtcaagtttctacctcctcta

SEQ ID NO: 12182 - DNA, 35 bp, Artificial Sequence
  Synthetic oligonucleotide
gacaccctaccgttgccggcccaaccgcatccccg

SEQ ID NO: 12183 - DNA, 34 bp, Artificial Sequence
  Synthetic oligonucleotide
tgtgcccacgacaatatccatgacccctacttct

SEQ ID NO: 12184 - DNA, 37 bp, Artificial Sequence
  Synthetic oligonucleotide
gccacctggcctctccgataacacgccccccttagga

SEQ ID NO: 12185 - DNA, 35 bp, Artificial Sequence
  Synthetic oligonucleotide
atcgcattgcacaaccctctgcgtcccccatgtcc

SEQ ID NO: 12186 - DNA, 36 bp, Artificial Sequence
  Synthetic oligonucleotide
tttgcacccccatctgccttatgtcgtatgttccga

SEQ ID NO: 12187 - DNA, 38 bp, Artificial Sequence
  Synthetic oligonucleotide
ggtcgccggccatctgctctaagcaactctcctcctga

SEQ ID NO: 12188 - DNA, 35 bp, Artificial Sequence
  Synthetic oligonucleotide
actcacggtactccgccatgttctagtcacgccct

SEQ ID NO: 12189 - DNA, 35 bp, Artificial Sequence
  Synthetic oligonucleotide
gatctcgttccatcgcattagttcctaccattgtt

SEQ ID NO: 12190 - DNA, 36 bp, Artificial Sequence
  Synthetic oligonucleotide
ccactggcttcacgtctgcattgccgttctttttca

SEQ ID NO: 12191 - DNA, 38 bp, Artificial Sequence
  Synthetic oligonucleotide
actaaaccctgcccagccccgtcctacctagcagatga

SEQ ID NO: 12192 - DNA, 35 bp, Artificial Sequence
  Synthetic oligonucleotide
gacccccgactcgattccctgtgcaagcctatata

SEQ ID NO: 12193 - DNA, 36 bp, Artificial Sequence
  Synthetic oligonucleotide
gtcgctgccgtcctagttgcctgctgcccttcctta

SEQ ID NO: 12194 - DNA, 35 bp, Artificial Sequence
  Synthetic oligonucleotide
tcctggtccccctatgcggttttcggcccccgcac

SEQ ID NO: 12195 - DNA, 35 bp, Artificial Sequence
  Synthetic oligonucleotide
aaccgagccgcctcgcatcgattctctgtgctacc

SEQ ID NO: 12196 - DNA, 35 bp, Artificial Sequence
  Synthetic oligonucleotide
tcccggtggtcgcccccgttttgctgtctacctgc

SEQ ID NO: 12197 - DNA, 35 bp, Artificial Sequence
  Synthetic oligonucleotide
ttacgccgccgggtccctctccagtctccgccgat

SEQ ID NO: 12198 - DNA, 35 bp, Artificial Sequence
  Synthetic oligonucleotide
tcacaccggtgcctgccgattaccttctttttgct

SEQ ID NO: 12199 - DNA, 35 bp, Artificial Sequence
  Synthetic oligonucleotide
gagcacccatcatgaccccgtccactctagcaaca

SEQ ID NO: 12200 - DNA, 35 bp, Artificial Sequence
  Synthetic oligonucleotide
tgacactccccgtccctgcctctttgtttgctgac

SEQ ID NO: 12201 - DNA, 35 bp, Artificial Sequence
  Synthetic oligonucleotide
ttgtagagctcctctctgttgtccggtccctgcct

SEQ ID NO: 12202 - DNA, 36 bp, Artificial Sequence
  Synthetic oligonucleotide
tgctccccctcgttctgggcctttgtacgatctaac

SEQ ID NO: 12203 - DNA, 35 bp, Artificial Sequence
  Synthetic oligonucleotide
gattcgacgccggctcggtcaacatcatcccattc

SEQ ID NO: 12204 - DNA, 35 bp, Artificial Sequence
  Synthetic oligonucleotide
tcactccccttaggcgcattgcccatacacgattt

SEQ ID NO: 12205 - DNA, 35 bp, Artificial Sequence
  Synthetic oligonucleotide
tcagacactgaccatcgtacggggcccttgttaca

SEQ ID NO: 12206 - DNA, 37 bp, Artificial Sequence
  Synthetic oligonucleotide
aaccgccccggccatgtaaatcctcctccgtacacga

SEQ ID NO: 12207 - DNA, 38 bp, Artificial Sequence
  Synthetic oligonucleotide
ggggggggggggcgaagatgatgcaggggcgatcgtga

SEQ ID NO: 12208 - DNA, 38 bp, Artificial Sequence
  Synthetic oligonucleotide
tgagagacgatgggggtaggaaggagcgcgtagtgtga

SEQ ID NO: 12209 - DNA, 34 bp, Artificial Sequence
  Synthetic oligonucleotide
gttcctcccctgacgtccccggcactttgcccgc

SEQ ID NO: 12210 - DNA, 35 bp, Artificial Sequence
  Synthetic oligonucleotide
gacaccatccgatacaactaccgcctctgtacggc

SEQ ID NO: 12211 - DNA, 37 bp, Artificial Sequence
  Synthetic oligonucleotide
tgagactgagggggggggaggaacgggagatgaagga

SEQ ID NO: 12212 - DNA, 35 bp, Artificial Sequence
  Synthetic oligonucleotide
tgtacatcggaacccgttccttcatccctcccatg

SEQ ID NO: 12213 - DNA, 35 bp, Artificial Sequence
  Synthetic oligonucleotide
atagcccccactcatgaccgtcgaggcttcattcc

SEQ ID NO: 12214 - DNA, 34 bp, Artificial Sequence
  Synthetic oligonucleotide
tgtacgacaagtgcacgccgctaatttttggtct

SEQ ID NO: 12215 - DNA, 35 bp, Artificial Sequence
  Synthetic oligonucleotide
tcccgccacagccgccacaactcctatgacataca

SEQ ID NO: 12216 - DNA, 37 bp, Artificial Sequence
  Synthetic oligonucleotide
atgccatgtcccggtgtttcggtgctccctctctcga

SEQ ID NO: 12217 - DNA, 35 bp, Artificial Sequence
  Synthetic oligonucleotide
agttatcgcctagccctggttacttatctttgttc

SEQ ID NO: 12218 - DNA, 36 bp, Artificial Sequence
  Synthetic oligonucleotide
gagtgggccgggaaggagaggggcgtgagtctgcaa

SEQ ID NO: 12219 - DNA, 36 bp, Artificial Sequence
  Synthetic oligonucleotide
gatggaggggaagtagttcgaggtaaaggaaggaca

SEQ ID NO: 12220 - DNA, 37 bp, Artificial Sequence
  Synthetic oligonucleotide
gtcgccccctctctgagccttctcttactgactacga

SEQ ID NO: 12221 - DNA, 36 bp, Artificial Sequence
  Synthetic oligonucleotide
actacaccacaaggtactattcacgccttcacgaca

SEQ ID NO: 12222 - DNA, 38 bp, Artificial Sequence
  Synthetic oligonucleotide
agcccacccccaggttgttcatggttcctccgtaatga

SEQ ID NO: 12223 - DNA, 35 bp, Artificial Sequence
  Synthetic oligonucleotide
tagcactggtactaacacgacctctctgactggcc

SEQ ID NO: 12224 - DNA, 37 bp, Artificial Sequence
  Synthetic oligonucleotide
ttaggccaaggagggagatagaaggcggattaacgga

SEQ ID NO: 12225 - DNA, 35 bp, Artificial Sequence
  Synthetic oligonucleotide
accaccaacactcgcagaccgtacctttggacctc

SEQ ID NO: 12226 - DNA, 36 bp, Artificial Sequence
  Synthetic oligonucleotide
acaccctgtcagatatttcccccgctgattcgtcca

SEQ ID NO: 12227 - DNA, 38 bp, Artificial Sequence
  Synthetic oligonucleotide
agcaccgccgccgtttattcataccctctccgcactga

SEQ ID NO: 12228 - DNA, 35 bp, Artificial Sequence
  Synthetic oligonucleotide
tattgttccacccagattgtcccccgcgggttccc

SEQ ID NO: 12229 - DNA, 35 bp, Artificial Sequence
  Synthetic oligonucleotide
accttgccacaggtgacttgttccttcatgccccg

SEQ ID NO: 12230 - DNA, 35 bp, Artificial Sequence
  Synthetic oligonucleotide
gaaaaacaacgggtggaagcagtagggggggggcg

SEQ ID NO: 12231 - DNA, 37 bp, Artificial Sequence
  Synthetic oligonucleotide
gcccctgtccctccttgtcaacaccagtcatcgctga

SEQ ID NO: 12232 - DNA, 37 bp, Artificial Sequence
  Synthetic oligonucleotide
gtgctaacacgggggacgggtgaagggaaaaattcga

SEQ ID NO: 12233 - DNA, 38 bp, Artificial Sequence
  Synthetic oligonucleotide
gccccaccaccgatcgccgtccatcgcgttactcatga

SEQ ID NO: 12234 - DNA, 36 bp, Artificial Sequence
  Synthetic oligonucleotide
tctgacggaccccgagttccgtcttaccatgtacca

SEQ ID NO: 12235 - DNA, 37 bp, Artificial Sequence
  Synthetic oligonucleotide
acactcgatggatgggaagggcgggcgggaacggtga

SEQ ID NO: 12236 - DNA, 35 bp, Artificial Sequence
  Synthetic oligonucleotide
gagcggcgcaggaggaaggaatggaaaataaatgg

SEQ ID NO: 12237 - DNA, 36 bp, Artificial Sequence
  Synthetic oligonucleotide
acatcgaccgtcaccgctccaccatcatcgctctga

SEQ ID NO: 12238 - DNA, 36 bp, Artificial Sequence
  Synthetic oligonucleotide
atcgcccaccgacccatggcttcgtgcggtacacta

SEQ ID NO: 12239 - DNA, 35 bp, Artificial Sequence
  Synthetic oligonucleotide
tgacatgtcaggccactccgctatcccagtcctac

SEQ ID NO: 12240 - DNA, 35 bp, Artificial Sequence
  Synthetic oligonucleotide
gccgagcctgtgtgactctttacacctttccatgt

SEQ ID NO: 12241 - DNA, 36 bp, Artificial Sequence
  Synthetic oligonucleotide
gccacgccgtacaccaccctctccaattcgggctga

SEQ ID NO: 12242 - DNA, 36 bp, Artificial Sequence
  Synthetic oligonucleotide
ggccgtagctcactctctgtcttgctccctgttcta

SEQ ID NO: 12243 - DNA, 35 bp, Artificial Sequence
  Synthetic oligonucleotide
ttgagccttaccctccgcatcgatctggttcctgc

SEQ ID NO: 12244 - DNA, 35 bp, Artificial Sequence
  Synthetic oligonucleotide
gttggcactccactctttcctcagatcgctcgctg

SEQ ID NO: 12245 - DNA, 37 bp, Artificial Sequence
  Synthetic oligonucleotide
ttgttatgcccctgcccgctcgcccttactttaagga

SEQ ID NO: 12246 - DNA, 35 bp, Artificial Sequence
  Synthetic oligonucleotide
tgccatgcctgttgtcgcattagtccttgccctcc

SEQ ID NO: 12247 - DNA, 35 bp, Artificial Sequence
  Synthetic oligonucleotide
ttgaggtgcaggggggtcggggttgggggctgaac

SEQ ID NO: 12248 - DNA, 35 bp, Artificial Sequence
  Synthetic oligonucleotide
atcagctgcacggcgtcgtctctgttctatcctcc

SEQ ID NO: 12249 - DNA, 35 bp, Artificial Sequence
  Synthetic oligonucleotide
acatccccagccgggtcgtctcacccttttttagt

SEQ ID NO: 12250 - DNA, 35 bp, Artificial Sequence
  Synthetic oligonucleotide
acccgctgccctcaaaaacaagcccactgaatatc

SEQ ID NO: 12251 - DNA, 35 bp, Artificial Sequence
  Synthetic oligonucleotide
gtgcgacgataggcggaaggtgggggaggagtctg

SEQ ID NO: 12252 - DNA, 35 bp, Artificial Sequence
  Synthetic oligonucleotide
gcacccattattccacttcgtaccgctatgccttg

SEQ ID NO: 12253 - DNA, 37 bp, Artificial Sequence
  Synthetic oligonucleotide
tgagacaccgcgaggctgcgaatccctcctgccctga

SEQ ID NO: 12254 - DNA, 38 bp, Artificial Sequence
  Synthetic oligonucleotide
gagccaagctcaatggtagcgtgcttacccctccgtga

SEQ ID NO: 12255 - DNA, 35 bp, Artificial Sequence
  Synthetic oligonucleotide
tgcaacccacatcaccgttaattggacccctgtga

SEQ ID NO: 12256 - DNA, 36 bp, Artificial Sequence
  Synthetic oligonucleotide
gacgacgtgacacaccacccctagatgctacgccta

SEQ ID NO: 12257 - DNA, 35 bp, Artificial Sequence
  Synthetic oligonucleotide
tccctgctccacagtcccaaggctcactatcatcc

SEQ ID NO: 12258 - DNA, 34 bp, Artificial Sequence
  Synthetic oligonucleotide
gcactacattcggatcccgcccaccatcacgttc

SEQ ID NO: 12259 - DNA, 35 bp, Artificial Sequence
  Synthetic oligonucleotide
ttaccgccgctcctcaaacaataagcccgattgcg

SEQ ID NO: 12260 - DNA, 36 bp, Artificial Sequence
  Synthetic oligonucleotide
agccaccacgaaccggcaacaccgggcttaccacca

SEQ ID NO: 12261 - DNA, 37 bp, Artificial Sequence
  Synthetic oligonucleotide
tcccctccacccgtgcttcatcggtatcatcttatga

SEQ ID NO: 12262 - DNA, 35 bp, Artificial Sequence
  Synthetic oligonucleotide
ttgttgcgctatcccatttactgcctccacctgta

SEQ ID NO: 12263 - DNA, 35 bp, Artificial Sequence
  Synthetic oligonucleotide
ggacccaccctcgttactgccactgtcttccagtt

SEQ ID NO: 12264 - DNA, 35 bp, Artificial Sequence
  Synthetic oligonucleotide
ggaccaccgaccaccccgtaggatctcactgtcca

SEQ ID NO: 12265 - DNA, 37 bp, Artificial Sequence
  Synthetic oligonucleotide
tcactcagatcgctacgcctcgctcccaccgcatgga

SEQ ID NO: 12266 - DNA, 36 bp, Artificial Sequence
  Synthetic oligonucleotide
tcctacaggcgcacgcatcatacctctgccatccta

SEQ ID NO: 12267 - DNA, 35 bp, Artificial Sequence
  Synthetic oligonucleotide
ttagtaccggccatttcatcacacccgacttgtcg

SEQ ID NO: 12268 - DNA, 35 bp, Artificial Sequence
  Synthetic oligonucleotide
gcacacggtcgctattcttccatggtccgctttgg

SEQ ID NO: 12269 - DNA, 36 bp, Artificial Sequence
  Synthetic oligonucleotide
gtctccgcctcccctctcccgtcaacggacagatca

SEQ ID NO: 12270 - DNA, 37 bp, Artificial Sequence
  Synthetic oligonucleotide
gatccatccgcacttttctgtcttcttatggacctga

SEQ ID NO: 12271 - DNA, 36 bp, Artificial Sequence
  Synthetic oligonucleotide
acccccccctgtgaggccacttatagttctaccgta

SEQ ID NO: 12272 - DNA, 35 bp, Artificial Sequence
  Synthetic oligonucleotide
gaccctccgaggcgaactccttactatgctttgcc

SEQ ID NO: 12273 - DNA, 35 bp, Artificial Sequence
  Synthetic oligonucleotide
tcgagtcccgctcattatcttaagccctctctcgc

SEQ ID NO: 12274 - DNA, 35 bp, Artificial Sequence
  Synthetic oligonucleotide
tagtgtcacgggtcccttcttatgcagttgttccc

SEQ ID NO: 12275 - DNA, 35 bp, Artificial Sequence
  Synthetic oligonucleotide
gctcaacggactgtgaattggtctccctcttctcc

SEQ ID NO: 12276 - DNA, 35 bp, Artificial Sequence
  Synthetic oligonucleotide
tcgtaatcacccgaccccttatcttgccagagccg

SEQ ID NO: 12277 - DNA, 35 bp, Artificial Sequence
  Synthetic oligonucleotide
tgttcatgtagcaggtgctccagtccgattgccct

SEQ ID NO: 12278 - DNA, 35 bp, Artificial Sequence
  Synthetic oligonucleotide
accagagccaagcttgctcgcacgaggccccctct

SEQ ID NO: 12279 - DNA, 37 bp, Artificial Sequence
  Synthetic oligonucleotide
acgcccgcttccgtcacgttacctgcttcttctccga

SEQ ID NO: 12280 - DNA, 36 bp, Artificial Sequence
  Synthetic oligonucleotide
tgtgcgggggcacctgtcaattggcccatctcacta

SEQ ID NO: 12281 - DNA, 36 bp, Artificial Sequence
  Synthetic oligonucleotide
acacgtcgcaagcttctgcccttctgcgtgccctta

SEQ ID NO: 12282 - DNA, 35 bp, Artificial Sequence
  Synthetic oligonucleotide
acccactgacagacagcctatgcccggctgcaatc

SEQ ID NO: 12283 - DNA, 35 bp, Artificial Sequence
  Synthetic oligonucleotide
tgcacatcacagtctactctgaattgccattttct

SEQ ID NO: 12284 - DNA, 37 bp, Artificial Sequence
  Synthetic oligonucleotide
gatggggacctgaagtaggagggcaaggggaggtaga

SEQ ID NO: 12285 - DNA, 38 bp, Artificial Sequence
  Synthetic oligonucleotide
agcgctagcccaggcgcttgatccactctccatactga

SEQ ID NO: 12286 - DNA, 35 bp, Artificial Sequence
  Synthetic oligonucleotide
gtcccgtgaagttctcccacgtccactgtttcacc

SEQ ID NO: 12287 - DNA, 37 bp, Artificial Sequence
  Synthetic oligonucleotide
ttcgacgcctcccgtttgcgggcctgacccatcctga

SEQ ID NO: 12288 - DNA, 35 bp, Artificial Sequence
  Synthetic oligonucleotide
gtaacgggggaaattgcaaggggggcggtataggg

SEQ ID NO: 12289 - DNA, 35 bp, Artificial Sequence
  Synthetic oligonucleotide
agcaccaccgtgggttccgttccctcttactttgg

SEQ ID NO: 12290 - DNA, 35 bp, Artificial Sequence
  Synthetic oligonucleotide
gccgaacggatgccgattcaccccgtccctccaaa

SEQ ID NO: 12291 - DNA, 35 bp, Artificial Sequence
  Synthetic oligonucleotide
gagcctggcccagacctccccctattcggtgtgca

SEQ ID NO: 12292 - DNA, 35 bp, Artificial Sequence
  Synthetic oligonucleotide
ttagtggtgcaagggaaaaaggcgcatgggtggga

SEQ ID NO: 12293 - DNA, 35 bp, Artificial Sequence
  Synthetic oligonucleotide
tgacctaactgctccgatagcctgtcacgcacctc

SEQ ID NO: 12294 - DNA, 37 bp, Artificial Sequence
  Synthetic oligonucleotide
gtctgccccacatttcgcctgataggactccaactga

SEQ ID NO: 12295 - DNA, 35 bp, Artificial Sequence
  Synthetic oligonucleotide
acccatctccagttgacatgaacggatttctcccc

SEQ ID NO: 12296 - DNA, 35 bp, Artificial Sequence
  Synthetic oligonucleotide
taacaacgccccctgttaaagtaattctgcctttc

SEQ ID NO: 12297 - DNA, 35 bp, Artificial Sequence
  Synthetic oligonucleotide
tccatgtttgcacgaaaaaagcctgccgtttacct

SEQ ID NO: 12298 - DNA, 36 bp, Artificial Sequence
  Synthetic oligonucleotide
aactcagccagcataccgtagtttatcgtttttcca

SEQ ID NO: 12299 - DNA, 36 bp, Artificial Sequence
  Synthetic oligonucleotide
tcagtgaaccgccactccctcataccgtaccaggca

SEQ ID NO: 12300 - DNA, 35 bp, Artificial Sequence
  Synthetic oligonucleotide
tacgaaccgactttgccaattgcggaccttctgcc

SEQ ID NO: 12301 - DNA, 37 bp, Artificial Sequence
  Synthetic oligonucleotide
tcgctccaccatcctgttttcatgtagagtcctccga

SEQ ID NO: 12302 - DNA, 35 bp, Artificial Sequence
  Synthetic oligonucleotide
tcacgcctgcatccacaaggatttaaacgcatccc

SEQ ID NO: 12303 - DNA, 35 bp, Artificial Sequence
  Synthetic oligonucleotide
ttggtagccaaggggcgggaggttgagtagtggtt

SEQ ID NO: 12304 - DNA, 37 bp, Artificial Sequence
  Synthetic oligonucleotide
actgactcccccgccatcatgtcgacgaccttttaga

SEQ ID NO: 12305 - DNA, 35 bp, Artificial Sequence
  Synthetic oligonucleotide
tcaaacgccatcattcgcgccccctctgatcatga

SEQ ID NO: 12306 - DNA, 35 bp, Artificial Sequence
  Synthetic oligonucleotide
tttcatgccgccaccgttatgttgtaggccctatc

SEQ ID NO: 12307 - DNA, 38 bp, Artificial Sequence
  Synthetic oligonucleotide
tgcgctcctcattccacttacgtactctcactgcgtga

SEQ ID NO: 12308 - DNA, 35 bp, Artificial Sequence
  Synthetic oligonucleotide
atcgtccgtcgccccatcaaccaataggacgttac

SEQ ID NO: 12309 - DNA, 35 bp, Artificial Sequence
  Synthetic oligonucleotide
taggtaccccgcctgtcactcttcctttatgcaca

SEQ ID NO: 12310 - DNA, 35 bp, Artificial Sequence
  Synthetic oligonucleotide
acagtgccatgtaccatcagcatcggccccaccca

SEQ ID NO: 12311 - DNA, 36 bp, Artificial Sequence
  Synthetic oligonucleotide
gatactggccggtgcggcaaggagaggggcgggaaa

SEQ ID NO: 12312 - DNA, 38 bp, Artificial Sequence
  Synthetic oligonucleotide
tacatacggcaccccacatagttaacatccgtctctga

SEQ ID NO: 12313 - DNA, 33 bp, Artificial Sequence
  Synthetic oligonucleotide
gtgcccacccgcgcccccagcgtagacagtttc

SEQ ID NO: 12314 - DNA, 35 bp, Artificial Sequence
  Synthetic oligonucleotide
ggcacaacatcatgccgtactcccacacaactccg

SEQ ID NO: 12315 - DNA, 35 bp, Artificial Sequence
  Synthetic oligonucleotide
aacccaaccacattctgtcacgtgctgccttcgcg

SEQ ID NO: 12316 - DNA, 36 bp, Artificial Sequence
  Synthetic oligonucleotide
gaccttacgccccatttgcttacttggaactttaca

SEQ ID NO: 12317 - DNA, 35 bp, Artificial Sequence
  Synthetic oligonucleotide
actaccatcacgtgactgccctaaaaggtctccca

SEQ ID NO: 12318 - DNA, 36 bp, Artificial Sequence
  Synthetic oligonucleotide
tcatgcgggaggaaaggggattaatggcggggcgga

SEQ ID NO: 12319 - DNA, 36 bp, Artificial Sequence
  Synthetic oligonucleotide
tgacacggtgcgagggtaggtaggggatgtggggga

SEQ ID NO: 12320 - DNA, 37 bp, Artificial Sequence
  Synthetic oligonucleotide
ttggacgtcgtgaggggggtggttgtaaaggctggga

SEQ ID NO: 12321 - DNA, 36 bp, Artificial Sequence
  Synthetic oligonucleotide
aaccgagtggtggaggatatgggaatgtgctatgga

SEQ ID NO: 12322 - DNA, 35 bp, Artificial Sequence
  Synthetic oligonucleotide
gctccatccgccggtccatcgttaggcactcacat

SEQ ID NO: 12323 - DNA, 36 bp, Artificial Sequence
  Synthetic oligonucleotide
gcccacacctgactacctttcgtcaacagggtacca

SEQ ID NO: 12324 - DNA, 36 bp, Artificial Sequence
  Synthetic oligonucleotide
gcgccgcacgcagtctttcacgaatcatctcacgca

SEQ ID NO: 12325 - DNA, 37 bp, Artificial Sequence
  Synthetic oligonucleotide
gatcaattcgcaccatctttttcggacaccctggcca

SEQ ID NO: 12326 - DNA, 35 bp, Artificial Sequence
  Synthetic oligonucleotide
ttattgacgggagggtggatcaaggcgggggggca

SEQ ID NO: 12327 - DNA, 35 bp, Artificial Sequence
  Synthetic oligonucleotide
tacccccccacccctgctttgcgtaataacagaac

SEQ ID NO: 12328 - DNA, 35 bp, Artificial Sequence
  Synthetic oligonucleotide
actcaaccgaaatcctcctgggcctgaccctcgct

SEQ ID NO: 12329 - DNA, 35 bp, Artificial Sequence
  Synthetic oligonucleotide
atcaacccacgccacttcgtcgccctgttgccccc

SEQ ID NO: 12330 - DNA, 35 bp, Artificial Sequence
  Synthetic oligonucleotide
gaggatagccgctggccgaacgatctccctttagt

SEQ ID NO: 12331 - DNA, 35 bp, Artificial Sequence
  Synthetic oligonucleotide
gtacactccgttcttctccgccatccgcatgccca

SEQ ID NO: 12332 - DNA, 35 bp, Artificial Sequence
  Synthetic oligonucleotide
accctccaacacgtcatgcgcctcttctctccgat

SEQ ID NO: 12333 - DNA, 37 bp, Artificial Sequence
  Synthetic oligonucleotide
ttcaccccgcattgctaacattccgcacaaacctgga

SEQ ID NO: 12334 - DNA, 35 bp, Artificial Sequence
  Synthetic oligonucleotide
gctgacccgccgctatccatatcgtttctccttgg

SEQ ID NO: 12335 - DNA, 35 bp, Artificial Sequence
  Synthetic oligonucleotide
tcccatcccagaacacggatccatctctactgaca

SEQ ID NO: 12336 - DNA, 35 bp, Artificial Sequence
  Synthetic oligonucleotide
gccctgacctggcacatcgcggctcaacatcgccc

SEQ ID NO: 12337 - DNA, 35 bp, Artificial Sequence
  Synthetic oligonucleotide
gcattacgcacccggcctttatttgccgctcttgc

SEQ ID NO: 12338 - DNA, 35 bp, Artificial Sequence
  Synthetic oligonucleotide
gcatctcggccccagccctgttttcacgcttcctg

SEQ ID NO: 12339 - DNA, 35 bp, Artificial Sequence
  Synthetic oligonucleotide
taagcctgctgactaattgtcggtcaccctcacct

SEQ ID NO: 12340 - DNA, 36 bp, Artificial Sequence
  Synthetic oligonucleotide
ggaaacgcaatgaaagcctcttcgacctcttcttca

SEQ ID NO: 12341 - DNA, 37 bp, Artificial Sequence
  Synthetic oligonucleotide
acacagtccaattgacgccgaccatcaccctcaccga

SEQ ID NO: 12342 - DNA, 37 bp, Artificial Sequence
  Synthetic oligonucleotide
tgcccaacgccgaatctggcactggtcacttctccga

SEQ ID NO: 12343 - DNA, 37 bp, Artificial Sequence
  Synthetic oligonucleotide
tcgactccccgcctcccgcccgtaaccgcatccttga

SEQ ID NO: 12344 - DNA, 35 bp, Artificial Sequence
  Synthetic oligonucleotide
gtcgccgttcgacactgcagactacttgcactaac

SEQ ID NO: 12345 - DNA, 35 bp, Artificial Sequence
  Synthetic oligonucleotide
acgataacggccggccctacgcaacatacgccttc

SEQ ID NO: 12346 - DNA, 35 bp, Artificial Sequence
  Synthetic oligonucleotide
aactcaccgctttaaagctgcatgcttacccgttt

SEQ ID NO: 12347 - DNA, 36 bp, Artificial Sequence
  Synthetic oligonucleotide
aactcccgacctcattgactactcacggtccacaaa

SEQ ID NO: 12348 - DNA, 36 bp, Artificial Sequence
  Synthetic oligonucleotide
tgttacatccccatatccccaccgtttggacagtga

SEQ ID NO: 12349 - DNA, 35 bp, Artificial Sequence
  Synthetic oligonucleotide
tgcctagagggtgggaagaaggtcggggagttggt

SEQ ID NO: 12350 - DNA, 35 bp, Artificial Sequence
  Synthetic oligonucleotide
tcacctcgctgaggccaccagttatacctcctagc

SEQ ID NO: 12351 - DNA, 36 bp, Artificial Sequence
  Synthetic oligonucleotide
tgtgagatcgccccttttactgttgcctgttttaca

SEQ ID NO: 12352 - DNA, 37 bp, Artificial Sequence
  Synthetic oligonucleotide
atgtgcaaaaccgggtggcagggtaacgggggagaga

SEQ ID NO: 12353 - DNA, 35 bp, Artificial Sequence
  Synthetic oligonucleotide
gcaccgtgttacgcttttttcgctcgtacgctgtc

SEQ ID NO: 12354 - DNA, 35 bp, Artificial Sequence
  Synthetic oligonucleotide
acccgtcttcccgtttgcttcattgcgcagtcctt

SEQ ID NO: 12355 - DNA, 36 bp, Artificial Sequence
  Synthetic oligonucleotide
attgtgcgccgaccccgctattgtcccgacccgaca

SEQ ID NO: 12356 - DNA, 38 bp, Artificial Sequence
  Synthetic oligonucleotide
actgtgccggccgtaccatcttgaatccacccttatga

SEQ ID NO: 12357 - DNA, 38 bp, Artificial Sequence
  Synthetic oligonucleotide
actgcactttgacgttgctaatctccatcccttgctga

SEQ ID NO: 12358 - DNA, 36 bp, Artificial Sequence
  Synthetic oligonucleotide
gtgaacaacccgcctttttgccataaattctgttta

SEQ ID NO: 12359 - DNA, 35 bp, Artificial Sequence
  Synthetic oligonucleotide
gatacatccggccactcaatagccaggtccgccac

SEQ ID NO: 12360 - DNA, 36 bp, Artificial Sequence
  Synthetic oligonucleotide
ggcccccatccatcctgtatcatcagctcacggaaa

SEQ ID NO: 12361 - DNA, 38 bp, Artificial Sequence
  Synthetic oligonucleotide
tgcatatccaccgctcacaccgtaacacacattcctga

SEQ ID NO: 12362 - DNA, 36 bp, Artificial Sequence
  Synthetic oligonucleotide
tcaacccccaccggtctgaggcttcaacgcttccca

SEQ ID NO: 12363 - DNA, 37 bp, Artificial Sequence
  Synthetic oligonucleotide
tccatgcccgtttgcccttccagttcacctgacctga

SEQ ID NO: 12364 - DNA, 36 bp, Artificial Sequence
  Synthetic oligonucleotide
gtgcctccctgccgctcgcgatcactgcctatttca

SEQ ID NO: 12365 - DNA, 37 bp, Artificial Sequence
  Synthetic oligonucleotide
atagtgggaggggggtgtggtcggattccgaatgtga

SEQ ID NO: 12366 - DNA, 35 bp, Artificial Sequence
  Synthetic oligonucleotide
aagcgcggaacccacccattttttgcactggctct

SEQ ID NO: 12367 - DNA, 35 bp, Artificial Sequence
  Synthetic oligonucleotide
gcaccacccgattcgctttaggtctattacaagtt

SEQ ID NO: 12368 - DNA, 35 bp, Artificial Sequence
  Synthetic oligonucleotide
gccacatcctcaactccggcctccccgagccgtac

SEQ ID NO: 12369 - DNA, 36 bp, Artificial Sequence
  Synthetic oligonucleotide
gagcccggtcatcgattcaaattgtccctgccccca

SEQ ID NO: 12370 - DNA, 35 bp, Artificial Sequence
  Synthetic oligonucleotide
actgcacgtccatcagctattctccttccgatcac

SEQ ID NO: 12371 - DNA, 35 bp, Artificial Sequence
  Synthetic oligonucleotide
gtcacgcctctgacctgccacgctctgtcattacc

SEQ ID NO: 12372 - DNA, 35 bp, Artificial Sequence
  Synthetic oligonucleotide
gttcgagacccgaccccacctgcgctctatagccc

SEQ ID NO: 12373 - DNA, 36 bp, Artificial Sequence
  Synthetic oligonucleotide
tccgagatctgactgacaacttacacctcacacacg

SEQ ID NO: 12374 - DNA, 35 bp, Artificial Sequence
  Synthetic oligonucleotide
gtgagcccaaagtcgaacgccactgtttctcacat

SEQ ID NO: 12375 - DNA, 36 bp, Artificial Sequence
  Synthetic oligonucleotide
agcgccgtagcagcctctccgcgcatgggccttcca

SEQ ID NO: 12376 - DNA, 35 bp, Artificial Sequence
  Synthetic oligonucleotide
ttacgagcgctatgcggcgtactattctcattccc

SEQ ID NO: 12377 - DNA, 35 bp, Artificial Sequence
  Synthetic oligonucleotide
tgcctcgcctccatgctctggctccctccgatttg

SEQ ID NO: 12378 - DNA, 36 bp, Artificial Sequence
  Synthetic oligonucleotide
tgttgcaggtcagctcacacactcatccttagtcca

SEQ ID NO: 12379 - DNA, 35 bp, Artificial Sequence
  Synthetic oligonucleotide
gacatcacggcttaggcatcctcacccatcattgc

SEQ ID NO: 12380 - DNA, 35 bp, Artificial Sequence
  Synthetic oligonucleotide
aacttgctccatccagtactattgcgatccttctc

SEQ ID NO: 12381 - DNA, 36 bp, Artificial Sequence
  Synthetic oligonucleotide
acccacaccgtgccttagtgccatgggaacatgcaa

SEQ ID NO: 12382 - DNA, 38 bp, Artificial Sequence
  Synthetic oligonucleotide
acccacaccgtctggctctgaatcttgcacgctcgtga

SEQ ID NO: 12383 - DNA, 38 bp, Artificial Sequence
  Synthetic oligonucleotide
tacgccacccggctgcgggcccacaagcacctatttta

SEQ ID NO: 12384 - DNA, 35 bp, Artificial Sequence
  Synthetic oligonucleotide
gtcaccgttcacctgtctttgccctctgccgtccg

SEQ ID NO: 12385 - DNA, 34 bp, Artificial Sequence
  Synthetic oligonucleotide
taggaccactgctgaccccttatgttaaccccct

SEQ ID NO: 12386 - DNA, 35 bp, Artificial Sequence
  Synthetic oligonucleotide
accccgtgagccacggaacttgtacatcctattgc

SEQ ID NO: 12387 - DNA, 35 bp, Artificial Sequence
  Synthetic oligonucleotide
tcccacctgtccacgccggagtcaatcttttcgga

SEQ ID NO: 12388 - DNA, 37 bp, Artificial Sequence
  Synthetic oligonucleotide
tccatccgccggtgattcactcgtccaatctaatgga

SEQ ID NO: 12389 - DNA, 35 bp, Artificial Sequence
  Synthetic oligonucleotide
tactgaacccaactggcctggtattttattgttta

SEQ ID NO: 12390 - DNA, 35 bp, Artificial Sequence
  Synthetic oligonucleotide
atccgagcgggctctcttgatgtccttttacgccg

SEQ ID NO: 12391 - DNA, 37 bp, Artificial Sequence
  Synthetic oligonucleotide
agcacactgcctcattttcgccctatctacggaccga

SEQ ID NO: 12392 - DNA, 35 bp, Artificial Sequence
  Synthetic oligonucleotide
gtcgccccacccatttatcgattcaatagttgctc

SEQ ID NO: 12393 - DNA, 35 bp, Artificial Sequence
  Synthetic oligonucleotide
aagtgaggcgggaggacttaagcacagggcgggag

SEQ ID NO: 12394 - DNA, 36 bp, Artificial Sequence
  Synthetic oligonucleotide
tagtagcccactttgcgcctccgtggttgccctcga

SEQ ID NO: 12395 - DNA, 37 bp, Artificial Sequence
  Synthetic oligonucleotide
gaggttggggggtaatgcggaggccggaaaaggggga

SEQ ID NO: 12396 - DNA, 36 bp, Artificial Sequence
  Synthetic oligonucleotide
agacccccacgtcgttcagcctcgccacccacttga

SEQ ID NO: 12397 - DNA, 37 bp, Artificial Sequence
  Synthetic oligonucleotide
ggacctcgccccctatacaacctctgacgttctacga

SEQ ID NO: 12398 - DNA, 35 bp, Artificial Sequence
  Synthetic oligonucleotide
tcccgcgcctcggttgcctattcttagccctacac

SEQ ID NO: 12399 - DNA, 34 bp, Artificial Sequence
  Synthetic oligonucleotide
atgtcgcaaccggacccgctcccgatccatgctc

SEQ ID NO: 12400 - DNA, 35 bp, Artificial Sequence
  Synthetic oligonucleotide
gacacgaacccgatcaaagttgctaccctgtcttc

SEQ ID NO: 12401 - DNA, 35 bp, Artificial Sequence
  Synthetic oligonucleotide
tccccgccgtgggtttctaatgtcaatttcactgt

SEQ ID NO: 12402 - DNA, 37 bp, Artificial Sequence
  Synthetic oligonucleotide
tacgctagtgcccttgtttcacgctccacgttggtga

SEQ ID NO: 12403 - DNA, 35 bp, Artificial Sequence
  Synthetic oligonucleotide
ttaccgatcgccgcccctctaacgcgatctcaact

SEQ ID NO: 12404 - DNA, 38 bp, Artificial Sequence
  Synthetic oligonucleotide
gagtgggcacgggagacataggataatggaggggatga

SEQ ID NO: 12405 - DNA, 36 bp, Artificial Sequence
  Synthetic oligonucleotide
tcctacgttcaggttccacatcctgttccatcgcta

SEQ ID NO: 12406 - DNA, 35 bp, Artificial Sequence
  Synthetic oligonucleotide
atggacgcgctcttacccatatccgccccattgcg

SEQ ID NO: 12407 - DNA, 36 bp, Artificial Sequence
  Synthetic oligonucleotide
tgaccgcgcaagccttttctccaccgccccttgtca

SEQ ID NO: 12408 - DNA, 35 bp, Artificial Sequence
  Synthetic oligonucleotide
tcctcctcgcaatgggctcatcggttctatcattc

SEQ ID NO: 12409 - DNA, 35 bp, Artificial Sequence
  Synthetic oligonucleotide
taagcccacgctctcacatcatcctagactacttc

SEQ ID NO: 12410 - DNA, 35 bp, Artificial Sequence
  Synthetic oligonucleotide
cacatctactggcttgtttacagtcttgctcccag

SEQ ID NO: 12411 - DNA, 35 bp, Artificial Sequence
  Synthetic oligonucleotide
tctccgcatgcgcacatcatcattggcccgtacat

SEQ ID NO: 12412 - DNA, 36 bp, Artificial Sequence
  Synthetic oligonucleotide
tcatccgctccagggcccacagcaaccgttctgcca

SEQ ID NO: 12413 - DNA, 36 bp, Artificial Sequence
  Synthetic oligonucleotide
ggagaggaccagggaatgataggaaatagggccgca

SEQ ID NO: 12414 - DNA, 35 bp, Artificial Sequence
  Synthetic oligonucleotide
gtcccacagtttttgtcctatccgcatctacgtga

SEQ ID NO: 12415 - DNA, 35 bp, Artificial Sequence
  Synthetic oligonucleotide
attcgcccccgctccgccgactgcatccttaatta

SEQ ID NO: 12416 - DNA, 37 bp, Artificial Sequence
  Synthetic oligonucleotide
acagcactcccatcactatgttaacctgcctattcga

SEQ ID NO: 12417 - DNA, 38 bp, Artificial Sequence
  Synthetic oligonucleotide
tatgttcggaggggggtaagggaggaccggggtaatga

SEQ ID NO: 12418 - DNA, 35 bp, Artificial Sequence
  Synthetic oligonucleotide
ttgcccctcagttccttaccgctccttcgtgtttg

SEQ ID NO: 12419 - DNA, 35 bp, Artificial Sequence
  Synthetic oligonucleotide
tctaggaggaaggaggagtctgggagggctgtggt

SEQ ID NO: 12420 - DNA, 37 bp, Artificial Sequence
  Synthetic oligonucleotide
gcaccccgtcgcccccgttcactgatttactgctcga

SEQ ID NO: 12421 - DNA, 37 bp, Artificial Sequence
  Synthetic oligonucleotide
tatcagccgccatagcctgcggtctcacgccacctga

SEQ ID NO: 12422 - DNA, 38 bp, Artificial Sequence
  Synthetic oligonucleotide
actgctgcctctgcacttcctatccgcatgcaccgtga

SEQ ID NO: 12423 - DNA, 36 bp, Artificial Sequence
  Synthetic oligonucleotide
acatcgcatgagctggccaccacctttgccctacta

SEQ ID NO: 12424 - DNA, 35 bp, Artificial Sequence
  Synthetic oligonucleotide
tacgatgcattcctctgttttcagcaactcgttac

SEQ ID NO: 12425 - DNA, 35 bp, Artificial Sequence
  Synthetic oligonucleotide
gtcctacgaccctgttgcttacgtgtactcctgcc

SEQ ID NO: 12426 - DNA, 35 bp, Artificial Sequence
  Synthetic oligonucleotide
ttcatgtgctcgaccgtttttgaacgccttcgctc

SEQ ID NO: 12427 - DNA, 37 bp, Artificial Sequence
  Synthetic oligonucleotide
tcccgctcgctccattaccatccattccctgtggtga

SEQ ID NO: 12428 - DNA, 36 bp, Artificial Sequence
  Synthetic oligonucleotide
acgacctccctcacctacatgatttttacgaccata

SEQ ID NO: 12429 - DNA, 36 bp, Artificial Sequence
  Synthetic oligonucleotide
acgcacgggccgcaaagaacgcgccctccttccgta

SEQ ID NO: 12430 - DNA, 34 bp, Artificial Sequence
  Synthetic oligonucleotide
tcaatcccccgttgttgcagcctattactatccg

SEQ ID NO: 12431 - DNA, 35 bp, Artificial Sequence
  Synthetic oligonucleotide
tgtgaccgccgtcctaccgaaacaaagtaccctct

SEQ ID NO: 12432 - DNA, 35 bp, Artificial Sequence
  Synthetic oligonucleotide
tccaatccgctaccggtgctcaggtacccccctgt

SEQ ID NO: 12433 - DNA, 35 bp, Artificial Sequence
  Synthetic oligonucleotide
tatgcccctgggctcattggtacaacttccaactt

SEQ ID NO: 12434 - DNA, 35 bp, Artificial Sequence
  Synthetic oligonucleotide
acaacatcctcgcctgtatactgctcgatgcagtt

SEQ ID NO: 12435 - DNA, 38 bp, Artificial Sequence
  Synthetic oligonucleotide
aagccaccctccgcccgcgttgaagaaccaattcctga

SEQ ID NO: 12436 - DNA, 38 bp, Artificial Sequence
  Synthetic oligonucleotide
gtatcgcccccctccgctatgtatgtttgttccgctga

SEQ ID NO: 12437 - DNA, 35 bp, Artificial Sequence
  Synthetic oligonucleotide
tcacgcccgcccccggctcacccctcttagatcac

SEQ ID NO: 12438 - DNA, 35 bp, Artificial Sequence
  Synthetic oligonucleotide
ggacaacccgccgagttcggtgctctttccatatc

SEQ ID NO: 12439 - DNA, 35 bp, Artificial Sequence
  Synthetic oligonucleotide
gcctatgcccggaccatgccatggcatgattattt

SEQ ID NO: 12440 - DNA, 36 bp, Artificial Sequence
  Synthetic oligonucleotide
tgcgcccaccgtgccaatttctgtctatatctgaca

SEQ ID NO: 12441 - DNA, 35 bp, Artificial Sequence
  Synthetic oligonucleotide
acacccatagattggcctttgcttcccaccttgta

SEQ ID NO: 12442 - DNA, 35 bp, Artificial Sequence
  Synthetic oligonucleotide
aacgcacccctacatgcatagaggcctttaccgcc

SEQ ID NO: 12443 - DNA, 37 bp, Artificial Sequence
  Synthetic oligonucleotide
acgcaccaacctggttgcacttctttaggaccatcga

SEQ ID NO: 12444 - DNA, 35 bp, Artificial Sequence
  Synthetic oligonucleotide
tacgtatcaaccagcgccccatgtccgcacttttc

SEQ ID NO: 12445 - DNA, 35 bp, Artificial Sequence
  Synthetic oligonucleotide
gcacactttttgacgttacgtggacgtttttctct

SEQ ID NO: 12446 - DNA, 36 bp, Artificial Sequence
  Synthetic oligonucleotide
gcacgacggccgaaaacgaacacttccatccacaca

SEQ ID NO: 12447 - DNA, 38 bp, Artificial Sequence
  Synthetic oligonucleotide
tgtggtggcaggtccgtcctgcttcatatcttccctga

SEQ ID NO: 12448 - DNA, 36 bp, Artificial Sequence
  Synthetic oligonucleotide
ggtgaaagccgacagaaaggaggaatatggagggaa

SEQ ID NO: 12449 - DNA, 37 bp, Artificial Sequence
  Synthetic oligonucleotide
accacacctgcccggtaagacccatgccccacacgga

SEQ ID NO: 12450 - DNA, 35 bp, Artificial Sequence
  Synthetic oligonucleotide
tctccatcagcagcctgtcacggctttaccaccgt

SEQ ID NO: 12451 - DNA, 35 bp, Artificial Sequence
  Synthetic oligonucleotide
tcacagatcaaacgttattttggcaccattccacc

SEQ ID NO: 12452 - DNA, 35 bp, Artificial Sequence
  Synthetic oligonucleotide
tccgagggtcacacacacaacgtccccctgatttc

SEQ ID NO: 12453 - DNA, 35 bp, Artificial Sequence
  Synthetic oligonucleotide
tcgtggcctccgctgaccacccgtacaatatcacg

SEQ ID NO: 12454 - DNA, 36 bp, Artificial Sequence
  Synthetic oligonucleotide
gtcgatgtccagcctctgtcacaacggccacattaa

SEQ ID NO: 12455 - DNA, 37 bp, Artificial Sequence
  Synthetic oligonucleotide
atagccggtgtgggtggggaaggggttatctttgcga

SEQ ID NO: 12456 - DNA, 37 bp, Artificial Sequence
  Synthetic oligonucleotide
gccccgcaccacccttcaatctattcagtacaccgga

SEQ ID NO: 12457 - DNA, 35 bp, Artificial Sequence
  Synthetic oligonucleotide
gctccatgcgtgcactactttgtcaccccccattc

SEQ ID NO: 12458 - DNA, 35 bp, Artificial Sequence
  Synthetic oligonucleotide
gccgcactcgcctcctgtattaacttccaaggtac

SEQ ID NO: 12459 - DNA, 35 bp, Artificial Sequence
  Synthetic oligonucleotide
tcacagacgtaaaactgcgttgggcccaccttttc

SEQ ID NO: 12460 - DNA, 35 bp, Artificial Sequence
  Synthetic oligonucleotide
taccgacatctcgcctatctgcatagcaactacac

SEQ ID NO: 12461 - DNA, 35 bp, Artificial Sequence
  Synthetic oligonucleotide
aaagcacaccttccttgtcaccacagttccttgcc

SEQ ID NO: 12462 - DNA, 35 bp, Artificial Sequence
  Synthetic oligonucleotide
gccatgcaaccccatctgctccggcctggatcatc

SEQ ID NO: 12463 - DNA, 35 bp, Artificial Sequence
  Synthetic oligonucleotide
tcagatccgctcacacattagtccgttttatttgt

SEQ ID NO: 12464 - DNA, 35 bp, Artificial Sequence
  Synthetic oligonucleotide
gtggtcgccctgtaacgatgttttgcacctacctt

SEQ ID NO: 12465 - DNA, 33 bp, Artificial Sequence
  Synthetic oligonucleotide
agaacacgatccatctgtacctagccatcaaca

SEQ ID NO: 12466 - DNA, 37 bp, Artificial Sequence
  Synthetic oligonucleotide
accaccaatcagcccagtccccccttccaacatgcga

SEQ ID NO: 12467 - DNA, 38 bp, Artificial Sequence
  Synthetic oligonucleotide
tcacgccccccggcgccaccataacaccccacggttga

SEQ ID NO: 12468 - DNA, 35 bp, Artificial Sequence
  Synthetic oligonucleotide
actgacacgcgagccgctttctatcaaattccgac

SEQ ID NO: 12469 - DNA, 35 bp, Artificial Sequence
  Synthetic oligonucleotide
tcgctaccccatgcttagtaaggaattcatcaacc

SEQ ID NO: 12470 - DNA, 34 bp, Artificial Sequence
  Synthetic oligonucleotide
atccccccgtgccctacgatttcctctctgagag

SEQ ID NO: 12471 - DNA, 35 bp, Artificial Sequence
  Synthetic oligonucleotide
ggtgcctcccttccgaaaatcttcgcaacctgcct

SEQ ID NO: 12472 - DNA, 37 bp, Artificial Sequence
  Synthetic oligonucleotide
gagccgttccgggaggagtgggcgggaaggagcaaga

SEQ ID NO: 12473 - DNA, 35 bp, Artificial Sequence
  Synthetic oligonucleotide
taacgcacgagatccaggagtgcgacattgtttcc

SEQ ID NO: 12474 - DNA, 36 bp, Artificial Sequence
  Synthetic oligonucleotide
agacaggtgccacgtcgtctccctgcgcttaatcca

SEQ ID NO: 12475 - DNA, 37 bp, Artificial Sequence
  Synthetic oligonucleotide
gtgcggagggactgactaaagggaggaacataaccga

SEQ ID NO: 12476 - DNA, 35 bp, Artificial Sequence
  Synthetic oligonucleotide
ggactccgaacacactgtccgtcaatagttccttc

SEQ ID NO: 12477 - DNA, 38 bp, Artificial Sequence
  Synthetic oligonucleotide
ttgacagctgccttcctcttatgtaacactctctctga

SEQ ID NO: 12478 - DNA, 35 bp, Artificial Sequence
  Synthetic oligonucleotide
agtcctaccactcgaacctgctgacagcacgcacc

SEQ ID NO: 12479 - DNA, 35 bp, Artificial Sequence
  Synthetic oligonucleotide
cacgccagtcctgtaggttttacattttctaatct

SEQ ID NO: 12480 - DNA, 38 bp, Artificial Sequence
  Synthetic oligonucleotide
agtacctcacacctctgctatgttgactatcctcctga

SEQ ID NO: 12481 - DNA, 37 bp, Artificial Sequence
  Synthetic oligonucleotide
accgccaacaccttgctgggtagttctaaccatttga

SEQ ID NO: 12482 - DNA, 35 bp, Artificial Sequence
  Synthetic oligonucleotide
atcgccctcgcccgcaggttttcgcataaaaccac

SEQ ID NO: 12483 - DNA, 35 bp, Artificial Sequence
  Synthetic oligonucleotide
gagctcgtgtcatgcccgccgtccccgcacctccg

SEQ ID NO: 12484 - DNA, 35 bp, Artificial Sequence
  Synthetic oligonucleotide
acccattcgtaggcttgctcctccgccttactcca

SEQ ID NO: 12485 - DNA, 37 bp, Artificial Sequence
  Synthetic oligonucleotide
tcacgaggaggggtgggttgtttgagaaggtgataga

SEQ ID NO: 12486 - DNA, 35 bp, Artificial Sequence
  Synthetic oligonucleotide
gacctccagcctatactgattacggatcttcccac

SEQ ID NO: 12487 - DNA, 35 bp, Artificial Sequence
  Synthetic oligonucleotide
tactttacaccgcctgttattcgtccaatatgccc

SEQ ID NO: 12488 - DNA, 37 bp, Artificial Sequence
  Synthetic oligonucleotide
tcgattcatcacccctattcctttatgacagttccga

SEQ ID NO: 12489 - DNA, 37 bp, Artificial Sequence
  Synthetic oligonucleotide
tgagccctgcaatccacactcacgctcatgtccctga

SEQ ID NO: 12490 - DNA, 35 bp, Artificial Sequence
  Synthetic oligonucleotide
ggtgtaccacatatgccccattctcatcacttggc

SEQ ID NO: 12491 - DNA, 35 bp, Artificial Sequence
  Synthetic oligonucleotide
ccaccctgccaccgcttaccctgttttgccttgat

SEQ ID NO: 12492 - DNA, 35 bp, Artificial Sequence
  Synthetic oligonucleotide
tggagcccgttacatcatgatctgtacactccccc

SEQ ID NO: 12493 - DNA, 38 bp, Artificial Sequence
  Synthetic oligonucleotide
gccatcgccgcaccacctgcactgccatcaaattctga

SEQ ID NO: 12494 - DNA, 35 bp, Artificial Sequence
  Synthetic oligonucleotide
tacatggcgcgctgccccgcttctctcgtgcacct

SEQ ID NO: 12495 - DNA, 35 bp, Artificial Sequence
  Synthetic oligonucleotide
gggaatccactgcatctgctcaccgactgcctacc

SEQ ID NO: 12496 - DNA, 37 bp, Artificial Sequence
  Synthetic oligonucleotide
gagtgggagtgtggtgggctttagagcaggggagtga

SEQ ID NO: 12497 - DNA, 35 bp, Artificial Sequence
  Synthetic oligonucleotide
tgtgaggaaaagtgaaggggggagctaaccgggga

SEQ ID NO: 12498 - DNA, 35 bp, Artificial Sequence
  Synthetic oligonucleotide
ttctcctgcgcgctgcccccgtcccggctgctcct

SEQ ID NO: 12499 - DNA, 36 bp, Artificial Sequence
  Synthetic oligonucleotide
gaaccgacccacctaagccttccgccacttgtggaa

SEQ ID NO: 12500 - DNA, 35 bp, Artificial Sequence
  Synthetic oligonucleotide
ttctcatcccacttggtcaaagccctgattctgtc

SEQ ID NO: 12501 - DNA, 35 bp, Artificial Sequence
  Synthetic oligonucleotide
tcgcgtccaccacacttgtctgtaacgtccctttg

SEQ ID NO: 12502 - DNA, 35 bp, Artificial Sequence
  Synthetic oligonucleotide
tacgcgcgccccttcatacttgtcatttcctcgct

SEQ ID NO: 12503 - DNA, 35 bp, Artificial Sequence
  Synthetic oligonucleotide
ggaggagccgcctgctcttcccgccctctatcaaa

SEQ ID NO: 12504 - DNA, 35 bp, Artificial Sequence
  Synthetic oligonucleotide
tccacctgcctcaccctgacacatactcgcccgta

SEQ ID NO: 12505 - DNA, 35 bp, Artificial Sequence
  Synthetic oligonucleotide
agatcgcactcccctcgcactgttgtccgtacact

SEQ ID NO: 12506 - DNA, 35 bp, Artificial Sequence
  Synthetic oligonucleotide
tatcccgcacacctcggaccatcttctaaagcacc

SEQ ID NO: 12507 - DNA, 36 bp, Artificial Sequence
  Synthetic oligonucleotide
gttcgcgccagccagcttactgtcctacacccacca

SEQ ID NO: 12508 - DNA, 38 bp, Artificial Sequence
  Synthetic oligonucleotide
gcatgcactgccgggacgtacctgtagcctcctcctga

SEQ ID NO: 12509 - DNA, 37 bp, Artificial Sequence
  Synthetic oligonucleotide
tacgagccccccccggtactgtcccctcggaacttga

SEQ ID NO: 12510 - DNA, 35 bp, Artificial Sequence
  Synthetic oligonucleotide
gaagaaggggaagaacgtacgaaaagtaactctgg

SEQ ID NO: 12511 - DNA, 36 bp, Artificial Sequence
  Synthetic oligonucleotide
tcgtgtggcctctgctatgctcaccacctttcctta

SEQ ID NO: 12512 - DNA, 35 bp, Artificial Sequence
  Synthetic oligonucleotide
acatatcgtggccccgctcttgtagtccccccctg

SEQ ID NO: 12513 - DNA, 38 bp, Artificial Sequence
  Synthetic oligonucleotide
gtccgacgccgtcaatgtctcgcctgcccttgccatga

SEQ ID NO: 12514 - DNA, 35 bp, Artificial Sequence
  Synthetic oligonucleotide
gcctcctgccgcactcctatcaagcacgtgttgta

SEQ ID NO: 12515 - DNA, 36 bp, Artificial Sequence
  Synthetic oligonucleotide
atcttgcgcttcctgcaccttgttatcgtaccatta

SEQ ID NO: 12516 - DNA, 35 bp, Artificial Sequence
  Synthetic oligonucleotide
tacccatgcacctttgatattgcccgcccccagat

SEQ ID NO: 12517 - DNA, 35 bp, Artificial Sequence
  Synthetic oligonucleotide
acgtcactctttgccctatccatcgtgttccttgt

SEQ ID NO: 12518 - DNA, 35 bp, Artificial Sequence
  Synthetic oligonucleotide
tcccccgggcaatgcacttacacacgctccttgaa

SEQ ID NO: 12519 - DNA, 37 bp, Artificial Sequence
  Synthetic oligonucleotide
tccccagccgtatttcgtttctttgctatcgttccga

SEQ ID NO: 12520 - DNA, 35 bp, Artificial Sequence
  Synthetic oligonucleotide
acgaccacttgacacactacacatatgcgccattc

SEQ ID NO: 12521 - DNA, 35 bp, Artificial Sequence
  Synthetic oligonucleotide
gaacaccctctcatacgtgataccatattgtaagt

SEQ ID NO: 12522 - DNA, 38 bp, Artificial Sequence
  Synthetic oligonucleotide
gcccacaatcggagcaatgaacactgcatctatcatga

SEQ ID NO: 12523 - DNA, 38 bp, Artificial Sequence
  Synthetic oligonucleotide
tcgatacgcctccttcgcccgacaccctgattctctga

SEQ ID NO: 12524 - DNA, 35 bp, Artificial Sequence
  Synthetic oligonucleotide
ttcgagctccagtcaatccatccatgtccgcccat

SEQ ID NO: 12525 - DNA, 35 bp, Artificial Sequence
  Synthetic oligonucleotide
atcagagggcgggaggggttaagacgggatggccc

SEQ ID NO: 12526 - DNA, 35 bp, Artificial Sequence
  Synthetic oligonucleotide
agcaccccgctactccgttcttccttccgaatgcc

SEQ ID NO: 12527 - DNA, 35 bp, Artificial Sequence
  Synthetic oligonucleotide
gttggacccacatttgccatcttccttctcgaagc

SEQ ID NO: 12528 - DNA, 37 bp, Artificial Sequence
  Synthetic oligonucleotide
gcatgtggaaggggcaagtagaagaagaaggaagcga

SEQ ID NO: 12529 - DNA, 35 bp, Artificial Sequence
  Synthetic oligonucleotide
gacgccacagatagcccactacttgaatgacttga

SEQ ID NO: 12530 - DNA, 35 bp, Artificial Sequence
  Synthetic oligonucleotide
gagcatcaacccgtcgctctttgcttctttgctgc

SEQ ID NO: 12531 - DNA, 35 bp, Artificial Sequence
  Synthetic oligonucleotide
agccgaccgtatgcccccccaatcccctacaggct

SEQ ID NO: 12532 - DNA, 35 bp, Artificial Sequence
  Synthetic oligonucleotide
accccaccgatatctctttaattcaccgtttgcta

SEQ ID NO: 12533 - DNA, 38 bp, Artificial Sequence
  Synthetic oligonucleotide
actggccggagtgagggaggaggaaaggattaccgtga

SEQ ID NO: 12534 - DNA, 35 bp, Artificial Sequence
  Synthetic oligonucleotide
tatcacccgcgatcgtactcgcgtagctcttagcc

SEQ ID NO: 12535 - DNA, 35 bp, Artificial Sequence
  Synthetic oligonucleotide
ttactccagccgagacttactggatctgcccctcc

SEQ ID NO: 12536 - DNA, 35 bp, Artificial Sequence
  Synthetic oligonucleotide
gcgacattgcatgcctccctgtccaacatacggtc

SEQ ID NO: 12537 - DNA, 36 bp, Artificial Sequence
  Synthetic oligonucleotide
atgcgaggggggacagggaaaagacaacggggccaa

SEQ ID NO: 12538 - DNA, 38 bp, Artificial Sequence
  Synthetic oligonucleotide
aagcgccgtcgcagagtctattcaccaccctcccctga

SEQ ID NO: 12539 - DNA, 36 bp, Artificial Sequence
  Synthetic oligonucleotide
tctgcacctccgctaccaggacttgcaccttccata

SEQ ID NO: 12540 - DNA, 35 bp, Artificial Sequence
  Synthetic oligonucleotide
tactgtatccacggggtgtcccctgcaatcacttc

SEQ ID NO: 12541 - DNA, 35 bp, Artificial Sequence
  Synthetic oligonucleotide
tgacccccccgccgtgtggaatccgcacataatgg

SEQ ID NO: 12542 - DNA, 35 bp, Artificial Sequence
  Synthetic oligonucleotide
ttcgcgtacccatgtataccttccctggccttcta

SEQ ID NO: 12543 - DNA, 35 bp, Artificial Sequence
  Synthetic oligonucleotide
tcgaggctctgcctagttgattttctgtcccttta

SEQ ID NO: 12544 - DNA, 35 bp, Artificial Sequence
  Synthetic oligonucleotide
atctccagagcgcgctcccatattcttgcgccacc

SEQ ID NO: 12545 - DNA, 35 bp, Artificial Sequence
  Synthetic oligonucleotide
atgcatcaacttggctcgtttggcacccatttcca

SEQ ID NO: 12546 - DNA, 37 bp, Artificial Sequence
  Synthetic oligonucleotide
gtaccccagccctctgctagttcacctttccaaatga

SEQ ID NO: 12547 - DNA, 36 bp, Artificial Sequence
  Synthetic oligonucleotide
ggacacgtactcatggttgttgtctcccatcttgca

SEQ ID NO: 12548 - DNA, 36 bp, Artificial Sequence
  Synthetic oligonucleotide
gatgcgccttctttcttattgagctgccttttctca

SEQ ID NO: 12549 - DNA, 35 bp, Artificial Sequence
  Synthetic oligonucleotide
tgtacgcccacctgtaattcacgaagctccacata

SEQ ID NO: 12550 - DNA, 35 bp, Artificial Sequence
  Synthetic oligonucleotide
gacccctcgctctttcgtagtgccgtcgcacttca

SEQ ID NO: 12551 - DNA, 36 bp, Artificial Sequence
  Synthetic oligonucleotide
gcagaaccgctgcccttattgccgcccccgacgaca

SEQ ID NO: 12552 - DNA, 36 bp, Artificial Sequence
  Synthetic oligonucleotide
tcacgactctatgtccgacacaatcccacatctgca

SEQ ID NO: 12553 - DNA, 37 bp, Artificial Sequence
  Synthetic oligonucleotide
aggagcatccgcccgtgcatacacaccacctttctga

SEQ ID NO: 12554 - DNA, 36 bp, Artificial Sequence
  Synthetic oligonucleotide
ttcgaccgcagggtagcacaaccacatacctcaata

SEQ ID NO: 12555 - DNA, 35 bp, Artificial Sequence
  Synthetic oligonucleotide
gttttccagccgctcatctctgcaccatcacgacc

SEQ ID NO: 12556 - DNA, 35 bp, Artificial Sequence
  Synthetic oligonucleotide
acctcaaggcccatctactagtgtcaactgctttc

SEQ ID NO: 12557 - DNA, 35 bp, Artificial Sequence
  Synthetic oligonucleotide
acccgggtccagacctccctccttactgtcgcaaa

SEQ ID NO: 12558 - DNA, 36 bp, Artificial Sequence
  Synthetic oligonucleotide
tagccactcctgtatgcgaacgcatgacccattcga

SEQ ID NO: 12559 - DNA, 35 bp, Artificial Sequence
  Synthetic oligonucleotide
ggtgccaagtttccgtcgcattactacctccgtgc

SEQ ID NO: 12560 - DNA, 36 bp, Artificial Sequence
  Synthetic oligonucleotide
gaaaagggatgggggggaaggagaaccgcagtgcca

SEQ ID NO: 12561 - DNA, 37 bp, Artificial Sequence
  Synthetic oligonucleotide
atctcgcgtaccggtccgtttagcaactccttcccga

SEQ ID NO: 12562 - DNA, 36 bp, Artificial Sequence
  Synthetic oligonucleotide
tacgtaccgtagggagtaaggggggggggatcgcga

SEQ ID NO: 12563 - DNA, 36 bp, Artificial Sequence
  Synthetic oligonucleotide
tacgtactcgtctccctgcttgcaagttctgctcga

SEQ ID NO: 12564 - DNA, 38 bp, Artificial Sequence
  Synthetic oligonucleotide
tgccaccccagccccgcgcaacagcactacgatgctga

SEQ ID NO: 12565 - DNA, 35 bp, Artificial Sequence
  Synthetic oligonucleotide
tatcccacgtcctggtacaattccctactatcctg

SEQ ID NO: 12566 - DNA, 35 bp, Artificial Sequence
  Synthetic oligonucleotide
taagaccacacagctgcgctatccgaatgcctttt

SEQ ID NO: 12567 - DNA, 35 bp, Artificial Sequence
  Synthetic oligonucleotide
tcgaatacgcgtcgctggcaccctccgtcccatct

SEQ ID NO: 12568 - DNA, 36 bp, Artificial Sequence
  Synthetic oligonucleotide
atttccccagcccactctatacacccgatggtccca

SEQ ID NO: 12569 - DNA, 37 bp, Artificial Sequence
  Synthetic oligonucleotide
gggatgtaacggcaccgggaaaaggcaggagagggga

SEQ ID NO: 12570 - DNA, 38 bp, Artificial Sequence
  Synthetic oligonucleotide
gccgccatcaggcgcacgttaggcatttccctctctga

SEQ ID NO: 12571 - DNA, 35 bp, Artificial Sequence
  Synthetic oligonucleotide
gtaacacgtccccggatttcttttgctcgatcgac

SEQ ID NO: 12572 - DNA, 36 bp, Artificial Sequence
  Synthetic oligonucleotide
tgtccacgggcactccctacactgtataccgccaca

SEQ ID NO: 12573 - DNA, 36 bp, Artificial Sequence
  Synthetic oligonucleotide
gcccacttcgatatgctcgatcctttgtagttcaca

SEQ ID NO: 12574 - DNA, 37 bp, Artificial Sequence
  Synthetic oligonucleotide
tcagacatcctctatcctccgcctctggccacacgga

SEQ ID NO: 12575 - DNA, 35 bp, Artificial Sequence
  Synthetic oligonucleotide
gttgctgccctcacgctttttacatttcccagggt

SEQ ID NO: 12576 - DNA, 35 bp, Artificial Sequence
  Synthetic oligonucleotide
tcagtcgcccttggtagcccgcgccattcctgttt

SEQ ID NO: 12577 - DNA, 36 bp, Artificial Sequence
  Synthetic oligonucleotide
ttggtgagagcaggcagggggaggggggaagtaaca

SEQ ID NO: 12578 - DNA, 36 bp, Artificial Sequence
  Synthetic oligonucleotide
atgccaccccccattgactgcagcaacggttcacta

SEQ ID NO: 12579 - DNA, 35 bp, Artificial Sequence
  Synthetic oligonucleotide
acacaacgcccctaatactgctccgttactggttc

SEQ ID NO: 12580 - DNA, 35 bp, Artificial Sequence
  Synthetic oligonucleotide
agttgtggagggaaggtaggggagttacggaaagt

SEQ ID NO: 12581 - DNA, 36 bp, Artificial Sequence
  Synthetic oligonucleotide
gtagccagccccagctccccgtttgttcactcaggt

SEQ ID NO: 12582 - DNA, 35 bp, Artificial Sequence
  Synthetic oligonucleotide
tctgcttgccccactccgcgctcatagcttccgta

SEQ ID NO: 12583 - DNA, 35 bp, Artificial Sequence
  Synthetic oligonucleotide
attcccgccatcacctccctttagggtgacgttta

SEQ ID NO: 12584 - DNA, 37 bp, Artificial Sequence
  Synthetic oligonucleotide
gccccagtcgcccgaagatttaggctttcctcctcga

SEQ ID NO: 12585 - DNA, 35 bp, Artificial Sequence
  Synthetic oligonucleotide
gacccacgccgggtaggtttccccctgttggtttc

SEQ ID NO: 12586 - DNA, 35 bp, Artificial Sequence
  Synthetic oligonucleotide
tctcaccgcggcaagttcatcaaggtcctatccct

SEQ ID NO: 12587 - DNA, 38 bp, Artificial Sequence
  Synthetic oligonucleotide
tcgattaccgaccgtgcctctcaaccctcattgcctga

SEQ ID NO: 12588 - DNA, 36 bp, Artificial Sequence
  Synthetic oligonucleotide
actcatcctaccagcgtttcgttctcccgactctga

SEQ ID NO: 12589 - DNA, 36 bp, Artificial Sequence
  Synthetic oligonucleotide
aatcacctcagcctcttgacgccgcctgctgttcta

SEQ ID NO: 12590 - DNA, 35 bp, Artificial Sequence
  Synthetic oligonucleotide
tccatcacgaacgtggcctagcccttccacaaaac

SEQ ID NO: 12591 - DNA, 35 bp, Artificial Sequence
  Synthetic oligonucleotide
acaaccccatgcaccgttggagcgtcccactggcc

SEQ ID NO: 12592 - DNA, 35 bp, Artificial Sequence
  Synthetic oligonucleotide
accccgagcgggcgagcggggggtaacaaacctgc

SEQ ID NO: 12593 - DNA, 35 bp, Artificial Sequence
  Synthetic oligonucleotide
tctcccttcactcaccattcgtatcctgggttcca

SEQ ID NO: 12594 - DNA, 37 bp, Artificial Sequence
  Synthetic oligonucleotide
gtgagggaggaggagtggcggagagcttcgggtgaga

SEQ ID NO: 12595 - DNA, 36 bp, Artificial Sequence
  Synthetic oligonucleotide
ggtgcgcagggggttagggcgggctcggggaatgga

SEQ ID NO: 12596 - DNA, 36 bp, Artificial Sequence
  Synthetic oligonucleotide
gactcgcgagctccatctacctatagcacgtcctta

SEQ ID NO: 12597 - DNA, 35 bp, Artificial Sequence
  Synthetic oligonucleotide
tagaacacgccgaaccggcaaatacgctttccacc

SEQ ID NO: 12598 - DNA, 35 bp, Artificial Sequence
  Synthetic oligonucleotide
gatctgccggaagggcagccaccactatactcttc

SEQ ID NO: 12599 - DNA, 35 bp, Artificial Sequence
  Synthetic oligonucleotide
gccacacgagcccacggaccacgcgaccgttttta

SEQ ID NO: 12600 - DNA, 37 bp, Artificial Sequence
  Synthetic oligonucleotide
tcaccgcccttcccaacagacactctcaacgtgatga

SEQ ID NO: 12601 - DNA, 36 bp, Artificial Sequence
  Synthetic oligonucleotide
tgattcgcccacccgatctacacgccttggactgta

SEQ ID NO: 12602 - DNA, 38 bp, Artificial Sequence
  Synthetic oligonucleotide
ttcgccctctctcgctatgacctccctctatgaagtga

SEQ ID NO: 12603 - DNA, 38 bp, Artificial Sequence
  Synthetic oligonucleotide
gtgtcaaggagggggaacgcggaacaggggggtggtga

SEQ ID NO: 12604 - DNA, 35 bp, Artificial Sequence
  Synthetic oligonucleotide
gttcgccacaccttcctgcaggcgttcccgaccac

SEQ ID NO: 12605 - DNA, 37 bp, Artificial Sequence
  Synthetic oligonucleotide
acaccattgccctcctcgtgacgttacttaccatgga

SEQ ID NO: 12606 - DNA, 35 bp, Artificial Sequence
  Synthetic oligonucleotide
atctccacccccgcttaccaggcgccacactcgac

SEQ ID NO: 12607 - DNA, 35 bp, Artificial Sequence
  Synthetic oligonucleotide
aaccaacggctcagatcccctttctaccgagtttg

SEQ ID NO: 12608 - DNA, 37 bp, Artificial Sequence
  Synthetic oligonucleotide
aaccaccaatgccatctgtagaaccacgctatctgga

SEQ ID NO: 12609 - DNA, 35 bp, Artificial Sequence
  Synthetic oligonucleotide
aaggggaaggaaaatggtcgtaggtaaaggcgtgt

SEQ ID NO: 12610 - DNA, 36 bp, Artificial Sequence
  Synthetic oligonucleotide
tagcacaccgcatcacataaagtctatacactgtca

SEQ ID NO: 12611 - DNA, 35 bp, Artificial Sequence
  Synthetic oligonucleotide
acgaactacctcacccatccgcatgccgactcaat

SEQ ID NO: 12612 - DNA, 35 bp, Artificial Sequence
  Synthetic oligonucleotide
accctgcctcctacaagaacccctcgtggtcgact

SEQ ID NO: 12613 - DNA, 36 bp, Artificial Sequence
  Synthetic oligonucleotide
gtcccctgccgatcaaattagctccgacttacgtaa

SEQ ID NO: 12614 - DNA, 38 bp, Artificial Sequence
  Synthetic oligonucleotide
aacagcccaatggtccccatatcgtgtcctaactctga

SEQ ID NO: 12615 - DNA, 37 bp, Artificial Sequence
  Synthetic oligonucleotide
tacgcgaccctttgctgtttacgccctgattccttga

SEQ ID NO: 12616 - DNA, 35 bp, Artificial Sequence
  Synthetic oligonucleotide
atcgcggtgcacatatcaatcctcgtcttgcttag

SEQ ID NO: 12617 - DNA, 35 bp, Artificial Sequence
  Synthetic oligonucleotide
tgaaacccacataccgcgacctctctctacctggg

SEQ ID NO: 12618 - DNA, 35 bp, Artificial Sequence
  Synthetic oligonucleotide
gtctccccctagctagctattctccatccgccctg

SEQ ID NO: 12619 - DNA, 36 bp, Artificial Sequence
  Synthetic oligonucleotide
gaacacccctctcctgactgactgcaatggctgcca

SEQ ID NO: 12620 - DNA, 36 bp, Artificial Sequence
  Synthetic oligonucleotide
gccgctaaagcgccgcaactaccaccccctgcccga

SEQ ID NO: 12621 - DNA, 35 bp, Artificial Sequence
  Synthetic oligonucleotide
tacgtgcgcgccatgcctcaattccttccaccccg

SEQ ID NO: 12622 - DNA, 35 bp, Artificial Sequence
  Synthetic oligonucleotide
acagtgcccctgcacgaagcccccgaatgcaatct

SEQ ID NO: 12623 - DNA, 35 bp, Artificial Sequence
  Synthetic oligonucleotide
tccatccgcattcaaatcatcgtctggctttcctt

SEQ ID NO: 12624 - DNA, 37 bp, Artificial Sequence
  Synthetic oligonucleotide
acccacgctagcacggaccatccgctaaccataccga

SEQ ID NO: 12625 - DNA, 36 bp, Artificial Sequence
  Synthetic oligonucleotide
ggaacgtgcaggggggaaggatgatcggggagcgta

SEQ ID NO: 12626 - DNA, 35 bp, Artificial Sequence
  Synthetic oligonucleotide
gccgactggcttccctttgtagttttttcagtgcc

SEQ ID NO: 12627 - DNA, 35 bp, Artificial Sequence
  Synthetic oligonucleotide
gaaccatgtaccacctagctttgtgggctccgctc

SEQ ID NO: 12628 - DNA, 35 bp, Artificial Sequence
  Synthetic oligonucleotide
ttagaagcctccttagtcgccacccgccttactcg

SEQ ID NO: 12629 - DNA, 36 bp, Artificial Sequence
  Synthetic oligonucleotide
gcacccgtgcttcatcattgctccctgcctcctgaa

SEQ ID NO: 12630 - DNA, 38 bp, Artificial Sequence
  Synthetic oligonucleotide
tgccgcccagctttaggtcctgccaccacatctgctga

SEQ ID NO: 12631 - DNA, 38 bp, Artificial Sequence
  Synthetic oligonucleotide
gccattggccatcttggtctacgtgaccctccctttga

SEQ ID NO: 12632 - DNA, 35 bp, Artificial Sequence
  Synthetic oligonucleotide
agccgagccacgaggccacttccatcccaatccta

SEQ ID NO: 12633 - DNA, 37 bp, Artificial Sequence
  Synthetic oligonucleotide
tgtccacattactgctaactgccgcaccactcttgga

SEQ ID NO: 12634 - DNA, 35 bp, Artificial Sequence
  Synthetic oligonucleotide
acgtacgcacgacgtccgtacccgttactgccctc

SEQ ID NO: 12635 - DNA, 37 bp, Artificial Sequence
  Synthetic oligonucleotide
gccaactccatgacccccatacagactactcggttga

SEQ ID NO: 12636 - DNA, 36 bp, Artificial Sequence
  Synthetic oligonucleotide
gcccgcaaagcctctgtttaatcctccctgttccga

SEQ ID NO: 12637 - DNA, 37 bp, Artificial Sequence
  Synthetic oligonucleotide
ggggggtgccgaggggcagtaggggaggaaggatgga

SEQ ID NO: 12638 - DNA, 38 bp, Artificial Sequence
  Synthetic oligonucleotide
actcaccgccgcaccttcctctatctgtctacgcctga

SEQ ID NO: 12639 - DNA, 35 bp, Artificial Sequence
  Synthetic oligonucleotide
gcctagctaccaacaccttttgtgacgtcctctta

SEQ ID NO: 12640 - DNA, 36 bp, Artificial Sequence
  Synthetic oligonucleotide
ttgaccacaaaccgtgggtaataaccgctaccacca

SEQ ID NO: 12641 - DNA, 36 bp, Artificial Sequence
  Synthetic oligonucleotide
tcacgactgacgttatccgaacctcccactttccca

SEQ ID NO: 12642 - DNA, 38 bp, Artificial Sequence
  Synthetic oligonucleotide
acacatccatcccagcacatcgcagacaggccccatga

SEQ ID NO: 12643 - DNA, 37 bp, Artificial Sequence
  Synthetic oligonucleotide
tgtcaagggccctccatatcgctcctatcctcagtga

SEQ ID NO: 12644 - DNA, 35 bp, Artificial Sequence
  Synthetic oligonucleotide
acatcgacgctcctccgacatcctgtacccttttg

SEQ ID NO: 12645 - DNA, 35 bp, Artificial Sequence
  Synthetic oligonucleotide
gtaacgcgcacgtacctccagccttctacacgttt

SEQ ID NO: 12646 - DNA, 38 bp, Artificial Sequence
  Synthetic oligonucleotide
gagcaagggggagaaaggagggaaaggtgagattatga

SEQ ID NO: 12647 - DNA, 36 bp, Artificial Sequence
  Synthetic oligonucleotide
tttgacgggggaaaggagtaggacggaagatgggca

SEQ ID NO: 12648 - DNA, 35 bp, Artificial Sequence
  Synthetic oligonucleotide
tcaaacaagccactggcccgcctcctgctattcct

SEQ ID NO: 12649 - DNA, 35 bp, Artificial Sequence
  Synthetic oligonucleotide
taagcccaccaacaccggcgcacctccagagcact

SEQ ID NO: 12650 - DNA, 35 bp, Artificial Sequence
  Synthetic oligonucleotide
cacgagcccaccaagtcaacgcccctagcactttc

SEQ ID NO: 12651 - DNA, 36 bp, Artificial Sequence
  Synthetic oligonucleotide
ttgggagccctgcaacgttactatagtcttttccca

SEQ ID NO: 12652 - DNA, 37 bp, Artificial Sequence
  Synthetic oligonucleotide
gcccttgccatctgccccgttcacagaatctcccaga

SEQ ID NO: 12653 - DNA, 35 bp, Artificial Sequence
  Synthetic oligonucleotide
accaacctccgtctttcctttactgagtcttgtca

SEQ ID NO: 12654 - DNA, 36 bp, Artificial Sequence
  Synthetic oligonucleotide
tttccgaacgcattccacgttaactcgtgaccttca

SEQ ID NO: 12655 - DNA, 35 bp, Artificial Sequence
  Synthetic oligonucleotide
gtggctccgtgtttgtctcgttttagctccttcca

SEQ ID NO: 12656 - DNA, 35 bp, Artificial Sequence
  Synthetic oligonucleotide
gatgcgccagcagggccaacttcactctcaacctc

SEQ ID NO: 12657 - DNA, 35 bp, Artificial Sequence
  Synthetic oligonucleotide
gcccaaaccctccccttgtattgcacggcgaattc

SEQ ID NO: 12658 - DNA, 35 bp, Artificial Sequence
  Synthetic oligonucleotide
aatcattccacccgttccaacacacagagagatct

SEQ ID NO: 12659 - DNA, 36 bp, Artificial Sequence
  Synthetic oligonucleotide
tatactcggcgctccccactcggcctcagcatccca

SEQ ID NO: 12660 - DNA, 35 bp, Artificial Sequence
  Synthetic oligonucleotide
acctggtcaggtcgagtcattatcggcctcccctc

SEQ ID NO: 12661 - DNA, 35 bp, Artificial Sequence
  Synthetic oligonucleotide
tctgcccctcaggcgttcccttctccccccgttag

SEQ ID NO: 12662 - DNA, 35 bp, Artificial Sequence
  Synthetic oligonucleotide
tgcccccctagcctatgtgcaccatacgcctctcg

SEQ ID NO: 12663 - DNA, 35 bp, Artificial Sequence
  Synthetic oligonucleotide
gccacctagccccccgaaagctcgcccgccactaa

SEQ ID NO: 12664 - DNA, 35 bp, Artificial Sequence
  Synthetic oligonucleotide
gcacgagccaatcccacgctataccgcctggtaca

SEQ ID NO: 12665 - DNA, 35 bp, Artificial Sequence
  Synthetic oligonucleotide
gccgtcctactgcggccccatacccgacgatttgc

SEQ ID NO: 12666 - DNA, 35 bp, Artificial Sequence
  Synthetic oligonucleotide
gcaaccacactgttggtgtcccagcttaccaaatc

SEQ ID NO: 12667 - DNA, 36 bp, Artificial Sequence
  Synthetic oligonucleotide
taacaaggagggaggtgtgtgggaggcggtacgcaa

SEQ ID NO: 12668 - DNA, 35 bp, Artificial Sequence
  Synthetic oligonucleotide
gttgtgcgcagggggggcaaactggggtggatgag

SEQ ID NO: 12669 - DNA, 36 bp, Artificial Sequence
  Synthetic oligonucleotide
aatgcgctgcagccactattctcgcgaccacgttca

SEQ ID NO: 12670 - DNA, 37 bp, Artificial Sequence
  Synthetic oligonucleotide
atactaaccacaatgccgacctacccgcctcgccgga

SEQ ID NO: 12671 - DNA, 35 bp, Artificial Sequence
  Synthetic oligonucleotide
acataccgataggtattctgacgcactacgccctc

SEQ ID NO: 12672 - DNA, 37 bp, Artificial Sequence
  Synthetic oligonucleotide
tgagagagacctaggagtacgaaggagaaagggggga

SEQ ID NO: 12673 - DNA, 35 bp, Artificial Sequence
  Synthetic oligonucleotide
gccacacattgacttggcattctacgaccccgctc

SEQ ID NO: 12674 - DNA, 35 bp, Artificial Sequence
  Synthetic oligonucleotide
gtgacaactaagttattttgccccccgacttcttg

SEQ ID NO: 12675 - DNA, 35 bp, Artificial Sequence
  Synthetic oligonucleotide
gcttaccgctcgccggtgactttttaaccttctac

SEQ ID NO: 12676 - DNA, 35 bp, Artificial Sequence
  Synthetic oligonucleotide
tacagcttgagcatcactacccgcgtgcccagccc

SEQ ID NO: 12677 - DNA, 35 bp, Artificial Sequence
  Synthetic oligonucleotide
aaatgctcggggggaaagacgagtgggttgggaga

SEQ ID NO: 12678 - DNA, 36 bp, Artificial Sequence
  Synthetic oligonucleotide
gtgcccacccgctaatatgatctatgcgctgtacta

SEQ ID NO: 12679 - DNA, 35 bp, Artificial Sequence
  Synthetic oligonucleotide
atgagccgaccggccaccacctcgtgaatcccacc

SEQ ID NO: 12680 - DNA, 35 bp, Artificial Sequence
  Synthetic oligonucleotide
acatgcccgtttgaggatgcccccttgtgttccct

SEQ ID NO: 12681 - DNA, 35 bp, Artificial Sequence
  Synthetic oligonucleotide
atccgccgagcctcttcagacctggtcgtaccatc

SEQ ID NO: 12682 - DNA, 35 bp, Artificial Sequence
  Synthetic oligonucleotide
gccaccacagtgccggcctagtactcttgcctaga

SEQ ID NO: 12683 - DNA, 36 bp, Artificial Sequence
  Synthetic oligonucleotide
tacaccggccgtgcacatcccgaccttaaccccgta

SEQ ID NO: 12684 - DNA, 35 bp, Artificial Sequence
  Synthetic oligonucleotide
gttgttgaagccgtccaccgtaccgcccttatgcc

SEQ ID NO: 12685 - DNA, 35 bp, Artificial Sequence
  Synthetic oligonucleotide
gttaggggggggaacgggaggacattagacaattt

SEQ ID NO: 12686 - DNA, 38 bp, Artificial Sequence
  Synthetic oligonucleotide
gtggtgccagctatgcatctcgtcctcctgagccctga

SEQ ID NO: 12687 - DNA, 35 bp, Artificial Sequence
  Synthetic oligonucleotide
taagcttgccccgctctgttgctcgcctgcctcct

SEQ ID NO: 12688 - DNA, 36 bp, Artificial Sequence
  Synthetic oligonucleotide
tactcggatcgtgcgcgtgcttccttcctgcccgaa

SEQ ID NO: 12689 - DNA, 37 bp, Artificial Sequence
  Synthetic oligonucleotide
gacaatggagtgggggaaggtgggttacagctgcaga

SEQ ID NO: 12690 - DNA, 35 bp, Artificial Sequence
  Synthetic oligonucleotide
agggaaaggggtgggaggggggatggtcgaaggtg

SEQ ID NO: 12691 - DNA, 38 bp, Artificial Sequence
  Synthetic oligonucleotide
gagagcacgaaggggggaggaagcagagtgttctatga

SEQ ID NO: 12692 - DNA, 35 bp, Artificial Sequence
  Synthetic oligonucleotide
gcatgtacacggtcttttgctggctttacccttta

SEQ ID NO: 12693 - DNA, 35 bp, Artificial Sequence
  Synthetic oligonucleotide
tacgtgccctggtggtagcgcccctgcactcttta

SEQ ID NO: 12694 - DNA, 35 bp, Artificial Sequence
  Synthetic oligonucleotide
tccacacccatcgaattagttacttctccgcgatc

SEQ ID NO: 12695 - DNA, 38 bp, Artificial Sequence
  Synthetic oligonucleotide
tgctgcccgcacagtgcaccatgcctcacccgtattga

SEQ ID NO: 12696 - DNA, 35 bp, Artificial Sequence
  Synthetic oligonucleotide
gattcactgcgccccttccgctatcgaccgtagct

SEQ ID NO: 12697 - DNA, 37 bp, Artificial Sequence
  Synthetic oligonucleotide
acacacatccttgtgcatccctgtaaaaattgattga

SEQ ID NO: 12698 - DNA, 35 bp, Artificial Sequence
  Synthetic oligonucleotide
gttgccacagcggttatcctacgacttccccgcgc

SEQ ID NO: 12699 - DNA, 35 bp, Artificial Sequence
  Synthetic oligonucleotide
tccctccctcgatcttgagtactagctagcctggc

SEQ ID NO: 12700 - DNA, 35 bp, Artificial Sequence
  Synthetic oligonucleotide
tgcctcgccccttattcttgcggtttgcaaatgga

SEQ ID NO: 12701 - DNA, 35 bp, Artificial Sequence
  Synthetic oligonucleotide
atgatacctccgttgggcttttttccatcagacat

SEQ ID NO: 12702 - DNA, 36 bp, Artificial Sequence
  Synthetic oligonucleotide
tgatcctactgctccgtaaccgacgtcttatcttca

SEQ ID NO: 12703 - DNA, 37 bp, Artificial Sequence
  Synthetic oligonucleotide
gtgcccatcacaaagttctatgcgctatccacttcga

SEQ ID NO: 12704 - DNA, 37 bp, Artificial Sequence
  Synthetic oligonucleotide
atacccgcctcacacagcctccctgtgcttcatggga

SEQ ID NO: 12705 - DNA, 37 bp, Artificial Sequence
  Synthetic oligonucleotide
accacacccctgaggccttggtaccctattaatatga

SEQ ID NO: 12706 - DNA, 35 bp, Artificial Sequence
  Synthetic oligonucleotide
acctaacatgtgctgttgtttagcattctccaccc

SEQ ID NO: 12707 - DNA, 35 bp, Artificial Sequence
  Synthetic oligonucleotide
acccatgtcgcttccaccataatctgctgtttctc

SEQ ID NO: 12708 - DNA, 37 bp, Artificial Sequence
  Synthetic oligonucleotide
tgcacggatagagggtgagggcactagggggagggga

SEQ ID NO: 12709 - DNA, 37 bp, Artificial Sequence
  Synthetic oligonucleotide
agggggggacggagtggggatgggtgccgtttgggga

SEQ ID NO: 12710 - DNA, 35 bp, Artificial Sequence
  Synthetic oligonucleotide
tcctgccattcacgttgctcatccattatacacct

SEQ ID NO: 12711 - DNA, 36 bp, Artificial Sequence
  Synthetic oligonucleotide
aatccgcgatctgtcttctgcgccacctcacccgaa

SEQ ID NO: 12712 - DNA, 35 bp, Artificial Sequence
  Synthetic oligonucleotide
gtgctcgccaccaggccgaaccttacttgccacca

SEQ ID NO: 12713 - DNA, 35 bp, Artificial Sequence
  Synthetic oligonucleotide
atgcgcacgagagggtgggatggggagggtatcca

SEQ ID NO: 12714 - DNA, 36 bp, Artificial Sequence
  Synthetic oligonucleotide
gttcagtgccacaactgaggatcataccatcttgca

SEQ ID NO: 12715 - DNA, 35 bp, Artificial Sequence
  Synthetic oligonucleotide
gtggctcactgcaactgacattaagccgtatccac

SEQ ID NO: 12716 - DNA, 35 bp, Artificial Sequence
  Synthetic oligonucleotide
taacgacgcgctactgcctttggtgatatccctcc

SEQ ID NO: 12717 - DNA, 38 bp, Artificial Sequence
  Synthetic oligonucleotide
atcaaccatcgcttcctgggccctctctcgctctgtga

SEQ ID NO: 12718 - DNA, 36 bp, Artificial Sequence
  Synthetic oligonucleotide
acatgacaccctcactgaaatcttggacatcgcgta

SEQ ID NO: 12719 - DNA, 35 bp, Artificial Sequence
  Synthetic oligonucleotide
ttgcacaccgacgccacgacaaaagtcgcacacct

SEQ ID NO: 12720 - DNA, 38 bp, Artificial Sequence
  Synthetic oligonucleotide
ggggtggggaagggtgggcctttttagaggcggactga

SEQ ID NO: 12721 - DNA, 35 bp, Artificial Sequence
  Synthetic oligonucleotide
gtactgcgacaatcagccgccctatccaaccatcc

SEQ ID NO: 12722 - DNA, 35 bp, Artificial Sequence
  Synthetic oligonucleotide
agatcagacggaccgctcctcacccccgctgaatt

SEQ ID NO: 12723 - DNA, 37 bp, Artificial Sequence
  Synthetic oligonucleotide
agacctcccatttgttctatgtaccactccttccaga

SEQ ID NO: 12724 - DNA, 35 bp, Artificial Sequence
  Synthetic oligonucleotide
acacggtgaccgccccacaatccacgccattgcat

SEQ ID NO: 12725 - DNA, 35 bp, Artificial Sequence
  Synthetic oligonucleotide
actgtcccctccgctgcggtgcactgctgtacaca

SEQ ID NO: 12726 - DNA, 37 bp, Artificial Sequence
  Synthetic oligonucleotide
gtggggtgagggaaataggcgggttggacgggaatga

SEQ ID NO: 12727 - DNA, 38 bp, Artificial Sequence
  Synthetic oligonucleotide
gatgccggtgtcgggctaaggggagtgggtggggctga

SEQ ID NO: 12728 - DNA, 35 bp, Artificial Sequence
  Synthetic oligonucleotide
ggactgggtgagtggtgggtgtgtggctgaaaggg

SEQ ID NO: 12729 - DNA, 35 bp, Artificial Sequence
  Synthetic oligonucleotide
gtgagcccggtcgtgtttgctctatccttccgtgt

SEQ ID NO: 12730 - DNA, 38 bp, Artificial Sequence
  Synthetic oligonucleotide
tgtgtaggacggggggggtattcaaatagagtgtgtga

SEQ ID NO: 12731 - DNA, 35 bp, Artificial Sequence
  Synthetic oligonucleotide
ttgcgtactgctcctctacgatagtgattgttctc

SEQ ID NO: 12732 - DNA, 35 bp, Artificial Sequence
  Synthetic oligonucleotide
gattcgcctccgcacattgtgaaacgtccctcgta

SEQ ID NO: 12733 - DNA, 35 bp, Artificial Sequence
  Synthetic oligonucleotide
ttgccgttccgctgcttcccctccctgtcgcgtat

SEQ ID NO: 12734 - DNA, 38 bp, Artificial Sequence
  Synthetic oligonucleotide
gtaagctggtcgcttcgtttggcccatctctttgttga

SEQ ID NO: 12735 - DNA, 37 bp, Artificial Sequence
  Synthetic oligonucleotide
acacattgaacctgttttgcgaatacctgcctctgga

SEQ ID NO: 12736 - DNA, 37 bp, Artificial Sequence
  Synthetic oligonucleotide
tccgtgacgccgttgcgaccccctcctgtagttttga

SEQ ID NO: 12737 - DNA, 31 bp, Artificial Sequence
  Synthetic oligonucleotide
ttcccgccccggtccgccggttctcatccaa

SEQ ID NO: 12738 - DNA, 37 bp, Artificial Sequence
  Synthetic oligonucleotide
acacctccctcgacaaacagcagacagttcccgatga

SEQ ID NO: 12739 - DNA, 34 bp, Artificial Sequence
  Synthetic oligonucleotide
gagcgatagcgaatcttcccttttatgcccaacc

SEQ ID NO: 12740 - DNA, 34 bp, Artificial Sequence
  Synthetic oligonucleotide
gcttagagcgcccccctcacgacctccctatcag

SEQ ID NO: 12741 - DNA, 35 bp, Artificial Sequence
  Synthetic oligonucleotide
tagtatctgcccatcccatttgcaatggaccttcg

SEQ ID NO: 12742 - DNA, 35 bp, Artificial Sequence
  Synthetic oligonucleotide
aaagtcagttccgcacccactagttgtccgccctg

SEQ ID NO: 12743 - DNA, 35 bp, Artificial Sequence
  Synthetic oligonucleotide
tcactcccgtgggagcgcaataatcatcgccctca

SEQ ID NO: 12744 - DNA, 35 bp, Artificial Sequence
  Synthetic oligonucleotide
tagtcccccgcctcttgtcggtacattacgcttga

SEQ ID NO: 12745 - DNA, 35 bp, Artificial Sequence
  Synthetic oligonucleotide
tacatccgtgcaaagatccgcattcttcgcccact

SEQ ID NO: 12746 - DNA, 35 bp, Artificial Sequence
  Synthetic oligonucleotide
taccgccgccttcgaataggtttgttctttctgcg

SEQ ID NO: 12747 - DNA, 36 bp, Artificial Sequence
  Synthetic oligonucleotide
gacgccgcacatattctaccaccgtttaccgctaga

SEQ ID NO: 12748 - DNA, 35 bp, Artificial Sequence
  Synthetic oligonucleotide
ttccccccggcccagcccatgctaacgttaaccga

SEQ ID NO: 12749 - DNA, 35 bp, Artificial Sequence
  Synthetic oligonucleotide
tgttcccctcggttcgattcccttcatatgttcca

SEQ ID NO: 12750 - DNA, 37 bp, Artificial Sequence
  Synthetic oligonucleotide
tccccacaccagacttgacgaaccccgacgcttccga

SEQ ID NO: 12751 - DNA, 35 bp, Artificial Sequence
  Synthetic oligonucleotide
acgacgaccagctaccgcttatatacccctaccgc

SEQ ID NO: 12752 - DNA, 35 bp, Artificial Sequence
  Synthetic oligonucleotide
ttattgcccctggtcccctctagccgccgtgtagg

SEQ ID NO: 12753 - DNA, 38 bp, Artificial Sequence
  Synthetic oligonucleotide
acacgcacgtacggagactaccgtgcgtttctttttga

SEQ ID NO: 12754 - DNA, 35 bp, Artificial Sequence
  Synthetic oligonucleotide
gcaccgccgcgaactatcatttccctccatgcaac

SEQ ID NO: 12755 - DNA, 35 bp, Artificial Sequence
  Synthetic oligonucleotide
tcatcatcgacgtggcccgtggtgttcttccctct

SEQ ID NO: 12756 - DNA, 36 bp, Artificial Sequence
  Synthetic oligonucleotide
taaggctagcccctatcccttgtaactatgtgtaca

SEQ ID NO: 12757 - DNA, 36 bp, Artificial Sequence
  Synthetic oligonucleotide
agtccccggcccccggtccctccatgttttcgcaca

SEQ ID NO: 12758 - DNA, 36 bp, Artificial Sequence
  Synthetic oligonucleotide
accctcagcatccgcttgattcttctgttagcctca

SEQ ID NO: 12759 - DNA, 37 bp, Artificial Sequence
  Synthetic oligonucleotide
tccagtccatccgcgctctacagctgttcctgccaga

SEQ ID NO: 12760 - DNA, 35 bp, Artificial Sequence
  Synthetic oligonucleotide
gcctacagtccgctctacctggcgacctttaccaa

SEQ ID NO: 12761 - DNA, 35 bp, Artificial Sequence
  Synthetic oligonucleotide
gcacaccgaggctgtaagcactatcacattcccaa

SEQ ID NO: 12762 - DNA, 37 bp, Artificial Sequence
  Synthetic oligonucleotide
accccaaccccatatgctacctaaggccctcccgtga

SEQ ID NO: 12763 - DNA, 37 bp, Artificial Sequence
  Synthetic oligonucleotide
ggaccggaggggtaaaggggtcggggcgtatgggtga

SEQ ID NO: 12764 - DNA, 36 bp, Artificial Sequence
  Synthetic oligonucleotide
atgaccaccggcgtgtatttcacccatccctctcaa

SEQ ID NO: 12765 - DNA, 35 bp, Artificial Sequence
  Synthetic oligonucleotide
tactcctcacctgtaatattgccaattctgaccga

SEQ ID NO: 12766 - DNA, 36 bp, Artificial Sequence
  Synthetic oligonucleotide
atgaggggggaggaaaggctctagggacaataagga

SEQ ID NO: 12767 - DNA, 37 bp, Artificial Sequence
  Synthetic oligonucleotide
acgccaacatgcctgtgcgtctctctcttcactggga

SEQ ID NO: 12768 - DNA, 35 bp, Artificial Sequence
  Synthetic oligonucleotide
tcacacggctttatgcgctgtccggaccctctcac

SEQ ID NO: 12769 - DNA, 35 bp, Artificial Sequence
  Synthetic oligonucleotide
accaccaaatcgactgtatcgtctcgcatgccatc

SEQ ID NO: 12770 - DNA, 37 bp, Artificial Sequence
  Synthetic oligonucleotide
gacgcgccccagttagccctctttctttccaacgtga

SEQ ID NO: 12771 - DNA, 35 bp, Artificial Sequence
  Synthetic oligonucleotide
acacctccacgctgccggcccttatctctatactg

SEQ ID NO: 12772 - DNA, 36 bp, Artificial Sequence
  Synthetic oligonucleotide
attgccgcccccttagtctataactgctccgttgaa

SEQ ID NO: 12773 - DNA, 36 bp, Artificial Sequence
  Synthetic oligonucleotide
gcaccggtcctgtcaattcaggcggtatccatctca

SEQ ID NO: 12774 - DNA, 35 bp, Artificial Sequence
  Synthetic oligonucleotide
aacagtgagggggaactggggcaaagggtgatcga

SEQ ID NO: 12775 - DNA, 36 bp, Artificial Sequence
  Synthetic oligonucleotide
tcttacctgacccctatgtatctcgtggaacgctta

SEQ ID NO: 12776 - DNA, 35 bp, Artificial Sequence
  Synthetic oligonucleotide
tactcccgcgaccactctcggcttctcatgtttct

SEQ ID NO: 12777 - DNA, 37 bp, Artificial Sequence
  Synthetic oligonucleotide
acgagaaggtaagggatatcggtgggcgggagggaga

SEQ ID NO: 12778 - DNA, 35 bp, Artificial Sequence
  Synthetic oligonucleotide
gtttacgcggacagcgttttcccccgctagcccat

SEQ ID NO: 12779 - DNA, 36 bp, Artificial Sequence
  Synthetic oligonucleotide
gtcaaccccagacgatgcttgtgagtccacctttta

SEQ ID NO: 12780 - DNA, 35 bp, Artificial Sequence
  Synthetic oligonucleotide
aagcacaacccgccgcttttgaaagtacgcttcca

SEQ ID NO: 12781 - DNA, 36 bp, Artificial Sequence
  Synthetic oligonucleotide
acccatcatgcacttgacgctatcattgtcacctca

SEQ ID NO: 12782 - DNA, 38 bp, Artificial Sequence
  Synthetic oligonucleotide
accaccgacgcgcgattgattttgccttctctccatga

SEQ ID NO: 12783 - DNA, 35 bp, Artificial Sequence
  Synthetic oligonucleotide
agcgcccaccccccaattacgtattgcaccatgtc

SEQ ID NO: 12784 - DNA, 35 bp, Artificial Sequence
  Synthetic oligonucleotide
gatgcagacgtagtcccaaatttcgaaccccctgg

SEQ ID NO: 12785 - DNA, 35 bp, Artificial Sequence
  Synthetic oligonucleotide
gccaacacggacttcctttgacctatccaattgca

SEQ ID NO: 12786 - DNA, 37 bp, Artificial Sequence
  Synthetic oligonucleotide
tcctgagcagacgcgctttcaacgttactactctcga

SEQ ID NO: 12787 - DNA, 38 bp, Artificial Sequence
  Synthetic oligonucleotide
tatccactcggtgagtatgctccacccctatctgttga

SEQ ID NO: 12788 - DNA, 35 bp, Artificial Sequence
  Synthetic oligonucleotide
acccagcgctactacatgaaagtcctcgttccacc

SEQ ID NO: 12789 - DNA, 35 bp, Artificial Sequence
  Synthetic oligonucleotide
ttcccgtccatctccgcccgagcacttcaacttct

SEQ ID NO: 12790 - DNA, 35 bp, Artificial Sequence
  Synthetic oligonucleotide
gtggggacaggatcgggaatcggggggagggtggc

SEQ ID NO: 12791 - DNA, 35 bp, Artificial Sequence
  Synthetic oligonucleotide
tactcacccctacgcgtgctatgcttttcctagcg

SEQ ID NO: 12792 - DNA, 35 bp, Artificial Sequence
  Synthetic oligonucleotide
gtcatatcccgcatatccttctaagcaacatccct

SEQ ID NO: 12793 - DNA, 37 bp, Artificial Sequence
  Synthetic oligonucleotide
aaatgggcggataagcaaggggtgaaagggatgggga

SEQ ID NO: 12794 - DNA, 35 bp, Artificial Sequence
  Synthetic oligonucleotide
tccttgcccaaatagggccgtgatcactcccttac

SEQ ID NO: 12795 - DNA, 37 bp, Artificial Sequence
  Synthetic oligonucleotide
taccgcctcatcacactgcacacacccttgtcaccga

SEQ ID NO: 12796 - DNA, 37 bp, Artificial Sequence
  Synthetic oligonucleotide
tcatcccctgagcacactcacacgacgatcttgtcga

SEQ ID NO: 12797 - DNA, 37 bp, Artificial Sequence
  Synthetic oligonucleotide
gttgtagagcaacacggtgtcaaggagggcgggggga

SEQ ID NO: 12798 - DNA, 35 bp, Artificial Sequence
  Synthetic oligonucleotide
ttatagtgtgagcggaaaacgggcggtggggagta

SEQ ID NO: 12799 - DNA, 35 bp, Artificial Sequence
  Synthetic oligonucleotide
agtgaacaacgaagggttgggagggtgaggggtcc

SEQ ID NO: 12800 - DNA, 35 bp, Artificial Sequence
  Synthetic oligonucleotide
tcccgcaccgtgcatcactttggccattattttgt

SEQ ID NO: 12801 - DNA, 37 bp, Artificial Sequence
  Synthetic oligonucleotide
gactggtggaggaggaggttgcatggggcaatagcga

SEQ ID NO: 12802 - DNA, 35 bp, Artificial Sequence
  Synthetic oligonucleotide
ttggggtggtgatgggctacggggggacgggagta

SEQ ID NO: 12803 - DNA, 35 bp, Artificial Sequence
  Synthetic oligonucleotide
ttactgaccactgtgtgtctcttactcgcccttgc

SEQ ID NO: 12804 - DNA, 35 bp, Artificial Sequence
  Synthetic oligonucleotide
gtggacaacctaacacatctgagggcacctacttc

SEQ ID NO: 12805 - DNA, 36 bp, Artificial Sequence
  Synthetic oligonucleotide
accatgccaccttatagacacgtgtccgtcccccga

SEQ ID NO: 12806 - DNA, 37 bp, Artificial Sequence
  Synthetic oligonucleotide
gggagtgaaagtgcggcaaataacgggtgggctggga

SEQ ID NO: 12807 - DNA, 35 bp, Artificial Sequence
  Synthetic oligonucleotide
attgacaagggttgggcggggtattggatgggaac

SEQ ID NO: 12808 - DNA, 35 bp, Artificial Sequence
  Synthetic oligonucleotide
atacgcctggctcctttctctcagcatcactcagc

SEQ ID NO: 12809 - DNA, 38 bp, Artificial Sequence
  Synthetic oligonucleotide
aactcaccgcttccgcccgtcaccccctgtttccgtga

SEQ ID NO: 12810 - DNA, 38 bp, Artificial Sequence
  Synthetic oligonucleotide
acagatgggggagggaatatatggggctcaaggggtga

SEQ ID NO: 12811 - DNA, 35 bp, Artificial Sequence
  Synthetic oligonucleotide
ttacaccccccgccaagctttgagcgaaatatgct

SEQ ID NO: 12812 - DNA, 36 bp, Artificial Sequence
  Synthetic oligonucleotide
acacaaccaactgccacacaatgcaagcctcactta

SEQ ID NO: 12813 - DNA, 35 bp, Artificial Sequence
  Synthetic oligonucleotide
acatacacgccgcgcacaagtaagccctccgcatc

SEQ ID NO: 12814 - DNA, 35 bp, Artificial Sequence
  Synthetic oligonucleotide
tgtgcccacctgctatagaactccaactcgcgcct

SEQ ID NO: 12815 - DNA, 36 bp, Artificial Sequence
  Synthetic oligonucleotide
ctcgcccctctctaccagacccgtattggtctacca

SEQ ID NO: 12816 - DNA, 35 bp, Artificial Sequence
  Synthetic oligonucleotide
atacctacccgcaccgaacaccgcctcgttaacta

SEQ ID NO: 12817 - DNA, 35 bp, Artificial Sequence
  Synthetic oligonucleotide
cacggaacctaccgcctgtctcttggtcactcttc

SEQ ID NO: 12818 - DNA, 35 bp, Artificial Sequence
  Synthetic oligonucleotide
gccacgttagccttcacagtttaggtcgcctgttc

SEQ ID NO: 12819 - DNA, 35 bp, Artificial Sequence
  Synthetic oligonucleotide
ttgacgcgtacgccgctgccccattacctgcttgt

SEQ ID NO: 12820 - DNA, 36 bp, Artificial Sequence
  Synthetic oligonucleotide
gccaccaacgcccacgaggcctgcttatgccagaca

SEQ ID NO: 12821 - DNA, 36 bp, Artificial Sequence
  Synthetic oligonucleotide
tgcaccctctctggacaacatacacaatctgcctga

SEQ ID NO: 12822 - DNA, 35 bp, Artificial Sequence
  Synthetic oligonucleotide
atgtgccaccgagctctatcttcattagcgcaacc

SEQ ID NO: 12823 - DNA, 35 bp, Artificial Sequence
  Synthetic oligonucleotide
tcgctcgcccatcatccgccgccaaccgctgaaat

SEQ ID NO: 12824 - DNA, 35 bp, Artificial Sequence
  Synthetic oligonucleotide
gctgccaagctcacactgctccacatctttaccga

SEQ ID NO: 12825 - DNA, 37 bp, Artificial Sequence
  Synthetic oligonucleotide
ttggggaggggaggggatatgggtgttacgtggatga

SEQ ID NO: 12826 - DNA, 37 bp, Artificial Sequence
  Synthetic oligonucleotide
gtggaagcccaattccctcgtattatgcgccccgtga

SEQ ID NO: 12827 - DNA, 38 bp, Artificial Sequence
  Synthetic oligonucleotide
tctcgccccacaccggtcttaccgtcactgtactgtga

SEQ ID NO: 12828 - DNA, 36 bp, Artificial Sequence
  Synthetic oligonucleotide
tcagacccgcactgcgttttgccggttcatatttta

SEQ ID NO: 12829 - DNA, 36 bp, Artificial Sequence
  Synthetic oligonucleotide
ttcgcaacccgcacatacactgtccgcctctttata

SEQ ID NO: 12830 - DNA, 35 bp, Artificial Sequence
  Synthetic oligonucleotide
gcgcccctcgcgctgccgtgccttatatttccgta

SEQ ID NO: 12831 - DNA, 35 bp, Artificial Sequence
  Synthetic oligonucleotide
tccggccaactcccgcgagctaggccacctttcac

SEQ ID NO: 12832 - DNA, 35 bp, Artificial Sequence
  Synthetic oligonucleotide
accatccatccgcagcacatcttcggtctttacaa

SEQ ID NO: 12833 - DNA, 35 bp, Artificial Sequence
  Synthetic oligonucleotide
gccgcacatcctttggcctctcctcgagctttcca

SEQ ID NO: 12834 - DNA, 35 bp, Artificial Sequence
  Synthetic oligonucleotide
actgggtgggagggaatatctagcgctcatgggca

SEQ ID NO: 12835 - DNA, 38 bp, Artificial Sequence
  Synthetic oligonucleotide
atgcaagggtaagggcggaggaaccggacgggaggtga

SEQ ID NO: 12836 - DNA, 38 bp, Artificial Sequence
  Synthetic oligonucleotide
aaaaggggaggcatgaggtgagggattgctgcgggtga

SEQ ID NO: 12837 - DNA, 35 bp, Artificial Sequence
  Synthetic oligonucleotide
accatccccgccggtgtttgttccgatttcatgcg

SEQ ID NO: 12838 - DNA, 35 bp, Artificial Sequence
  Synthetic oligonucleotide
tctcacctccacagcatacctatcatgatcatcat

SEQ ID NO: 12839 - DNA, 35 bp, Artificial Sequence
  Synthetic oligonucleotide
tacatcggctcatagtacgtcctcaggtttcgctt

SEQ ID NO: 12840 - DNA, 36 bp, Artificial Sequence
  Synthetic oligonucleotide
attcagccgccccgtctcgtattcgctaacttttca

SEQ ID NO: 12841 - DNA, 35 bp, Artificial Sequence
  Synthetic oligonucleotide
tacccgccgcgtgtccccatgacccttatatactc

SEQ ID NO: 12842 - DNA, 35 bp, Artificial Sequence
  Synthetic oligonucleotide
gtcgagagccccctacattgctacgtactgtccat

SEQ ID NO: 12843 - DNA, 35 bp, Artificial Sequence
  Synthetic oligonucleotide
cacaccccatcatctttacaaggtctgcccacatt

SEQ ID NO: 12844 - DNA, 38 bp, Artificial Sequence
  Synthetic oligonucleotide
accctgcccatgtcttcgctgcggagctcccatcctga

SEQ ID NO: 12845 - DNA, 35 bp, Artificial Sequence
  Synthetic oligonucleotide
tccccaaaccccatagaacgcacgtgacatacgta

SEQ ID NO: 12846 - DNA, 35 bp, Artificial Sequence
  Synthetic oligonucleotide
tgatcggacctttctgctctgccctggccctgtgc

SEQ ID NO: 12847 - DNA, 35 bp, Artificial Sequence
  Synthetic oligonucleotide
gcaccctagtgcgctagtttcgataattgttccat

SEQ ID NO: 12848 - DNA, 35 bp, Artificial Sequence
  Synthetic oligonucleotide
ccaacgctacccgtgccgtaacccgctcgctctat

SEQ ID NO: 12849 - DNA, 37 bp, Artificial Sequence
  Synthetic oligonucleotide
acaccgaacccggtaattttgtttcgcccccacggga

SEQ ID NO: 12850 - DNA, 35 bp, Artificial Sequence
  Synthetic oligonucleotide
agcgcaggcaatatctccagccaagcctcccacgc

SEQ ID NO: 12851 - DNA, 35 bp, Artificial Sequence
  Synthetic oligonucleotide
tgcgactcgcgcggaatcgaccttccctgcaacca

SEQ ID NO: 12852 - DNA, 35 bp, Artificial Sequence
  Synthetic oligonucleotide
gcaccgtttgagcactctttcatcctggcgctgca

SEQ ID NO: 12853 - DNA, 37 bp, Artificial Sequence
  Synthetic oligonucleotide
atgggtgagagcaacctgcagaggaaagggtggtgga

SEQ ID NO: 12854 - DNA, 36 bp, Artificial Sequence
  Synthetic oligonucleotide
gccacctggccccatctgcactcacaggaggactta

SEQ ID NO: 12855 - DNA, 35 bp, Artificial Sequence
  Synthetic oligonucleotide
gattcccacacttggtccagccgccccggatagcc

SEQ ID NO: 12856 - DNA, 35 bp, Artificial Sequence
  Synthetic oligonucleotide
accagggcgcccgtctctttagctctttatctgtc

SEQ ID NO: 12857 - DNA, 35 bp, Artificial Sequence
  Synthetic oligonucleotide
tccaccacaccctcatcgtcatggtaataccattc

SEQ ID NO: 12858 - DNA, 35 bp, Artificial Sequence
  Synthetic oligonucleotide
tagggggccgtgctgctcctaggtcttgtttccct

SEQ ID NO: 12859 - DNA, 36 bp, Artificial Sequence
  Synthetic oligonucleotide
gatggccacccatggatacctttctgcactgacttt

SEQ ID NO: 12860 - DNA, 35 bp, Artificial Sequence
  Synthetic oligonucleotide
tcccaccttcctcaattgtgcaggatcccttcgct

SEQ ID NO: 12861 - DNA, 35 bp, Artificial Sequence
  Synthetic oligonucleotide
gcactccttcagcacagcacttcccccgcgtgcca

SEQ ID NO: 12862 - DNA, 36 bp, Artificial Sequence
  Synthetic oligonucleotide
acacccgacatcggaacgctccattttcattctgca

SEQ ID NO: 12863 - DNA, 37 bp, Artificial Sequence
  Synthetic oligonucleotide
gtatgcatgaggggaggagaggaccgaggatcgacga

SEQ ID NO: 12864 - DNA, 38 bp, Artificial Sequence
  Synthetic oligonucleotide
gggacccatgccccaacggtatctcacttcatccatga

SEQ ID NO: 12865 - DNA, 35 bp, Artificial Sequence
  Synthetic oligonucleotide
aatgagcccgcgttaagtctagcacctccatgtcc

SEQ ID NO: 12866 - DNA, 37 bp, Artificial Sequence
  Synthetic oligonucleotide
tccaccacctgcagtacacttgaatgccttagcttga

SEQ ID NO: 12867 - DNA, 35 bp, Artificial Sequence
  Synthetic oligonucleotide
gcaaggtggaagggcggattcggggcactggtagg

SEQ ID NO: 12868 - DNA, 35 bp, Artificial Sequence
  Synthetic oligonucleotide
actcagtgcctcccctagaacgtctaatacctttg

SEQ ID NO: 12869 - DNA, 35 bp, Artificial Sequence
  Synthetic oligonucleotide
aacggtcgccgggcgggtgattagggcgggcctct

SEQ ID NO: 12870 - DNA, 36 bp, Artificial Sequence
  Synthetic oligonucleotide
tgccaccgcacccggtggtaaccgtacccgtgccta

SEQ ID NO: 12871 - DNA, 35 bp, Artificial Sequence
  Synthetic oligonucleotide
tagtttgcagcaatcggttcatccttcccccctgc

SEQ ID NO: 12872 - DNA, 38 bp, Artificial Sequence
  Synthetic oligonucleotide
tctacgcagtgcatcttccgcactccattcactcctga

SEQ ID NO: 12873 - DNA, 38 bp, Artificial Sequence
  Synthetic oligonucleotide
tgcatgaaaggtgtgggagggaaaaggtgggacggtga

SEQ ID NO: 12874 - DNA, 35 bp, Artificial Sequence
  Synthetic oligonucleotide
gacaccattcccgtggctctagctttttccatatt

SEQ ID NO: 12875 - DNA, 37 bp, Artificial Sequence
  Synthetic oligonucleotide
tgtcactggccgactccccgtttcatccctccatgga

SEQ ID NO: 12876 - DNA, 35 bp, Artificial Sequence
  Synthetic oligonucleotide
acgtctacaccacatcgctttcacttcgagcccgc

SEQ ID NO: 12877 - DNA, 35 bp, Artificial Sequence
  Synthetic oligonucleotide
ttgagccccacttcctgtttgacggttgttgtccg

SEQ ID NO: 12878 - DNA, 35 bp, Artificial Sequence
  Synthetic oligonucleotide
gcatgaaagggaagggggtaagcaatttcagggat

SEQ ID NO: 12879 - DNA, 37 bp, Artificial Sequence
  Synthetic oligonucleotide
tccaccctgcccctaatctggatactccttgctcgga

SEQ ID NO: 12880 - DNA, 35 bp, Artificial Sequence
  Synthetic oligonucleotide
tcatcacaacagcctctcaacgtctagcttccgac

SEQ ID NO: 12881 - DNA, 36 bp, Artificial Sequence
  Synthetic oligonucleotide
tccccccgccaagttccacgtgccgcttcacccaga

SEQ ID NO: 12882 - DNA, 35 bp, Artificial Sequence
  Synthetic oligonucleotide
gtgctatccatgcacactgagccgtaacactcgcc

SEQ ID NO: 12883 - DNA, 35 bp, Artificial Sequence
  Synthetic oligonucleotide
tgatgtgtgccgtattagtatctgtcacctgcttc

SEQ ID NO: 12884 - DNA, 35 bp, Artificial Sequence
  Synthetic oligonucleotide
gactgctggcctccttctcacccatcagtgccttt

SEQ ID NO: 12885 - DNA, 35 bp, Artificial Sequence
  Synthetic oligonucleotide
gagccggcgagacgctgcatcccaattaccatccc

SEQ ID NO: 12886 - DNA, 35 bp, Artificial Sequence
  Synthetic oligonucleotide
ggacactttcacactttacttggttgctggctcgc

SEQ ID NO: 12887 - DNA, 35 bp, Artificial Sequence
  Synthetic oligonucleotide
gtgcccacgctcttagtattcctctctcttgcaga

SEQ ID NO: 12888 - DNA, 35 bp, Artificial Sequence
  Synthetic oligonucleotide
acttacgtggcgcaccatcaccgtcggacttccgc

SEQ ID NO: 12889 - DNA, 35 bp, Artificial Sequence
  Synthetic oligonucleotide
actaaagggaggagaggttggaggaggggagaggg

SEQ ID NO: 12890 - DNA, 35 bp, Artificial Sequence
  Synthetic oligonucleotide
gtgctcgccccccacgggtctggatttcttctttg

SEQ ID NO: 12891 - DNA, 37 bp, Artificial Sequence
  Synthetic oligonucleotide
atgatcaaccgcctctttcaccgacactcgctggaga

SEQ ID NO: 12892 - DNA, 38 bp, Artificial Sequence
  Synthetic oligonucleotide
gcacggtcaccaccgtcgcccatactgccattcactga

SEQ ID NO: 12893 - DNA, 35 bp, Artificial Sequence
  Synthetic oligonucleotide
atggtgccatcgctctgtaactcacgtaacctaac

SEQ ID NO: 12894 - DNA, 35 bp, Artificial Sequence
  Synthetic oligonucleotide
gggggggggaaggataggtagggacggagactctt

SEQ ID NO: 12895 - DNA, 36 bp, Artificial Sequence
  Synthetic oligonucleotide
tccaccacctgtcgtaccttccaaatctatcatgga

SEQ ID NO: 12896 - DNA, 37 bp, Artificial Sequence
  Synthetic oligonucleotide
tgggaccgcaaggggggagggagcgaagtgggatgga

SEQ ID NO: 12897 - DNA, 38 bp, Artificial Sequence
  Synthetic oligonucleotide
atctggcccactgtttccacgtatcaccaactgcctga

SEQ ID NO: 12898 - DNA, 36 bp, Artificial Sequence
  Synthetic oligonucleotide
ttcaactgccccgttgttccatctgcatttatgtaa

SEQ ID NO: 12899 - DNA, 38 bp, Artificial Sequence
  Synthetic oligonucleotide
aaccacaactttcccgcactgctttgagactcgcctga

SEQ ID NO: 12900 - DNA, 35 bp, Artificial Sequence
  Synthetic oligonucleotide
taacgccagacacacgccgctgcaatcgtacccat

SEQ ID NO: 12901 - DNA, 35 bp, Artificial Sequence
  Synthetic oligonucleotide
gtgggggtgggtcgggaacggaaggagaaacacaa

SEQ ID NO: 12902 - DNA, 38 bp, Artificial Sequence
  Synthetic oligonucleotide
tacacatcggggggaatagggggcatatagtggcttga

SEQ ID NO: 12903 - DNA, 34 bp, Artificial Sequence
  Synthetic oligonucleotide
gagacaccgttcattaacctcttgctgtccacac

SEQ ID NO: 12904 - DNA, 35 bp, Artificial Sequence
  Synthetic oligonucleotide
agtcaagagcggggtggggcacgaattaggggagg

SEQ ID NO: 12905 - DNA, 37 bp, Artificial Sequence
  Synthetic oligonucleotide
aaacccccgcccccagaccagtctaaccttgatctga

SEQ ID NO: 12906 - DNA, 35 bp, Artificial Sequence
  Synthetic oligonucleotide
ggatcctccagtctgctcactgtccacatttgttc

SEQ ID NO: 12907 - DNA, 35 bp, Artificial Sequence
  Synthetic oligonucleotide
gcgacccaccccatagccccacgttgtaatccact

SEQ ID NO: 12908 - DNA, 35 bp, Artificial Sequence
  Synthetic oligonucleotide
gcccgctcaccctctgcaacgaacctgtatgattt

SEQ ID NO: 12909 - DNA, 36 bp, Artificial Sequence
  Synthetic oligonucleotide
gagcaaagaggggggagtagggacagtgcgggggaa

SEQ ID NO: 12910 - DNA, 38 bp, Artificial Sequence
  Synthetic oligonucleotide
gcaagccgtcgcttgaacaagcctctccatttccgtga

SEQ ID NO: 12911 - DNA, 36 bp, Artificial Sequence
  Synthetic oligonucleotide
aaccacacctgcctctaatgctcctgccctgtagaa

SEQ ID NO: 12912 - DNA, 35 bp, Artificial Sequence
  Synthetic oligonucleotide
aatggggtggggcctgaggggggaaggtctgttca

SEQ ID NO: 12913 - DNA, 37 bp, Artificial Sequence
  Synthetic oligonucleotide
actcacgtcacccgtttgtttctttcccgcctctaga

SEQ ID NO: 12914 - DNA, 35 bp, Artificial Sequence
  Synthetic oligonucleotide
ttcatgccaccccccaatgcaacccagccgctcct

SEQ ID NO: 12915 - DNA, 38 bp, Artificial Sequence
  Synthetic oligonucleotide
gtgccgacacagacgcttccgccacatctcctttatga

SEQ ID NO: 12916 - DNA, 35 bp, Artificial Sequence
  Synthetic oligonucleotide
gtcgctcctgggcactgcatgaactactagccaac

SEQ ID NO: 12917 - DNA, 35 bp, Artificial Sequence
  Synthetic oligonucleotide
gtggtcaacgcgcatgtccgcccatcttgttccta

SEQ ID NO: 12918 - DNA, 35 bp, Artificial Sequence
  Synthetic oligonucleotide
tcaaacgcgttcccctccgtccactgccctgacaa

SEQ ID NO: 12919 - DNA, 36 bp, Artificial Sequence
  Synthetic oligonucleotide
gtcacccagcgttgctgcccgttcctccactagcca

SEQ ID NO: 12920 - DNA, 36 bp, Artificial Sequence
  Synthetic oligonucleotide
ttcacctcacccttgaatgtttttacgccctgtgaa

SEQ ID NO: 12921 - DNA, 36 bp, Artificial Sequence
  Synthetic oligonucleotide
ttgtgccatcccgtttcgcgccccctcggttccaaa

SEQ ID NO: 12922 - DNA, 38 bp, Artificial Sequence
  Synthetic oligonucleotide
tgcaacgtcctgttcgcgccttctttgccacggtttga

SEQ ID NO: 12923 - DNA, 35 bp, Artificial Sequence
  Synthetic oligonucleotide
atcatcccggtttgctatgcccactgggcccatcc

SEQ ID NO: 12924 - DNA, 34 bp, Artificial Sequence
  Synthetic oligonucleotide
ttcgacattacggtcggtcgctatcgctttactc

SEQ ID NO: 12925 - DNA, 35 bp, Artificial Sequence
  Synthetic oligonucleotide
ttgccttgacagacgtccactctcaccattttctg

SEQ ID NO: 12926 - DNA, 35 bp, Artificial Sequence
  Synthetic oligonucleotide
atcgcactccgccctctacttccggatggataatc

SEQ ID NO: 12927 - DNA, 35 bp, Artificial Sequence
  Synthetic oligonucleotide
accgagctccgttttgcccccattgcatcacctgt

SEQ ID NO: 12928 - DNA, 37 bp, Artificial Sequence
  Synthetic oligonucleotide
gagagaggcaagggggaattgaacaatggatacacga

SEQ ID NO: 12929 - DNA, 38 bp, Artificial Sequence
  Synthetic oligonucleotide
tcccggctcccgtactttattcccgacccgccatgtga

SEQ ID NO: 12930 - DNA, 35 bp, Artificial Sequence
  Synthetic oligonucleotide
ttgccgacacactggccgaccccgcacgctcaccc

SEQ ID NO: 12931 - DNA, 35 bp, Artificial Sequence
  Synthetic oligonucleotide
ggaccgaccgcgccacatcgttttccctttcgctt

SEQ ID NO: 12932 - DNA, 37 bp, Artificial Sequence
  Synthetic oligonucleotide
ggacatccgccccgtgccgacctcaatacccgacgga

SEQ ID NO: 12933 - DNA, 37 bp, Artificial Sequence
  Synthetic oligonucleotide
tcctcatcgggattatccctgccttgtcacccccgga

SEQ ID NO: 12934 - DNA, 35 bp, Artificial Sequence
  Synthetic oligonucleotide
tcacactggaacccaactacgtcgacaccatcctt

SEQ ID NO: 12935 - DNA, 37 bp, Artificial Sequence
  Synthetic oligonucleotide
gacacccatccgtccatgcgtgtgccaaacttcccga

SEQ ID NO: 12936 - DNA, 35 bp, Artificial Sequence
  Synthetic oligonucleotide
tagagctgatcggaatggggggtagtggggttgga

SEQ ID NO: 12937 - DNA, 36 bp, Artificial Sequence
  Synthetic oligonucleotide
acctgtacgcctcactgtgctcctaccccacgttga

SEQ ID NO: 12938 - DNA, 35 bp, Artificial Sequence
  Synthetic oligonucleotide
gccatgtcgcaagccttaccctaactatgaacctt

SEQ ID NO: 12939 - DNA, 36 bp, Artificial Sequence
  Synthetic oligonucleotide
gtcccaccccgcacttcgtatgatcagacgcgaaca

SEQ ID NO: 12940 - DNA, 36 bp, Artificial Sequence
  Synthetic oligonucleotide
ttgccatctctgccggttcagccatcttgcttagca

SEQ ID NO: 12941 - DNA, 36 bp, Artificial Sequence
  Synthetic oligonucleotide
tgccacctaccacgcggacccatcacagcctgttca

SEQ ID NO: 12942 - DNA, 37 bp, Artificial Sequence
  Synthetic oligonucleotide
tgcgccacccctctgagtgcacgctaacctcacccga

SEQ ID NO: 12943 - DNA, 35 bp, Artificial Sequence
  Synthetic oligonucleotide
tccctcgccctcccatgctcagaggcccactttac

SEQ ID NO: 12944 - DNA, 35 bp, Artificial Sequence
  Synthetic oligonucleotide
acccaccaccctcacgaagacaagctctatcggaa

SEQ ID NO: 12945 - DNA, 37 bp, Artificial Sequence
  Synthetic oligonucleotide
gtcccacccatgacttaaacagttccggttcaggaga

SEQ ID NO: 12946 - DNA, 36 bp, Artificial Sequence
  Synthetic oligonucleotide
tgtgtacgatccagcgcgtcaccatcataggtccca

SEQ ID NO: 12947 - DNA, 38 bp, Artificial Sequence
  Synthetic oligonucleotide
atcctccgtccgccttctgcaatcacagactatcctga

SEQ ID NO: 12948 - DNA, 35 bp, Artificial Sequence
  Synthetic oligonucleotide
actaacaccccagtactgcacgtgcagtaacttgc

SEQ ID NO: 12949 - DNA, 35 bp, Artificial Sequence
  Synthetic oligonucleotide
gttaccctacgggccactaccgccacctaaccaat

SEQ ID NO: 12950 - DNA, 35 bp, Artificial Sequence
  Synthetic oligonucleotide
gaccaatgcatctagtttcccgccagccacgtatt

SEQ ID NO: 12951 - DNA, 36 bp, Artificial Sequence
  Synthetic oligonucleotide
atgcccttccgagcgaacgttttgcccacgttttca

SEQ ID NO: 12952 - DNA, 36 bp, Artificial Sequence
  Synthetic oligonucleotide
gtgcctctcgccccgcttggttatctccgtttgaga

SEQ ID NO: 12953 - DNA, 36 bp, Artificial Sequence
  Synthetic oligonucleotide
accccaacccagagaagcgcccgcccttccccgtcc

SEQ ID NO: 12954 - DNA, 35 bp, Artificial Sequence
  Synthetic oligonucleotide
ttcacgctggcgtgagcatgctatcggcttccctc

SEQ ID NO: 12955 - DNA, 35 bp, Artificial Sequence
  Synthetic oligonucleotide
gtgccctcaacgtactcccgcgcgaatccacaatt

SEQ ID NO: 12956 - DNA, 36 bp, Artificial Sequence
  Synthetic oligonucleotide
agaccgctaggcccatcttttgcgtaacatctaaca

SEQ ID NO: 12957 - DNA, 36 bp, Artificial Sequence
  Synthetic oligonucleotide
tgaggccccgatgcaaattcagcccctccacgccga

SEQ ID NO: 12958 - DNA, 38 bp, Artificial Sequence
  Synthetic oligonucleotide
atctgcccaggtctctacattgcgccacgttactttga

SEQ ID NO: 12959 - DNA, 35 bp, Artificial Sequence
  Synthetic oligonucleotide
tcaacaatcgctcacatatccgcgtcgacacgccc

SEQ ID NO: 12960 - DNA, 35 bp, Artificial Sequence
  Synthetic oligonucleotide
atcccgttcgcctggtttctttgcttccttactaa

SEQ ID NO: 12961 - DNA, 35 bp, Artificial Sequence
  Synthetic oligonucleotide
ggtgtcgccagcagaaggggaggcgggaggggtga

SEQ ID NO: 12962 - DNA, 37 bp, Artificial Sequence
  Synthetic oligonucleotide
gcccgaccccgtgcttacggaatacctacttgcttga

SEQ ID NO: 12963 - DNA, 38 bp, Artificial Sequence
  Synthetic oligonucleotide
gtcacgccgctctccatctccgtattcatcagtcttga

SEQ ID NO: 12964 - DNA, 35 bp, Artificial Sequence
  Synthetic oligonucleotide
tccagccctagtccgcccttcgacccaactatgca

SEQ ID NO: 12965 - DNA, 35 bp, Artificial Sequence
  Synthetic oligonucleotide
accagtgcaggaacttgcttagcctactccttacc

SEQ ID NO: 12966 - DNA, 35 bp, Artificial Sequence
  Synthetic oligonucleotide
gcgattaggaggagcgggtgaaactggggcatggt

SEQ ID NO: 12967 - DNA, 35 bp, Artificial Sequence
  Synthetic oligonucleotide
agcgacacccgcaccggtccgtccctctctgcaaa

SEQ ID NO: 12968 - DNA, 36 bp, Artificial Sequence
  Synthetic oligonucleotide
gcagggacgcccggcctaaatgaccctcaccctcga

SEQ ID NO: 12969 - DNA, 35 bp, Artificial Sequence
  Synthetic oligonucleotide
tattgctcccatgctcttttggtgtcccttgcaac

SEQ ID NO: 12970 - DNA, 35 bp, Artificial Sequence
  Synthetic oligonucleotide
ggaccagccacgcacatagtttgccccccggtccc

SEQ ID NO: 12971 - DNA, 36 bp, Artificial Sequence
  Synthetic oligonucleotide
gctgagtggaagtgggaaaatgggtgaatcttgcaa

SEQ ID NO: 12972 - DNA, 36 bp, Artificial Sequence
  Synthetic oligonucleotide
gcaacttgcatgggtaaggggtggatgggggcggaa

SEQ ID NO: 12973 - DNA, 35 bp, Artificial Sequence
  Synthetic oligonucleotide
gcccgccgtcccttgctctgttctcacttctctaa

SEQ ID NO: 12974 - DNA, 36 bp, Artificial Sequence
  Synthetic oligonucleotide
ttcacgtagcgcagtagccccacctccctttgacga

SEQ ID NO: 12975 - DNA, 35 bp, Artificial Sequence
  Synthetic oligonucleotide
gaatgcgcctaactaactgctgctggctactcctc

SEQ ID NO: 12976 - DNA, 35 bp, Artificial Sequence
  Synthetic oligonucleotide
tacacaactgggtcgatgggccggggggggaactg

SEQ ID NO: 12977 - DNA, 35 bp, Artificial Sequence
  Synthetic oligonucleotide
gttgcccacgtactcggagtgtccctgttcaccgt

SEQ ID NO: 12978 - DNA, 35 bp, Artificial Sequence
  Synthetic oligonucleotide
aagccaccctcgtttatctattctactgcacctca

SEQ ID NO: 12979 - DNA, 37 bp, Artificial Sequence
  Synthetic oligonucleotide
gatctgacaagggggcaagtggggtaaaatgatagga

SEQ ID NO: 12980 - DNA, 37 bp, Artificial Sequence
  Synthetic oligonucleotide
accgcgacctcatgcaacttttacgtgccctccctga

SEQ ID NO: 12981 - DNA, 35 bp, Artificial Sequence
  Synthetic oligonucleotide
tgaccaaccactctggcaccagacaccaatatgtc

SEQ ID NO: 12982 - DNA, 35 bp, Artificial Sequence
  Synthetic oligonucleotide
agagtgccgcctcttgaaacacacctccccgttcg

SEQ ID NO: 12983 - DNA, 35 bp, Artificial Sequence
  Synthetic oligonucleotide
ttatggacgggggaggaatttagaaggggaactgg

SEQ ID NO: 12984 - DNA, 36 bp, Artificial Sequence
  Synthetic oligonucleotide
tcagccaatgtacgttcactgacatctcgcctctca

SEQ ID NO: 12985 - DNA, 35 bp, Artificial Sequence
  Synthetic oligonucleotide
aagacctgcgcatttcttcacatcaacgacttagc

SEQ ID NO: 12986 - DNA, 34 bp, Artificial Sequence
  Synthetic oligonucleotide
taacgcctatgtctagcctattccttttgtgcca

SEQ ID NO: 12987 - DNA, 36 bp, Artificial Sequence
  Synthetic oligonucleotide
gtgaaggcgggaacggggaggtgaggtaagggggca

SEQ ID NO: 12988 - DNA, 37 bp, Artificial Sequence
  Synthetic oligonucleotide
acgtggcctccagtgtttgaccctgcctttccctcga

SEQ ID NO: 12989 - DNA, 35 bp, Artificial Sequence
  Synthetic oligonucleotide
atccctccgcctagtacttcgaatagtgtcgcccc

SEQ ID NO: 12990 - DNA, 35 bp, Artificial Sequence
  Synthetic oligonucleotide
actgtcacccgcactgaattctcttactggcatca

SEQ ID NO: 12991 - DNA, 37 bp, Artificial Sequence
  Synthetic oligonucleotide
gtgcaagcccctgcatcgtacccgcccgttcgcttga

SEQ ID NO: 12992 - DNA, 35 bp, Artificial Sequence
  Synthetic oligonucleotide
agtacgggtgggacggagaggaggatagggtgata

SEQ ID NO: 12993 - DNA, 35 bp, Artificial Sequence
  Synthetic oligonucleotide
tcccgcaccaccacatcacctgtcgctggacacac

SEQ ID NO: 12994 - DNA, 35 bp, Artificial Sequence
  Synthetic oligonucleotide
aagggatgaggaggaggggagtatggggataaaat

SEQ ID NO: 12995 - DNA, 36 bp, Artificial Sequence
  Synthetic oligonucleotide
gttccacgaactgcttgctcctccattctcgtgtca

SEQ ID NO: 12996 - DNA, 37 bp, Artificial Sequence
  Synthetic oligonucleotide
accaatgcactttgcgtatcgaccccacaactcgcga

SEQ ID NO: 12997 - DNA, 36 bp, Artificial Sequence
  Synthetic oligonucleotide
taagcatcccgcctggccccaacaactggacaccac

SEQ ID NO: 12998 - DNA, 35 bp, Artificial Sequence
  Synthetic oligonucleotide
tgcatacctccctgtcctacgttcagacattctgg

SEQ ID NO: 12999 - DNA, 36 bp, Artificial Sequence
  Synthetic oligonucleotide
agcgaacgcctgcacgccacgcacttccctcggaaa

SEQ ID NO: 13000 - DNA, 35 bp, Artificial Sequence
  Synthetic oligonucleotide
ccgcctcactccagcagaagctaccatatgactgc

SEQ ID NO: 13001 - DNA, 36 bp, Artificial Sequence
  Synthetic oligonucleotide
gggacatcctccactcctggcctcatgcattgtgca

SEQ ID NO: 13002 - DNA, 36 bp, Artificial Sequence
  Synthetic oligonucleotide
tgctcagttgccccatcatcatgcaccatccatcga

SEQ ID NO: 13003 - DNA, 35 bp, Artificial Sequence
  Synthetic oligonucleotide
tgcgtaaccacacgccaatcacctcgccggtatct

SEQ ID NO: 13004 - DNA, 35 bp, Artificial Sequence
  Synthetic oligonucleotide
taccagaagcgctcctgccctgccaaacttggtct

SEQ ID NO: 13005 - DNA, 38 bp, Artificial Sequence
  Synthetic oligonucleotide
gtgagcaacgcactggacaccccaccacctgcctttga

SEQ ID NO: 13006 - DNA, 35 bp, Artificial Sequence
  Synthetic oligonucleotide
tttgcagccaccagcccatacggaacccacgcatc

SEQ ID NO: 13007 - DNA, 35 bp, Artificial Sequence
  Synthetic oligonucleotide
attgccccagactatatgcacctaatcccccttcg

SEQ ID NO: 13008 - DNA, 37 bp, Artificial Sequence
  Synthetic oligonucleotide
tacgcgagctgacctgctcccttgtccttgatcctga

SEQ ID NO: 13009 - DNA, 37 bp, Artificial Sequence
  Synthetic oligonucleotide
gtatcgtcgactccactgtgccactctttccttctga

SEQ ID NO: 13010 - DNA, 36 bp, Artificial Sequence
  Synthetic oligonucleotide
tgtagcccacaggtcaccgttcacctcgttcgtccc

SEQ ID NO: 13011 - DNA, 35 bp, Artificial Sequence
  Synthetic oligonucleotide
gctcaagcccctgcatatcctgccctctgttaaat

SEQ ID NO: 13012 - DNA, 36 bp, Artificial Sequence
  Synthetic oligonucleotide
tcagcgacatggttaatcccccatgctgcttctcta

SEQ ID NO: 13013 - DNA, 35 bp, Artificial Sequence
  Synthetic oligonucleotide
aacaccgcaagtcgttcgccgcaaccgttttaaac

SEQ ID NO: 13014 - DNA, 35 bp, Artificial Sequence
  Synthetic oligonucleotide
ttgccaccaacatatcctgggtctctacactttag

SEQ ID NO: 13015 - DNA, 35 bp, Artificial Sequence
  Synthetic oligonucleotide
gactacccctgattcgctcctttgacttcataacg

SEQ ID NO: 13016 - DNA, 35 bp, Artificial Sequence
  Synthetic oligonucleotide
accatcccaccggcgtggtgtcccccgccactact

SEQ ID NO: 13017 - DNA, 36 bp, Artificial Sequence
  Synthetic oligonucleotide
tcactcttcaatgcatcagcacctgccactcatcca

SEQ ID NO: 13018 - DNA, 36 bp, Artificial Sequence
  Synthetic oligonucleotide
gcatccctccgttggactcgatgcccgtttatctca

SEQ ID NO: 13019 - DNA, 35 bp, Artificial Sequence
  Synthetic oligonucleotide
tcccccccccagtaagtggagccgttcctaatacc

SEQ ID NO: 13020 - DNA, 35 bp, Artificial Sequence
  Synthetic oligonucleotide
gctcatatcgcccgtccagtctgcccgggtcccat

SEQ ID NO: 13021 - DNA, 36 bp, Artificial Sequence
  Synthetic oligonucleotide
acccaccccactcgttatcgatcgcttcccaggaga

SEQ ID NO: 13022 - DNA, 35 bp, Artificial Sequence
  Synthetic oligonucleotide
agtacactgctcggctccatcctaaattaccttcg

SEQ ID NO: 13023 - DNA, 36 bp, Artificial Sequence
  Synthetic oligonucleotide
acacgccctgtaacgccttagaacacatcaatgcaa

SEQ ID NO: 13024 - DNA, 35 bp, Artificial Sequence
  Synthetic oligonucleotide
tcccacctagccgctggttctataaagcctcccgc

SEQ ID NO: 13025 - DNA, 35 bp, Artificial Sequence
  Synthetic oligonucleotide
aaccatgcccgttcctggcctcatttacagtaatc

SEQ ID NO: 13026 - DNA, 35 bp, Artificial Sequence
  Synthetic oligonucleotide
tgtgggaggggatacatgggagattgtgggaggtg

SEQ ID NO: 13027 - DNA, 37 bp, Artificial Sequence
  Synthetic oligonucleotide
gacgcaaaagggttggagcgctagagaagggggcaga

SEQ ID NO: 13028 - DNA, 36 bp, Artificial Sequence
  Synthetic oligonucleotide
gagagagtgcacggcggggggtagggggaacataga

SEQ ID NO: 13029 - DNA, 36 bp, Artificial Sequence
  Synthetic oligonucleotide
tcccacctcgttcgtttctaatacctaagtgcccaa

SEQ ID NO: 13030 - DNA, 35 bp, Artificial Sequence
  Synthetic oligonucleotide
gggacactcgcactatctatcacgccacgtcgtta

SEQ ID NO: 13031 - DNA, 35 bp, Artificial Sequence
  Synthetic oligonucleotide
tgttgctcgcactcagcctttctatgcatttcacc

SEQ ID NO: 13032 - DNA, 35 bp, Artificial Sequence
  Synthetic oligonucleotide
gtgtatcgcctcctcacgccacagtggcttccatc

SEQ ID NO: 13033 - DNA, 35 bp, Artificial Sequence
  Synthetic oligonucleotide
gaaccatcccatgttttgttactgatccgctaagg

SEQ ID NO: 13034 - DNA, 35 bp, Artificial Sequence
  Synthetic oligonucleotide
gccaccccacgccatagagccttatcattcgcaag

SEQ ID NO: 13035 - DNA, 35 bp, Artificial Sequence
  Synthetic oligonucleotide
tcgccctccctgacccctggatttacgccaaaact

SEQ ID NO: 13036 - DNA, 35 bp, Artificial Sequence
  Synthetic oligonucleotide
acacacgtctcctagtctccgctaccgtccttgtt

SEQ ID NO: 13037 - DNA, 36 bp, Artificial Sequence
  Synthetic oligonucleotide
agccgcctcccgttgacagctgccgcccctctacga

SEQ ID NO: 13038 - DNA, 37 bp, Artificial Sequence
  Synthetic oligonucleotide
agccaacccatcgtgcactcacctgcattcaaatcga

SEQ ID NO: 13039 - DNA, 37 bp, Artificial Sequence
  Synthetic oligonucleotide
gtgcccccctctactttgctgtttcctgtacttggga

SEQ ID NO: 13040 - DNA, 35 bp, Artificial Sequence
  Synthetic oligonucleotide
ttgacgcccccctcttaagtacgaggtgacgtacc

SEQ ID NO: 13041 - DNA, 35 bp, Artificial Sequence
  Synthetic oligonucleotide
gagtaacgtccgtcgccttccaacgcctatcctcg

SEQ ID NO: 13042 - DNA, 37 bp, Artificial Sequence
  Synthetic oligonucleotide
tccaccccgacggtcgtggcacaataccccaccgtga

SEQ ID NO: 13043 - DNA, 35 bp, Artificial Sequence
  Synthetic oligonucleotide
gcctcccccgtgcgccacctcccccaattgggcat

SEQ ID NO: 13044 - DNA, 37 bp, Artificial Sequence
  Synthetic oligonucleotide
gctgcccgtggcgttatgccctacaccctctcactga

SEQ ID NO: 13045 - DNA, 38 bp, Artificial Sequence
  Synthetic oligonucleotide
ttcagcccccacacgttcttccccgcgccgataggtga

SEQ ID NO: 13046 - DNA, 35 bp, Artificial Sequence
  Synthetic oligonucleotide
aaagatggaggagggtgcaggagatggaacggtga

SEQ ID NO: 13047 - DNA, 35 bp, Artificial Sequence
  Synthetic oligonucleotide
acacgtgccactctaccacccatttaaacggtgtg

SEQ ID NO: 13048 - DNA, 35 bp, Artificial Sequence
  Synthetic oligonucleotide
gacgacaagccgccgtacacatcaaacactctcat

SEQ ID NO: 13049 - DNA, 35 bp, Artificial Sequence
  Synthetic oligonucleotide
tgaacaggccaatgcagaccactcctctagtccaa

SEQ ID NO: 13050 - DNA, 37 bp, Artificial Sequence
  Synthetic oligonucleotide
ttgacgcctcagtgcgctccttcccttcccaagtaga

SEQ ID NO: 13051 - DNA, 38 bp, Artificial Sequence
  Synthetic oligonucleotide
acgacagggaggaggaggtcgtagggttgactaggtga

SEQ ID NO: 13052 - DNA, 38 bp, Artificial Sequence
  Synthetic oligonucleotide
tccatctcctcgatagggccctcgtactacctccttga

SEQ ID NO: 13053 - DNA, 36 bp, Artificial Sequence
  Synthetic oligonucleotide
gacaaacacggaagtgtcacaactacctctttgcta

SEQ ID NO: 13054 - DNA, 38 bp, Artificial Sequence
  Synthetic oligonucleotide
tccacgccgactacattttgccagcctcaataccatga

SEQ ID NO: 13055 - DNA, 38 bp, Artificial Sequence
  Synthetic oligonucleotide
gcccacccacaatccttcgcgacgatcggcctttttga

SEQ ID NO: 13056 - DNA, 35 bp, Artificial Sequence
  Synthetic oligonucleotide
gacctcgcacctaatcgatcgcccccggatcacat

SEQ ID NO: 13057 - DNA, 37 bp, Artificial Sequence
  Synthetic oligonucleotide
gacccgacgcctcacatgcacctcgaatcccactcga

SEQ ID NO: 13058 - DNA, 35 bp, Artificial Sequence
  Synthetic oligonucleotide
gtcattcccagtttccccttctgcctagtcctgta

SEQ ID NO: 13059 - DNA, 36 bp, Artificial Sequence
  Synthetic oligonucleotide
gatagaccacgccacacacctatgccagacgaaggt

SEQ ID NO: 13060 - DNA, 36 bp, Artificial Sequence
  Synthetic oligonucleotide
tgccaagcaccttgccggactgcctccaacccccga

SEQ ID NO: 13061 - DNA, 35 bp, Artificial Sequence
  Synthetic oligonucleotide
tatgctatcccgacggcgtcactacgttaccttgg

SEQ ID NO: 13062 - DNA, 35 bp, Artificial Sequence
  Synthetic oligonucleotide
tgccttccatcttttgttgcggtctctgcctttac

SEQ ID NO: 13063 - DNA, 35 bp, Artificial Sequence
  Synthetic oligonucleotide
gaaccgacgactgctaccattgtctgaaccttctc

SEQ ID NO: 13064 - DNA, 36 bp, Artificial Sequence
  Synthetic oligonucleotide
tctgtgccggtctctcagtgctctgctcatcctgta

SEQ ID NO: 13065 - DNA, 35 bp, Artificial Sequence
  Synthetic oligonucleotide
tcacgcctccctccggcaggagcctcaaaatctcg

SEQ ID NO: 13066 - DNA, 35 bp, Artificial Sequence
  Synthetic oligonucleotide
tcaggatacccaccgctaacccccacccctccgat

SEQ ID NO: 13067 - DNA, 35 bp, Artificial Sequence
  Synthetic oligonucleotide
tgcccccgagtcttagcgcaatgttgccaccccca

SEQ ID NO: 13068 - DNA, 35 bp, Artificial Sequence
  Synthetic oligonucleotide
ttgtgcgcaggtgtactgctgcctccccatcttca

SEQ ID NO: 13069 - DNA, 37 bp, Artificial Sequence
  Synthetic oligonucleotide
tcgagggaacaaaggggggggctgaggttcggttgga

SEQ ID NO: 13070 - DNA, 35 bp, Artificial Sequence
  Synthetic oligonucleotide
actacacttcagcattgcactacccagcattcacc

SEQ ID NO: 13071 - DNA, 35 bp, Artificial Sequence
  Synthetic oligonucleotide
acacccactttccgacacttattcaggtggctacc

SEQ ID NO: 13072 - DNA, 35 bp, Artificial Sequence
  Synthetic oligonucleotide
tccaagcgccctcagtcaccccctcttcgccaatc

SEQ ID NO: 13073 - DNA, 35 bp, Artificial Sequence
  Synthetic oligonucleotide
gatgtggaacgaaagtgaggaggcggatagttaag

SEQ ID NO: 13074 - DNA, 36 bp, Artificial Sequence
  Synthetic oligonucleotide
gacccctttacgcttgtcgctataacacctgtccca

SEQ ID NO: 13075 - DNA, 38 bp, Artificial Sequence
  Synthetic oligonucleotide
aacgacacatgcagacgttactattcgcctctctccga

SEQ ID NO: 13076 - DNA, 36 bp, Artificial Sequence
  Synthetic oligonucleotide
gacccctcccgagttattgctttgttgcatttttta

SEQ ID NO: 13077 - DNA, 35 bp, Artificial Sequence
  Synthetic oligonucleotide
ggagccccgctaatctcaccatcttgccctttcgg

SEQ ID NO: 13078 - DNA, 36 bp, Artificial Sequence
  Synthetic oligonucleotide
tgccaactacaccgggtattttcatgccacccatca

SEQ ID NO: 13079 - DNA, 37 bp, Artificial Sequence
  Synthetic oligonucleotide
tttggccaacacaaatgccttctatgcctctccacga

SEQ ID NO: 13080 - DNA, 38 bp, Artificial Sequence
  Synthetic oligonucleotide
gccacttccatcgttgctaagctgccacactttcatga

SEQ ID NO: 13081 - DNA, 36 bp, Artificial Sequence
  Synthetic oligonucleotide
gaagtcccctcccccgcctaatctcacgtaggtata

SEQ ID NO: 13082 - DNA, 35 bp, Artificial Sequence
  Synthetic oligonucleotide
gcaccgtaatactcacacacacaatactaaaatgg

SEQ ID NO: 13083 - DNA, 36 bp, Artificial Sequence
  Synthetic oligonucleotide
gaccctgtactcgccaccattccctttagccaacga

SEQ ID NO: 13084 - DNA, 37 bp, Artificial Sequence
  Synthetic oligonucleotide
aacgcggggagggctgcctgggaccggggaatacgga

SEQ ID NO: 13085 - DNA, 37 bp, Artificial Sequence
  Synthetic oligonucleotide
accaccccccgagatcgcattatcaagtctttcatga

SEQ ID NO: 13086 - DNA, 35 bp, Artificial Sequence
  Synthetic oligonucleotide
gtgcgcacgagccattctgttcgacaccatctgtc

SEQ ID NO: 13087 - DNA, 35 bp, Artificial Sequence
  Synthetic oligonucleotide
gtcgaagaccggcccttctggagcgcatgttcccg

SEQ ID NO: 13088 - DNA, 36 bp, Artificial Sequence
  Synthetic oligonucleotide
tgacccatcgtcactggtcagctacgccctccacca

SEQ ID NO: 13089 - DNA, 37 bp, Artificial Sequence
  Synthetic oligonucleotide
gaaggggacggggaaaaagcagggggaacgatgttga

SEQ ID NO: 13090 - DNA, 35 bp, Artificial Sequence
  Synthetic oligonucleotide
acttcacatcggcgagaacactgcccggctatctc

SEQ ID NO: 13091 - DNA, 35 bp, Artificial Sequence
  Synthetic oligonucleotide
ccgctgttctactcagccctccgagacacaacgag

SEQ ID NO: 13092 - DNA, 36 bp, Artificial Sequence
  Synthetic oligonucleotide
taccctacgcacatcgtaaatcctcacaccttttaa

SEQ ID NO: 13093 - DNA, 37 bp, Artificial Sequence
  Synthetic oligonucleotide
gagggggacggggagggagtgcgagccatccaaggga

SEQ ID NO: 13094 - DNA, 37 bp, Artificial Sequence
  Synthetic oligonucleotide
gcgagggggaggtaatgcaaaatagttggaggggcga

SEQ ID NO: 13095 - DNA, 35 bp, Artificial Sequence
  Synthetic oligonucleotide
ataccgccccccaagtaccatcgttgttaccctgg

SEQ ID NO: 13096 - DNA, 35 bp, Artificial Sequence
  Synthetic oligonucleotide
atcaccacccgcggattacgccgagtctgcaccct

SEQ ID NO: 13097 - DNA, 35 bp, Artificial Sequence
  Synthetic oligonucleotide
gaactgtgggttaggggagataacggggagtgggt

SEQ ID NO: 13098 - DNA, 35 bp, Artificial Sequence
  Synthetic oligonucleotide
tgtggtgtccgtccttgtaactttccgtccgtcgc

SEQ ID NO: 13099 - DNA, 37 bp, Artificial Sequence
  Synthetic oligonucleotide
atcgcctcataaccacgaaccagccacacccccagga

SEQ ID NO: 13100 - DNA, 35 bp, Artificial Sequence
  Synthetic oligonucleotide
gtcagccccgtcttgcttcatgatccactcgctgc

SEQ ID NO: 13101 - DNA, 36 bp, Artificial Sequence
  Synthetic oligonucleotide
accttcaccagtctcgccttcgttttgatactagca

SEQ ID NO: 13102 - DNA, 32 bp, Artificial Sequence
  Synthetic oligonucleotide
tagtatgaccgcgggccctcgttgtttcatca

SEQ ID NO: 13103 - DNA, 38 bp, Artificial Sequence
  Synthetic oligonucleotide
acacccttacagcaactgtacctccaccccatcggtga

SEQ ID NO: 13104 - DNA, 35 bp, Artificial Sequence
  Synthetic oligonucleotide
gtcccgaccgctcgcgaaccctgtccatgctcgtt

SEQ ID NO: 13105 - DNA, 36 bp, Artificial Sequence
  Synthetic oligonucleotide
gactacgacctgaccgaactagcttacaactcacaa

SEQ ID NO: 13106 - DNA, 38 bp, Artificial Sequence
  Synthetic oligonucleotide
atcccacccatcccgtcagcctctgtctgggtccctga

SEQ ID NO: 13107 - DNA, 38 bp, Artificial Sequence
  Synthetic oligonucleotide
gcacgggtggtgcacgtcggagcttcggggtaagctga

SEQ ID NO: 13108 - DNA, 35 bp, Artificial Sequence
  Synthetic oligonucleotide
tgcactaacgccaacggaacgctcacaccctggcc

SEQ ID NO: 13109 - DNA, 35 bp, Artificial Sequence
  Synthetic oligonucleotide
gccacagcagtagggagggcggggtaatgggtgag

SEQ ID NO: 13110 - DNA, 38 bp, Artificial Sequence
  Synthetic oligonucleotide
gccgcatggcaggtatcacctctcgccctccgccttga

SEQ ID NO: 13111 - DNA, 35 bp, Artificial Sequence
  Synthetic oligonucleotide
acatctgcgcatggatacaccactgcacctaagcc

SEQ ID NO: 13112 - DNA, 35 bp, Artificial Sequence
  Synthetic oligonucleotide
gtctgacacgcccatccaccgatatcccctactcg

SEQ ID NO: 13113 - DNA, 35 bp, Artificial Sequence
  Synthetic oligonucleotide
gctctacctcccatcctctcttaaagcctgcacgg

SEQ ID NO: 13114 - DNA, 36 bp, Artificial Sequence
  Synthetic oligonucleotide
gagtggaccggtggggtgggaagataatgatcgaaa

SEQ ID NO: 13115 - DNA, 38 bp, Artificial Sequence
  Synthetic oligonucleotide
acgccctcattgcgtggccatccctccgttcctcgtga

SEQ ID NO: 13116 - DNA, 38 bp, Artificial Sequence
  Synthetic oligonucleotide
gacccctggcccattctgtactacgcccgcatttttga

SEQ ID NO: 13117 - DNA, 35 bp, Artificial Sequence
  Synthetic oligonucleotide
gactcctcgctgttcgtaaccttacgcaatgcccc

SEQ ID NO: 13118 - DNA, 37 bp, Artificial Sequence
  Synthetic oligonucleotide
acgagggtcccaccatcatcgccattcacatcgccga

SEQ ID NO: 13119 - DNA, 35 bp, Artificial Sequence
  Synthetic oligonucleotide
acgctgctgagcctacattgccgctgatttccaac

SEQ ID NO: 13120 - DNA, 35 bp, Artificial Sequence
  Synthetic oligonucleotide
tacacctcttccgcccgttccctgccggaggcacc

SEQ ID NO: 13121 - DNA, 37 bp, Artificial Sequence
  Synthetic oligonucleotide
ttggcccctgaccgctccgaagcgctattccatctga

SEQ ID NO: 13122 - DNA, 35 bp, Artificial Sequence
  Synthetic oligonucleotide
aacaccccggttcgtggttacgctgttctatcctc

SEQ ID NO: 13123 - DNA, 35 bp, Artificial Sequence
  Synthetic oligonucleotide
gtccaaacggaagaactagggaaggagaatttggg

SEQ ID NO: 13124 - DNA, 35 bp, Artificial Sequence
  Synthetic oligonucleotide
actggccctgaccgtttttatttctcattgctttg

SEQ ID NO: 13125 - DNA, 36 bp, Artificial Sequence
  Synthetic oligonucleotide
tcactgctcactgattcatccgtggcttctttctta

SEQ ID NO: 13126 - DNA, 35 bp, Artificial Sequence
  Synthetic oligonucleotide
gacgtaacgtcactatggatgtcccccttttcgtc

SEQ ID NO: 13127 - DNA, 35 bp, Artificial Sequence
  Synthetic oligonucleotide
tttgaccaccccctgtcctcacgtgtgtaccctgg

SEQ ID NO: 13128 - DNA, 36 bp, Artificial Sequence
  Synthetic oligonucleotide
gatggagcatacgggggggaggcatcagtgtagaca

SEQ ID NO: 13129 - DNA, 37 bp, Artificial Sequence
  Synthetic oligonucleotide
gtgcccgccccctcgtgttgcccctttgtctcggcga

SEQ ID NO: 13130 - DNA, 38 bp, Artificial Sequence
  Synthetic oligonucleotide
gggtgcacacccacgtgatacttttgccatccgcgtga

SEQ ID NO: 13131 - DNA, 35 bp, Artificial Sequence
  Synthetic oligonucleotide
gttgtcgccgaatgaactaagctatgccatcctac

SEQ ID NO: 13132 - DNA, 37 bp, Artificial Sequence
  Synthetic oligonucleotide
gccacgaaccacaacccacctgtgccatccttcagga

SEQ ID NO: 13133 - DNA, 37 bp, Artificial Sequence
  Synthetic oligonucleotide
gagaaggtgtggaggggtgttggggtgagttggctga

SEQ ID NO: 13134 - DNA, 35 bp, Artificial Sequence
  Synthetic oligonucleotide
gggtcacccatcttgcaagcttgcccattacatgt

SEQ ID NO: 13135 - DNA, 35 bp, Artificial Sequence
  Synthetic oligonucleotide
gccatcctgagcgcactgtctaaaccaccatagtt

SEQ ID NO: 13136 - DNA, 35 bp, Artificial Sequence
  Synthetic oligonucleotide
tcccaacccagcatccgaaaggtcacccacagacc

SEQ ID NO: 13137 - DNA, 35 bp, Artificial Sequence
  Synthetic oligonucleotide
gcgcatgggggagggtggatagggaatgtagaggt

SEQ ID NO: 13138 - DNA, 35 bp, Artificial Sequence
  Synthetic oligonucleotide
aatccccagccgtagcccagtctttctcgttgcaa

SEQ ID NO: 13139 - DNA, 36 bp, Artificial Sequence
  Synthetic oligonucleotide
gcaccatctcacagacggcatttcccttcttgttca

SEQ ID NO: 13140 - DNA, 35 bp, Artificial Sequence
  Synthetic oligonucleotide
gtcgcgccacaatcgttcccaagcactcgttcctt

SEQ ID NO: 13141 - DNA, 35 bp, Artificial Sequence
  Synthetic oligonucleotide
atgcacaccacccggattccaactgcgtgtaattt

SEQ ID NO: 13142 - DNA, 35 bp, Artificial Sequence
  Synthetic oligonucleotide
gtttcggaacgtcaccattttccccctgcccgtaa

SEQ ID NO: 13143 - DNA, 36 bp, Artificial Sequence
  Synthetic oligonucleotide
tcatggccgttgccataaccgttttcgctacctaca

SEQ ID NO: 13144 - DNA, 35 bp, Artificial Sequence
  Synthetic oligonucleotide
tgacccctcacttcggacccatttctgcgccctgt

SEQ ID NO: 13145 - DNA, 35 bp, Artificial Sequence
  Synthetic oligonucleotide
gccaccacaccgtactcaagagttatgcctataca

SEQ ID NO: 13146 - DNA, 37 bp, Artificial Sequence
  Synthetic oligonucleotide
acattcccccgatgcacgtatccggtccccatcgtga

SEQ ID NO: 13147 - DNA, 37 bp, Artificial Sequence
  Synthetic oligonucleotide
gtctgcctatgtacaccgagcgcagccatcccctcga

SEQ ID NO: 13148 - DNA, 38 bp, Artificial Sequence
  Synthetic oligonucleotide
ttactccacgcgcgccgatccccgtccgtacaccctga

SEQ ID NO: 13149 - DNA, 35 bp, Artificial Sequence
  Synthetic oligonucleotide
tctgtatgactccagtcgctccttcactggctttc

SEQ ID NO: 13150 - DNA, 35 bp, Artificial Sequence
  Synthetic oligonucleotide
ttcgatcacgccctgctcacacgccaccacaaatt

SEQ ID NO: 13151 - DNA, 35 bp, Artificial Sequence
  Synthetic oligonucleotide
tcatgtagccccgtatctacccacgcatactaacc

SEQ ID NO: 13152 - DNA, 37 bp, Artificial Sequence
  Synthetic oligonucleotide
gagatcggagggccggggtaagggggcggatatatga

SEQ ID NO: 13153 - DNA, 37 bp, Artificial Sequence
  Synthetic oligonucleotide
gacgcgctgttgccccatttacaccagactttgctga

SEQ ID NO: 13154 - DNA, 35 bp, Artificial Sequence
  Synthetic oligonucleotide
gcccctgccttccgcgattcgccgccgcctgctct

SEQ ID NO: 13155 - DNA, 35 bp, Artificial Sequence
  Synthetic oligonucleotide
tagccacaattcagccgatgaagcccccctcgtta

SEQ ID NO: 13156 - DNA, 35 bp, Artificial Sequence
  Synthetic oligonucleotide
tgttactgccatctcttccatcgcaatgtgtcctt

SEQ ID NO: 13157 - DNA, 35 bp, Artificial Sequence
  Synthetic oligonucleotide
aacgcggcttaacaccttctacgctggaccatcgc

SEQ ID NO: 13158 - DNA, 37 bp, Artificial Sequence
  Synthetic oligonucleotide
aatgaggtgggagcagtgatagtaagtgtgcgtagga

SEQ ID NO: 13159 - DNA, 36 bp, Artificial Sequence
  Synthetic oligonucleotide
ttagaactgccatctgtctgtctgctcctgccttta

SEQ ID NO: 13160 - DNA, 35 bp, Artificial Sequence
  Synthetic oligonucleotide
ttcgagcgggctacaacaattgtcaccgtgcctct

SEQ ID NO: 13161 - DNA, 36 bp, Artificial Sequence
  Synthetic oligonucleotide
gtgatgcccaaaccgcttagacaccgtacctttgca

SEQ ID NO: 13162 - DNA, 37 bp, Artificial Sequence
  Synthetic oligonucleotide
ttacgcccactgcacaccagtgaatgacctcttccga

SEQ ID NO: 13163 - DNA, 37 bp, Artificial Sequence
  Synthetic oligonucleotide
gcatcgcagagcacgtgtaaaggggtgggaatgagga

SEQ ID NO: 13164 - DNA, 38 bp, Artificial Sequence
  Synthetic oligonucleotide
atgggggagggagggtgggttcacagcacgtgaggtga

SEQ ID NO: 13165 - DNA, 35 bp, Artificial Sequence
  Synthetic oligonucleotide
gtcacacatcgcccagtttatctctaggtacgccc

SEQ ID NO: 13166 - DNA, 36 bp, Artificial Sequence
  Synthetic oligonucleotide
acgatctacacccgggtctcatttggtcaacatgcc

SEQ ID NO: 13167 - DNA, 35 bp, Artificial Sequence
  Synthetic oligonucleotide
agaagaccacctctgccatttttcgctgcatttgc

SEQ ID NO: 13168 - DNA, 35 bp, Artificial Sequence
  Synthetic oligonucleotide
tgatgacgtctgcgcgactattgcccttctcttgt

SEQ ID NO: 13169 - DNA, 37 bp, Artificial Sequence
  Synthetic oligonucleotide
ggagaagtagcggcgcgaggcaagagggaggggtgga

SEQ ID NO: 13170 - DNA, 35 bp, Artificial Sequence
  Synthetic oligonucleotide
agaccaagcctccgcccctatgttaccttttctac

SEQ ID NO: 13171 - DNA, 38 bp, Artificial Sequence
  Synthetic oligonucleotide
gaacgggaggctgtgaaggggtgtgggggaaatattga

SEQ ID NO: 13172 - DNA, 37 bp, Artificial Sequence
  Synthetic oligonucleotide
acccaccccccaactgcccgtgttgtagctcccttga

SEQ ID NO: 13173 - DNA, 35 bp, Artificial Sequence
  Synthetic oligonucleotide
gcgtgtttgcctccgaccctcaagccttgcttcct

SEQ ID NO: 13174 - DNA, 35 bp, Artificial Sequence
  Synthetic oligonucleotide
tacgacccgacaactgcttagctcggtttccaatc

SEQ ID NO: 13175 - DNA, 35 bp, Artificial Sequence
  Synthetic oligonucleotide
tagtacccgtcgttccgtcatgggtcttacctctc

SEQ ID NO: 13176 - DNA, 35 bp, Artificial Sequence
  Synthetic oligonucleotide
actccgcagactgtcgtaccgctattgttctcgtc

SEQ ID NO: 13177 - DNA, 38 bp, Artificial Sequence
  Synthetic oligonucleotide
taacaccctatctgtgccacgacctgttcctgctatga

SEQ ID NO: 13178 - DNA, 35 bp, Artificial Sequence
  Synthetic oligonucleotide
tccgccaccatcacagccccgggcttcggtctcta

SEQ ID NO: 13179 - DNA, 36 bp, Artificial Sequence
  Synthetic oligonucleotide
gcgccgcctcctgtacctgcaatgctgcccctcata

SEQ ID NO: 13180 - DNA, 35 bp, Artificial Sequence
  Synthetic oligonucleotide
gtctaactgttgctgctatacctcgtcgccaggcc

SEQ ID NO: 13181 - DNA, 35 bp, Artificial Sequence
  Synthetic oligonucleotide
ctcactcgccgccttgtgactcaccgtttatgtgc

SEQ ID NO: 13182 - DNA, 35 bp, Artificial Sequence
  Synthetic oligonucleotide
gtccaccggaaacgcacccccgtacaaccgacctc

SEQ ID NO: 13183 - DNA, 35 bp, Artificial Sequence
  Synthetic oligonucleotide
tgtcaagccacgatcactatgtttgtccaccatct

SEQ ID NO: 13184 - DNA, 35 bp, Artificial Sequence
  Synthetic oligonucleotide
gacacacacctttcacgataaagccagttgctttt

SEQ ID NO: 13185 - DNA, 35 bp, Artificial Sequence
  Synthetic oligonucleotide
actctggtcccattgtcttccccatacgaaattgc

SEQ ID NO: 13186 - DNA, 35 bp, Artificial Sequence
  Synthetic oligonucleotide
tgtgcccttgccctctgtatcccatagttacacgt

SEQ ID NO: 13187 - DNA, 36 bp, Artificial Sequence
  Synthetic oligonucleotide
acaccacattgttgccaccatctgtttacccgtaca

SEQ ID NO: 13188 - DNA, 36 bp, Artificial Sequence
  Synthetic oligonucleotide
acgagacgatcgtcatgtctgttcaccgcaccccca

SEQ ID NO: 13189 - DNA, 36 bp, Artificial Sequence
  Synthetic oligonucleotide
tatcgaagccgggactaggaggggcaaaatagggga

SEQ ID NO: 13190 - DNA, 35 bp, Artificial Sequence
  Synthetic oligonucleotide
tgggatcacacatcttccaccctgcgccaccctgc

SEQ ID NO: 13191 - DNA, 35 bp, Artificial Sequence
  Synthetic oligonucleotide
taaccagaccacctgctcctacacttaggacactc

SEQ ID NO: 13192 - DNA, 35 bp, Artificial Sequence
  Synthetic oligonucleotide
atgtctccgcctcgtgataatctactccatcctgc

SEQ ID NO: 13193 - DNA, 35 bp, Artificial Sequence
  Synthetic oligonucleotide
acctcgccaccaactgacccttacagacctgctgg

SEQ ID NO: 13194 - DNA, 35 bp, Artificial Sequence
  Synthetic oligonucleotide
atcttgccacgccactcatagtcgacccgcccgca

SEQ ID NO: 13195 - DNA, 38 bp, Artificial Sequence
  Synthetic oligonucleotide
accatccacgattgcccctacggatacggcctccttga

SEQ ID NO: 13196 - DNA, 34 bp, Artificial Sequence
  Synthetic oligonucleotide
gatttgccccaaccgtagcctcgggctccgttcc

SEQ ID NO: 13197 - DNA, 35 bp, Artificial Sequence
  Synthetic oligonucleotide
acatctagcctccccatattgagggccaaactcat

SEQ ID NO: 13198 - DNA, 36 bp, Artificial Sequence
  Synthetic oligonucleotide
aacgccacacctccattgcatccccgccctgtacta

SEQ ID NO: 13199 - DNA, 35 bp, Artificial Sequence
  Synthetic oligonucleotide
gtccaagcacacgtagttcccgccaattgcagccc

SEQ ID NO: 13200 - DNA, 35 bp, Artificial Sequence
  Synthetic oligonucleotide
gacacgcgccgcagcactcgcctccatgttctcct

SEQ ID NO: 13201 - DNA, 35 bp, Artificial Sequence
  Synthetic oligonucleotide
actgcatcacacttcatcactctggtttccgctcc

SEQ ID NO: 13202 - DNA, 35 bp, Artificial Sequence
  Synthetic oligonucleotide
tgcgcctcccaggtcacgcgagagcttcatcctgc

SEQ ID NO: 13203 - DNA, 35 bp, Artificial Sequence
  Synthetic oligonucleotide
tcacactagctcgtattcgtaatccgtccccttgt

SEQ ID NO: 13204 - DNA, 35 bp, Artificial Sequence
  Synthetic oligonucleotide
tacacctccgtaaggaacccacccactatgttcca

SEQ ID NO: 13205 - DNA, 36 bp, Artificial Sequence
  Synthetic oligonucleotide
gacccggtcgcatagctccaattattgaccctctca

SEQ ID NO: 13206 - DNA, 35 bp, Artificial Sequence
  Synthetic oligonucleotide
actcaccgccccgtttacgttcacatctttgtgat

SEQ ID NO: 13207 - DNA, 37 bp, Artificial Sequence
  Synthetic oligonucleotide
aaccttcaccctcgccatggcaaaaagcacccccgga

SEQ ID NO: 13208 - DNA, 37 bp, Artificial Sequence
  Synthetic oligonucleotide
gcgcccccccgcttgctcgcaacctcgttaccaatga

SEQ ID NO: 13209 - DNA, 35 bp, Artificial Sequence
  Synthetic oligonucleotide
gtcccccgctgatgtgggtgcctctcgattctctc

SEQ ID NO: 13210 - DNA, 37 bp, Artificial Sequence
  Synthetic oligonucleotide
tgtgtggccttccgacccagcctaccgcccacttgga

SEQ ID NO: 13211 - DNA, 35 bp, Artificial Sequence
  Synthetic oligonucleotide
ttgctagggttcgctactccgcatccgaggccctc

SEQ ID NO: 13212 - DNA, 35 bp, Artificial Sequence
  Synthetic oligonucleotide
tgttgcaccgtcgccgtgatctccccctctaccag

SEQ ID NO: 13213 - DNA, 35 bp, Artificial Sequence
  Synthetic oligonucleotide
gctgaccgaagccggccaggtaacccctctcattc

SEQ ID NO: 13214 - DNA, 35 bp, Artificial Sequence
  Synthetic oligonucleotide
gatgctcctatgaatcacctgggccctataccttc

SEQ ID NO: 13215 - DNA, 36 bp, Artificial Sequence
  Synthetic oligonucleotide
gacgactcctatcccaaccacacgccttcacgcgaa

SEQ ID NO: 13216 - DNA, 36 bp, Artificial Sequence
  Synthetic oligonucleotide
attctcccgcccacctcggcctcataaagggcgaca

SEQ ID NO: 13217 - DNA, 35 bp, Artificial Sequence
  Synthetic oligonucleotide
aacaaggcaccctccttgctccgatatgccaacct

SEQ ID NO: 13218 - DNA, 37 bp, Artificial Sequence
  Synthetic oligonucleotide
gcatcccgccggctgccttttgtacctgctcttcgga

SEQ ID NO: 13219 - DNA, 38 bp, Artificial Sequence
  Synthetic oligonucleotide
agcgacctcccgcccccacgctcagtcacatcaattga

SEQ ID NO: 13220 - DNA, 35 bp, Artificial Sequence
  Synthetic oligonucleotide
gaacaccaccccttcgtctatgatgtctcggttac

SEQ ID NO: 13221 - DNA, 35 bp, Artificial Sequence
  Synthetic oligonucleotide
tacagctcgcaatcacagccctggattcacccccc

SEQ ID NO: 13222 - DNA, 35 bp, Artificial Sequence
  Synthetic oligonucleotide
tatgcacccccttttgtctactggccgtcgtccct

SEQ ID NO: 13223 - DNA, 35 bp, Artificial Sequence
  Synthetic oligonucleotide
gatatggccggtcgctccctgcttcagttcgctct

SEQ ID NO: 13224 - DNA, 37 bp, Artificial Sequence
  Synthetic oligonucleotide
gatctcagccatcctgagcgtttgccccgttttttga

SEQ ID NO: 13225 - DNA, 35 bp, Artificial Sequence
  Synthetic oligonucleotide
accacacccttgatatatccctctgggcatttttg

SEQ ID NO: 13226 - DNA, 35 bp, Artificial Sequence
  Synthetic oligonucleotide
ttaacgagcgcgaaactacgttctagcccactcct

SEQ ID NO: 13227 - DNA, 36 bp, Artificial Sequence
  Synthetic oligonucleotide
aatgaccttacacatgcatactacgtagacccgcca

SEQ ID NO: 13228 - DNA, 37 bp, Artificial Sequence
  Synthetic oligonucleotide
ttcgaagaaggaggttggaaagctggtgacggagaga

SEQ ID NO: 13229 - DNA, 36 bp, Artificial Sequence
  Synthetic oligonucleotide
agtaccctccgccacgtccgttactgccgcacttta

SEQ ID NO: 13230 - DNA, 35 bp, Artificial Sequence
  Synthetic oligonucleotide
gtgaaggccctggtccacgacacatccccttatcc

SEQ ID NO: 13231 - DNA, 35 bp, Artificial Sequence
  Synthetic oligonucleotide
gcacgcttaacactgccgctttccagcccgcccaa

SEQ ID NO: 13232 - DNA, 36 bp, Artificial Sequence
  Synthetic oligonucleotide
ttgccacgtttgcctcatctactctcctgctgaaca

SEQ ID NO: 13233 - DNA, 37 bp, Artificial Sequence
  Synthetic oligonucleotide
atgcggggaacgaaaagggggattggtgatgggaaga

SEQ ID NO: 13234 - DNA, 36 bp, Artificial Sequence
  Synthetic oligonucleotide
gaagtcagcgcaccgccgcccatcgtaaagccctta

SEQ ID NO: 13235 - DNA, 36 bp, Artificial Sequence
  Synthetic oligonucleotide
tatctgggacaacaaaggaaggggaaagggggaaca

SEQ ID NO: 13236 - DNA, 35 bp, Artificial Sequence
  Synthetic oligonucleotide
gacaacccccattgtatccgccattgtgcctaggc

SEQ ID NO: 13237 - DNA, 35 bp, Artificial Sequence
  Synthetic oligonucleotide
gatcagccacgacctgatctagacacccactcact

SEQ ID NO: 13238 - DNA, 35 bp, Artificial Sequence
  Synthetic oligonucleotide
tccgacggtcttatcccgagtgcttgaccacaccc

SEQ ID NO: 13239 - DNA, 36 bp, Artificial Sequence
  Synthetic oligonucleotide
tagaggcgcagattgtcccagcccccgcctgcacca

SEQ ID NO: 13240 - DNA, 35 bp, Artificial Sequence
  Synthetic oligonucleotide
gctatcgggagggtgggttgatggggcggaaacgg

SEQ ID NO: 13241 - DNA, 35 bp, Artificial Sequence
  Synthetic oligonucleotide
gtaacccaaccaccatcccgctgtagacttgtagt

SEQ ID NO: 13242 - DNA, 37 bp, Artificial Sequence
  Synthetic oligonucleotide
tgctctgccccgggcctataacctcgaccatctggga

SEQ ID NO: 13243 - DNA, 36 bp, Artificial Sequence
  Synthetic oligonucleotide
accgagcctcaccgacgtaccacctttgcctcagga

SEQ ID NO: 13244 - DNA, 35 bp, Artificial Sequence
  Synthetic oligonucleotide
gtccactgtcggtgctccctctaagcgttttcctc

SEQ ID NO: 13245 - DNA, 35 bp, Artificial Sequence
  Synthetic oligonucleotide
gcctaccacaggtcattttcctaaccacactatgt

SEQ ID NO: 13246 - DNA, 36 bp, Artificial Sequence
  Synthetic oligonucleotide
actggggggggtagtaggctggagcgggggagaaaa

SEQ ID NO: 13247 - DNA, 35 bp, Artificial Sequence
  Synthetic oligonucleotide
tgcggtgacacatatctaccccacattcccgcgca

SEQ ID NO: 13248 - DNA, 36 bp, Artificial Sequence
  Synthetic oligonucleotide
gtctcacaggcacctgttcataaatgcccgccccga

SEQ ID NO: 13249 - DNA, 36 bp, Artificial Sequence
  Synthetic oligonucleotide
tactacacgcccatcctgcgttactttcccatttga

SEQ ID NO: 13250 - DNA, 35 bp, Artificial Sequence
  Synthetic oligonucleotide
gcacacctcgaatcttgcgcttaatgaactcactc

SEQ ID NO: 13251 - DNA, 35 bp, Artificial Sequence
  Synthetic oligonucleotide
tcccatcagtaggccacccgccggtacatgcactt

SEQ ID NO: 13252 - DNA, 38 bp, Artificial Sequence
  Synthetic oligonucleotide
gccaacataatacgctttgcatgcactctcccccgtga

SEQ ID NO: 13253 - DNA, 36 bp, Artificial Sequence
  Synthetic oligonucleotide
tccctccgaaagaacggcccatcaactcacatccgc

SEQ ID NO: 13254 - DNA, 35 bp, Artificial Sequence
  Synthetic oligonucleotide
acgatggtgggggtcaagaaggaacggaaggccgg

SEQ ID NO: 13255 - DNA, 38 bp, Artificial Sequence
  Synthetic oligonucleotide
tccgccgtgcaccccattaccacatgacagcctggtga

SEQ ID NO: 13256 - DNA, 36 bp, Artificial Sequence
  Synthetic oligonucleotide
taccgacgttagcatccgacccgcctcccacacgaa

SEQ ID NO: 13257 - DNA, 36 bp, Artificial Sequence
  Synthetic oligonucleotide
acatccactcctgcgcggtctgctctcatctatcga

SEQ ID NO: 13258 - DNA, 38 bp, Artificial Sequence
  Synthetic oligonucleotide
gcgctagcacggacacatgttctctggtgtacccatga

SEQ ID NO: 13259 - DNA, 36 bp, Artificial Sequence
  Synthetic oligonucleotide
acccccccccatgatgcatagcccacggttcccttc

SEQ ID NO: 13260 - DNA, 35 bp, Artificial Sequence
  Synthetic oligonucleotide
actacaccccacctgtttaagtcacatcgagggtt

SEQ ID NO: 13261 - DNA, 37 bp, Artificial Sequence
  Synthetic oligonucleotide
tccaagccaatgcaaccatcgaaccaacgccttccga

SEQ ID NO: 13262 - DNA, 35 bp, Artificial Sequence
  Synthetic oligonucleotide
tagaccagcagcccgtgccgtgtcacacctttcac

SEQ ID NO: 13263 - DNA, 35 bp, Artificial Sequence
  Synthetic oligonucleotide
gattgaatcgcggcaggcttttccacccctgcttg

SEQ ID NO: 13264 - DNA, 36 bp, Artificial Sequence
  Synthetic oligonucleotide
ggatccgtacagggggggtgggaagggttcatgcaa

SEQ ID NO: 13265 - DNA, 35 bp, Artificial Sequence
  Synthetic oligonucleotide
tccacccccggattctcgcaaaggcctgactttga

SEQ ID NO: 13266 - DNA, 35 bp, Artificial Sequence
  Synthetic oligonucleotide
gacgtatccaccaccgactcctgttgcctcctgac

SEQ ID NO: 13267 - DNA, 35 bp, Artificial Sequence
  Synthetic oligonucleotide
gtacgccctcagccgcgtggtccgttccccgtctc

SEQ ID NO: 13268 - DNA, 35 bp, Artificial Sequence
  Synthetic oligonucleotide
atcaaggagaaggaaggcgaaattggagacttgaa

SEQ ID NO: 13269 - DNA, 38 bp, Artificial Sequence
  Synthetic oligonucleotide
gcacacccggcaggcagtttcgcgccccttatctctga

SEQ ID NO: 13270 - DNA, 36 bp, Artificial Sequence
  Synthetic oligonucleotide
acgccccatgtccttgccagtcatacgcccctccaa

SEQ ID NO: 13271 - DNA, 36 bp, Artificial Sequence
  Synthetic oligonucleotide
tccacgaccggaaggtcccatccaacacacttgaga

SEQ ID NO: 13272 - DNA, 37 bp, Artificial Sequence
  Synthetic oligonucleotide
tgacatctccccggaagcgcaacgatcctgctctcga

SEQ ID NO: 13273 - DNA, 35 bp, Artificial Sequence
  Synthetic oligonucleotide
tatccgacacccaggctgacgtgccactcctgtac

SEQ ID NO: 13274 - DNA, 35 bp, Artificial Sequence
  Synthetic oligonucleotide
gtccccaggtcgccggtctcttgttgcatcaaccg

SEQ ID NO: 13275 - DNA, 37 bp, Artificial Sequence
  Synthetic oligonucleotide
tcacgcaagggacggggggaaaaggttcgcatgtcga

SEQ ID NO: 13276 - DNA, 37 bp, Artificial Sequence
  Synthetic oligonucleotide
aagatagacggagtggtggaatcaggggaatggcgga

SEQ ID NO: 13277 - DNA, 35 bp, Artificial Sequence
  Synthetic oligonucleotide
gtgattccaccctgatacgaccctggcgcatgcct

SEQ ID NO: 13278 - DNA, 37 bp, Artificial Sequence
  Synthetic oligonucleotide
gagagcgcagaaagaggtgatggaggagggagctgga

SEQ ID NO: 13279 - DNA, 35 bp, Artificial Sequence
  Synthetic oligonucleotide
acctccaaccctcgttcgtgctttcgcatatccgc

SEQ ID NO: 13280 - DNA, 35 bp, Artificial Sequence
  Synthetic oligonucleotide
gcacgcccctgactttcacgtccccgcttccctgg

SEQ ID NO: 13281 - DNA, 35 bp, Artificial Sequence
  Synthetic oligonucleotide
tccgccgtgcacctccccgttgtgatctgcacata

SEQ ID NO: 13282 - DNA, 35 bp, Artificial Sequence
  Synthetic oligonucleotide
tgctactacacatttctcgccctttcccgaggtac

SEQ ID NO: 13283 - DNA, 35 bp, Artificial Sequence
  Synthetic oligonucleotide
tcactgacggcactcaccccgatagttcccgcacc

SEQ ID NO: 13284 - DNA, 35 bp, Artificial Sequence
  Synthetic oligonucleotide
tcacacgtctttcgaaaatgctggcccaatcccgt

SEQ ID NO: 13285 - DNA, 36 bp, Artificial Sequence
  Synthetic oligonucleotide
atacgcccccgctcctcttacggattccggaaatta

SEQ ID NO: 13286 - DNA, 36 bp, Artificial Sequence
  Synthetic oligonucleotide
accaccctacaagtactatcccagcaagttcctgca

SEQ ID NO: 13287 - DNA, 35 bp, Artificial Sequence
  Synthetic oligonucleotide
acaacccggggaagggagggatctagggaaccacg

SEQ ID NO: 13288 - DNA, 35 bp, Artificial Sequence
  Synthetic oligonucleotide
aagcctagagggataaagggagggggggcgacaac

SEQ ID NO: 13289 - DNA, 35 bp, Artificial Sequence
  Synthetic oligonucleotide
acatccacccagcttctgccgccatttcagtcgcg

SEQ ID NO: 13290 - DNA, 38 bp, Artificial Sequence
  Synthetic oligonucleotide
tgacctcggcacagcgcacctctcaccgttccgtttga

SEQ ID NO: 13291 - DNA, 35 bp, Artificial Sequence
  Synthetic oligonucleotide
gacaccccttctacaccagtctgcacttcatacac

SEQ ID NO: 13292 - DNA, 35 bp, Artificial Sequence
  Synthetic oligonucleotide
acgagtgcactgctctttcgtctatcggaaccacc

SEQ ID NO: 13293 - DNA, 35 bp, Artificial Sequence
  Synthetic oligonucleotide
gttgagcactgcttttctcgcgcctagttcctgcc

SEQ ID NO: 13294 - DNA, 35 bp, Artificial Sequence
  Synthetic oligonucleotide
gcgctcatggctctgttcaaccagtcattactatc

SEQ ID NO: 13295 - DNA, 35 bp, Artificial Sequence
  Synthetic oligonucleotide
aatgaagctgccgcatctcttaagttatctccctg

SEQ ID NO: 13296 - DNA, 35 bp, Artificial Sequence
  Synthetic oligonucleotide
acgtgcgctcccccggctgacctgagaaactccct

SEQ ID NO: 13297 - DNA, 35 bp, Artificial Sequence
  Synthetic oligonucleotide
ggagggtgggagtggagggtcaaaggctgtcaagt

SEQ ID NO: 13298 - DNA, 36 bp, Artificial Sequence
  Synthetic oligonucleotide
accacatgcatcttgctcactcatgacacgtgctta

SEQ ID NO: 13299 - DNA, 35 bp, Artificial Sequence
  Synthetic oligonucleotide
ggtcgtgggaaatgaaagtctggggagggcatggt

SEQ ID NO: 13300 - DNA, 36 bp, Artificial Sequence
  Synthetic oligonucleotide
ggtgggggggcaataggggctactaaatggacggta

SEQ ID NO: 13301 - DNA, 35 bp, Artificial Sequence
  Synthetic oligonucleotide
gccaatggcacattgttaccttaagcccatgcctt

SEQ ID NO: 13302 - DNA, 36 bp, Artificial Sequence
  Synthetic oligonucleotide
ccaccttctatcgcgtccactggaagcctatctcaa

SEQ ID NO: 13303 - DNA, 36 bp, Artificial Sequence
  Synthetic oligonucleotide
tgtttgccatagcttgcattgctcaccttccctgta

SEQ ID NO: 13304 - DNA, 35 bp, Artificial Sequence
  Synthetic oligonucleotide
gatcgcaattgagccatcgcagcctgtttctctat

SEQ ID NO: 13305 - DNA, 35 bp, Artificial Sequence
  Synthetic oligonucleotide
aggacacaggcggctcttctttacagtccatttct

SEQ ID NO: 13306 - DNA, 35 bp, Artificial Sequence
  Synthetic oligonucleotide
atcccagttcccgtacccagctttacggagttccc

SEQ ID NO: 13307 - DNA, 36 bp, Artificial Sequence
  Synthetic oligonucleotide
aacgccccacccttgtttggtatcaccactccggaa

SEQ ID NO: 13308 - DNA, 37 bp, Artificial Sequence
  Synthetic oligonucleotide
accgcacctatgccacaaattccatgctgacccacga

SEQ ID NO: 13309 - DNA, 37 bp, Artificial Sequence
  Synthetic oligonucleotide
gaccaaccgtgcctcatctcgcagtacagccccggga

SEQ ID NO: 13310 - DNA, 35 bp, Artificial Sequence
  Synthetic oligonucleotide
aactcgcccctgtcccggtgcttgtctgttccacc

SEQ ID NO: 13311 - DNA, 38 bp, Artificial Sequence
  Synthetic oligonucleotide
tgatcactgtcactcttacctggcctctcaaccgttga

SEQ ID NO: 13312 - DNA, 35 bp, Artificial Sequence
  Synthetic oligonucleotide
atgttctctcctggcccccactgtttatcgtttgg

SEQ ID NO: 13313 - DNA, 35 bp, Artificial Sequence
  Synthetic oligonucleotide
actcccccgggcccctactccccagcgcgaacttt

SEQ ID NO: 13314 - DNA, 38 bp, Artificial Sequence
  Synthetic oligonucleotide
tcctcaccgctacattcgtccaaccctgcctctactga

SEQ ID NO: 13315 - DNA, 36 bp, Artificial Sequence
  Synthetic oligonucleotide
tctcagtagtggtgatatgggtgggcgggtggtgta

SEQ ID NO: 13316 - DNA, 28 bp, Artificial Sequence
  Synthetic oligonucleotide
gatgatagggtgggaggtgggttgacgg

SEQ ID NO: 13317 - DNA, 35 bp, Artificial Sequence
  Synthetic oligonucleotide
tgtgccccttacatttcatggccactttggattgc

SEQ ID NO: 13318 - DNA, 35 bp, Artificial Sequence
  Synthetic oligonucleotide
atcgcccccgcgacccatattgtctctctaatact

SEQ ID NO: 13319 - DNA, 35 bp, Artificial Sequence
  Synthetic oligonucleotide
tacacaaatggggtcagcgatcgttctccttcgcc

SEQ ID NO: 13320 - DNA, 35 bp, Artificial Sequence
  Synthetic oligonucleotide
ctggatcaccaccatacgttacacgtacgccttgc

SEQ ID NO: 13321 - DNA, 36 bp, Artificial Sequence
  Synthetic oligonucleotide
acgtcctccaacaccccacccaaggctgcaccccga

SEQ ID NO: 13322 - DNA, 35 bp, Artificial Sequence
  Synthetic oligonucleotide
taagctgcctcgctaaccagaccccgtccctcttg

SEQ ID NO: 13323 - DNA, 35 bp, Artificial Sequence
  Synthetic oligonucleotide
ttgtgccccgcctatttcgactggttccgacccga

SEQ ID NO: 13324 - DNA, 38 bp, Artificial Sequence
  Synthetic oligonucleotide
atgcgacacatctcgcctcgccacatcattgttcctga

SEQ ID NO: 13325 - DNA, 36 bp, Artificial Sequence
  Synthetic oligonucleotide
gaacccgcctgagcttcgtgacgccgcctacttcta

SEQ ID NO: 13326 - DNA, 35 bp, Artificial Sequence
  Synthetic oligonucleotide
atcagccggtgcgagcccccctcattttttgtttt

SEQ ID NO: 13327 - DNA, 35 bp, Artificial Sequence
  Synthetic oligonucleotide
ggagtcatcgtccgtactgccgccctccctgccaa

SEQ ID NO: 13328 - DNA, 35 bp, Artificial Sequence
  Synthetic oligonucleotide
gctaacacgtcagctatgcttatgtctgcctccac

SEQ ID NO: 13329 - DNA, 36 bp, Artificial Sequence
  Synthetic oligonucleotide
tgacgcattagcatgcttgccactgtgctccaccaa

SEQ ID NO: 13330 - DNA, 36 bp, Artificial Sequence
  Synthetic oligonucleotide
gagaaggggccgataccgggtaacaaaggggggaga

SEQ ID NO: 13331 - DNA, 38 bp, Artificial Sequence
  Synthetic oligonucleotide
gctccaccctccacgttcataaaatcctgtgctactga

SEQ ID NO: 13332 - DNA, 38 bp, Artificial Sequence
  Synthetic oligonucleotide
tcccgtcacttgaatcactctgccaacttctttcgtga

SEQ ID NO: 13333 - DNA, 37 bp, Artificial Sequence
  Synthetic oligonucleotide
gcgactaacaggcatgaggggggtggaggaaatgtga

SEQ ID NO: 13334 - DNA, 35 bp, Artificial Sequence
  Synthetic oligonucleotide
ttacgacccgtcactcctttgtttcacttctgcac

SEQ ID NO: 13335 - DNA, 35 bp, Artificial Sequence
  Synthetic oligonucleotide
acccgtgaccgtatcgttgcgaatcaacctttccc

SEQ ID NO: 13336 - DNA, 35 bp, Artificial Sequence
  Synthetic oligonucleotide
attgcatcctcgacctgacctcatcgcaggtactc

SEQ ID NO: 13337 - DNA, 35 bp, Artificial Sequence
  Synthetic oligonucleotide
acttacccacgcgacactggccctctatgcacgcg

SEQ ID NO: 13338 - DNA, 35 bp, Artificial Sequence
  Synthetic oligonucleotide
gtccgtaaactgtttcgaccacctgtcccttttta

SEQ ID NO: 13339 - DNA, 35 bp, Artificial Sequence
  Synthetic oligonucleotide
tcaagcataagagggcgggaggtgttggatgggtg

SEQ ID NO: 13340 - DNA, 35 bp, Artificial Sequence
  Synthetic oligonucleotide
tgtgaccgtagctcccatgcgatcgccccctttgt

SEQ ID NO: 13341 - DNA, 36 bp, Artificial Sequence
  Synthetic oligonucleotide
gcaatacgtaaattgcgctgggttgattcaccttca

SEQ ID NO: 13342 - DNA, 38 bp, Artificial Sequence
  Synthetic oligonucleotide
tcaactcgccgtctgtttccctaccgtccctggtttga

SEQ ID NO: 13343 - DNA, 35 bp, Artificial Sequence
  Synthetic oligonucleotide
agtaatacgcccgcagccccctgctttcattctgc

SEQ ID NO: 13344 - DNA, 35 bp, Artificial Sequence
  Synthetic oligonucleotide
aactacactcgccgccctctatttcgtcactgcgt

SEQ ID NO: 13345 - DNA, 35 bp, Artificial Sequence
  Synthetic oligonucleotide
tttgccgtcgcaatctaccaccctgatcagtcgtt

SEQ ID NO: 13346 - DNA, 38 bp, Artificial Sequence
  Synthetic oligonucleotide
aactatgccgtcatagcacacaccacgcacacctatga

SEQ ID NO: 13347 - DNA, 35 bp, Artificial Sequence
  Synthetic oligonucleotide
tacaccgaccgccgtgcttcactctggctctagta

SEQ ID NO: 13348 - DNA, 35 bp, Artificial Sequence
  Synthetic oligonucleotide
ttttgccgcatccacgaatcgacgtgcacattttc

SEQ ID NO: 13349 - DNA, 35 bp, Artificial Sequence
  Synthetic oligonucleotide
tgtcgcccgatgctcgtttcggcgccttcttctcc

SEQ ID NO: 13350 - DNA, 37 bp, Artificial Sequence
  Synthetic oligonucleotide
ttcccgctccgcaataccgatcatctgttaccctcga

SEQ ID NO: 13351 - DNA, 38 bp, Artificial Sequence
  Synthetic oligonucleotide
gacaggccaccacacccccacactgcgcaagcagatga

SEQ ID NO: 13352 - DNA, 37 bp, Artificial Sequence
  Synthetic oligonucleotide
agccctcggcaccgtatctttcttgcctgatcactga

SEQ ID NO: 13353 - DNA, 35 bp, Artificial Sequence
  Synthetic oligonucleotide
accgactcggctcaatgcactcgcatatctttctc

SEQ ID NO: 13354 - DNA, 35 bp, Artificial Sequence
  Synthetic oligonucleotide
gtgcgcaacaggtctcagcctttccggtaccttca

SEQ ID NO: 13355 - DNA, 35 bp, Artificial Sequence
  Synthetic oligonucleotide
acatcacactcattcacgctcgccctgtatcatgt

SEQ ID NO: 13356 - DNA, 36 bp, Artificial Sequence
  Synthetic oligonucleotide
gacccccggtcaatcgctacttatctgcctaccgca

SEQ ID NO: 13357 - DNA, 35 bp, Artificial Sequence
  Synthetic oligonucleotide
gtatgagtgggggagtcgtaggaggcgggtttatt

SEQ ID NO: 13358 - DNA, 35 bp, Artificial Sequence
  Synthetic oligonucleotide
gatgcctcaacacgaacttgtaactgctctttcag

SEQ ID NO: 13359 - DNA, 35 bp, Artificial Sequence
  Synthetic oligonucleotide
gcgcaccacacaaagtatctcggcccttctgcccg

SEQ ID NO: 13360 - DNA, 36 bp, Artificial Sequence
  Synthetic oligonucleotide
agacggacacatatggggggaatggtaggggagtga

SEQ ID NO: 13361 - DNA, 38 bp, Artificial Sequence
  Synthetic oligonucleotide
aacgccgacctgccccacaagtgcgataacctcattga

SEQ ID NO: 13362 - DNA, 38 bp, Artificial Sequence
  Synthetic oligonucleotide
ttccaccacgtcattcgttcccttggtcctcgtgctga

SEQ ID NO: 13363 - DNA, 36 bp, Artificial Sequence
  Synthetic oligonucleotide
acacgacactccctgctgttccccatgtgaggttta

SEQ ID NO: 13364 - DNA, 35 bp, Artificial Sequence
  Synthetic oligonucleotide
gctatagccgttacgcgcgtgtcgcctccattccc

SEQ ID NO: 13365 - DNA, 35 bp, Artificial Sequence
  Synthetic oligonucleotide
gcgcactcccttttttcactagatctcgtcgacga

SEQ ID NO: 13366 - DNA, 35 bp, Artificial Sequence
  Synthetic oligonucleotide
ggtcctcccgaaggtaaccgtttgccatgctatcc

SEQ ID NO: 13367 - DNA, 35 bp, Artificial Sequence
  Synthetic oligonucleotide
tcaactagccggagaaccagtagcatgccaccctc

SEQ ID NO: 13368 - DNA, 35 bp, Artificial Sequence
  Synthetic oligonucleotide
ggttcacccccaattatgtcgactttccgttcggt

SEQ ID NO: 13369 - DNA, 35 bp, Artificial Sequence
  Synthetic oligonucleotide
ggatccggtgccgccatcatctccctgtcgaacgc

SEQ ID NO: 13370 - DNA, 35 bp, Artificial Sequence
  Synthetic oligonucleotide
agcgttgcccagttcgcgcattttgcttgttctcg

SEQ ID NO: 13371 - DNA, 37 bp, Artificial Sequence
  Synthetic oligonucleotide
tgccatctcggctcatcaccgtgccccaactattgga

SEQ ID NO: 13372 - DNA, 36 bp, Artificial Sequence
  Synthetic oligonucleotide
gcaagggcatccatctcccgcgggcacatacctcca

SEQ ID NO: 13373 - DNA, 35 bp, Artificial Sequence
  Synthetic oligonucleotide
gactactccagcccctactagccgtcatccttgga

SEQ ID NO: 13374 - DNA, 37 bp, Artificial Sequence
  Synthetic oligonucleotide
gatcaccccatcatgagtccacacaggctttgattga

SEQ ID NO: 13375 - DNA, 35 bp, Artificial Sequence
  Synthetic oligonucleotide
atgtcacgctctgccactatctacctagtctcact

SEQ ID NO: 13376 - DNA, 35 bp, Artificial Sequence
  Synthetic oligonucleotide
tcacaacgccgcagtctttcaaccatggcccctgt

SEQ ID NO: 13377 - DNA, 35 bp, Artificial Sequence
  Synthetic oligonucleotide
gctgacccccgcttagctcttgtcgattatctttt

SEQ ID NO: 13378 - DNA, 35 bp, Artificial Sequence
  Synthetic oligonucleotide
accctctcgtatgtcgtaccgattcctgtctttca

SEQ ID NO: 13379 - DNA, 37 bp, Artificial Sequence
  Synthetic oligonucleotide
ggggcgacgagcccccggatccccttcttcaccatga

SEQ ID NO: 13380 - DNA, 36 bp, Artificial Sequence
  Synthetic oligonucleotide
gattccgtcggtccgaagcctccacattaaccgtta

SEQ ID NO: 13381 - DNA, 35 bp, Artificial Sequence
  Synthetic oligonucleotide
tgcccgaacttggcgtttcaatttatggtccatcc

SEQ ID NO: 13382 - DNA, 35 bp, Artificial Sequence
  Synthetic oligonucleotide
atcactgcccggggagcatgctatcttttaccctt

SEQ ID NO: 13383 - DNA, 38 bp, Artificial Sequence
  Synthetic oligonucleotide
gccccacgacaccccgcccggcgttccatttaacgtga

SEQ ID NO: 13384 - DNA, 35 bp, Artificial Sequence
  Synthetic oligonucleotide
gcacccggcatgtttttgtgcttccaccccaagtt

SEQ ID NO: 13385 - DNA, 36 bp, Artificial Sequence
  Synthetic oligonucleotide
ttcgaggagctctctgtgccactcctacctctcaca

SEQ ID NO: 13386 - DNA, 37 bp, Artificial Sequence
  Synthetic oligonucleotide
acacggacggtggggggagaggagagtgagcgaagga

SEQ ID NO: 13387 - DNA, 38 bp, Artificial Sequence
  Synthetic oligonucleotide
tccccaacgcctaaccggttaaatttggtctcccgtga

SEQ ID NO: 13388 - DNA, 36 bp, Artificial Sequence
  Synthetic oligonucleotide
acaacacgggagggcgggtacgcaggggatccgtta

SEQ ID NO: 13389 - DNA, 35 bp, Artificial Sequence
  Synthetic oligonucleotide
gctgaccattcacccatctgtattccttcacatac

SEQ ID NO: 13390 - DNA, 35 bp, Artificial Sequence
  Synthetic oligonucleotide
gtcacctaaacatgtctttcgttaacccccctgta

SEQ ID NO: 13391 - DNA, 35 bp, Artificial Sequence
  Synthetic oligonucleotide
tgagacgccgcacgctctcctggcccttccctgtc

SEQ ID NO: 13392 - DNA, 35 bp, Artificial Sequence
  Synthetic oligonucleotide
gtggtccctattgaacgtgcccgtatgtcccttct

SEQ ID NO: 13393 - DNA, 35 bp, Artificial Sequence
  Synthetic oligonucleotide
tagccccgtacctgggcgacaccactgccccaaca

SEQ ID NO: 13394 - DNA, 36 bp, Artificial Sequence
  Synthetic oligonucleotide
gcactgcgaccaccgagccctccaccacgcccgtaa

SEQ ID NO: 13395 - DNA, 35 bp, Artificial Sequence
  Synthetic oligonucleotide
gtggggcctctacccgaatctgtctccattactga

SEQ ID NO: 13396 - DNA, 35 bp, Artificial Sequence
  Synthetic oligonucleotide
ttccccagagccaccctttcgctgtgccatggtcc

SEQ ID NO: 13397 - DNA, 35 bp, Artificial Sequence
  Synthetic oligonucleotide
gaccgtgacggagctgaccgcgcattcctcaccac

SEQ ID NO: 13398 - DNA, 35 bp, Artificial Sequence
  Synthetic oligonucleotide
ttgcgccgctccccattccagctgccattgttttt

SEQ ID NO: 13399 - DNA, 36 bp, Artificial Sequence
  Synthetic oligonucleotide
gtaacatccctgcgctctctttcggttaccgagtaa

SEQ ID NO: 13400 - DNA, 36 bp, Artificial Sequence
  Synthetic oligonucleotide
ggaccaccactgagcccccgacttgggagacttcca

SEQ ID NO: 13401 - DNA, 37 bp, Artificial Sequence
  Synthetic oligonucleotide
agcggaggggagagcgtgagggccggggaaataggga

SEQ ID NO: 13402 - DNA, 38 bp, Artificial Sequence
  Synthetic oligonucleotide
acacatcagccggagccacagcccaccccctagcctga

SEQ ID NO: 13403 - DNA, 35 bp, Artificial Sequence
  Synthetic oligonucleotide
tcactcctcgattgccacactactttccggttcac

SEQ ID NO: 13404 - DNA, 35 bp, Artificial Sequence
  Synthetic oligonucleotide
gatcggtgcatgcatcgcctccattgaactgcctt

SEQ ID NO: 13405 - DNA, 36 bp, Artificial Sequence
  Synthetic oligonucleotide
gacgtagcagccatacgcgctagaccattcctatca

SEQ ID NO: 13406 - DNA, 32 bp, Artificial Sequence
  Synthetic oligonucleotide
atgttaaatccgccactgagttgcccttgtga

SEQ ID NO: 13407 - DNA, 35 bp, Artificial Sequence
  Synthetic oligonucleotide
tctaaatccacgccctccgtgtccgacccggttca

SEQ ID NO: 13408 - DNA, 35 bp, Artificial Sequence
  Synthetic oligonucleotide
atcctaccccggcggccattgactcatccatcgac

SEQ ID NO: 13409 - DNA, 35 bp, Artificial Sequence
  Synthetic oligonucleotide
tcctcagcccccgccgcgaggcgttagccacactc

SEQ ID NO: 13410 - DNA, 35 bp, Artificial Sequence
  Synthetic oligonucleotide
gaccaacgaagcaaggtctctaccctctccgcaca

SEQ ID NO: 13411 - DNA, 37 bp, Artificial Sequence
  Synthetic oligonucleotide
tccgaccattcgcctctcgatcgcatttgcacattga

SEQ ID NO: 13412 - DNA, 35 bp, Artificial Sequence
  Synthetic oligonucleotide
tgtccgatccagttttttgtgcccattgttcgcac

SEQ ID NO: 13413 - DNA, 35 bp, Artificial Sequence
  Synthetic oligonucleotide
tcctctggaccgcttggctaccctggctaactatc

SEQ ID NO: 13414 - DNA, 36 bp, Artificial Sequence
  Synthetic oligonucleotide
gtgccgctcacatcctccgaagacccagcccgttca

SEQ ID NO: 13415 - DNA, 36 bp, Artificial Sequence
  Synthetic oligonucleotide
ttctacatgcgtatgctatcccaccgtcccatacga

SEQ ID NO: 13416 - DNA, 37 bp, Artificial Sequence
  Synthetic oligonucleotide
tttgcagacaacgcaaaacgtaatgaaccccatccga

SEQ ID NO: 13417 - DNA, 35 bp, Artificial Sequence
  Synthetic oligonucleotide
tcagccactttcccctttctccgtcgcttcaagga

SEQ ID NO: 13418 - DNA, 36 bp, Artificial Sequence
  Synthetic oligonucleotide
gacgaccagactcacaaccgtatcacgcttaccaaa

SEQ ID NO: 13419 - DNA, 35 bp, Artificial Sequence
  Synthetic oligonucleotide
gttcacagtagcctatgcgcatcgccctgtttatc

SEQ ID NO: 13420 - DNA, 36 bp, Artificial Sequence
  Synthetic oligonucleotide
gatgacccccgtctcgctgcctgtacccaagcaata

SEQ ID NO: 13421 - DNA, 35 bp, Artificial Sequence
  Synthetic oligonucleotide
atcgccctaagccgtcccctgctattctgttgccg

SEQ ID NO: 13422 - DNA, 35 bp, Artificial Sequence
  Synthetic oligonucleotide
taacctcccgcaagtgtatcgccactggcttccct

SEQ ID NO: 13423 - DNA, 37 bp, Artificial Sequence
  Synthetic oligonucleotide
agcctacgccattgccctccgccttatgcttttgcga

SEQ ID NO: 13424 - DNA, 36 bp, Artificial Sequence
  Synthetic oligonucleotide
aatgggagtcgggggggtgggcgcccgagaaattga

SEQ ID NO: 13425 - DNA, 36 bp, Artificial Sequence
  Synthetic oligonucleotide
accacgcacctttcttaccgcactatgcttcatgta

SEQ ID NO: 13426 - DNA, 35 bp, Artificial Sequence
  Synthetic oligonucleotide
gcctgccgcctgcactctcactccgtagttatacg

SEQ ID NO: 13427 - DNA, 37 bp, Artificial Sequence
  Synthetic oligonucleotide
gccacatgcagtaggggcatggcggggaaaaggggga

SEQ ID NO: 13428 - DNA, 37 bp, Artificial Sequence
  Synthetic oligonucleotide
accgtcaacccctgcatgcacgtagatttcaccatga

SEQ ID NO: 13429 - DNA, 38 bp, Artificial Sequence
  Synthetic oligonucleotide
gtctttgccccggaccccttataacgatcacactctga

SEQ ID NO: 13430 - DNA, 38 bp, Artificial Sequence
  Synthetic oligonucleotide
tcccgaccacgtttatccctatgccatcgccctcgtga

SEQ ID NO: 13431 - DNA, 38 bp, Artificial Sequence
  Synthetic oligonucleotide
aatccgccgaccgctctcttcgtaatgttcctggttga

SEQ ID NO: 13432 - DNA, 36 bp, Artificial Sequence
  Synthetic oligonucleotide
acgcctcgcccgccgttcatgtccccccacttacta

SEQ ID NO: 13433 - DNA, 35 bp, Artificial Sequence
  Synthetic oligonucleotide
tacaccatagtgatgctcgaccacacgctcctgcc

SEQ ID NO: 13434 - DNA, 35 bp, Artificial Sequence
  Synthetic oligonucleotide
ttcgccaggctcccgcaattgttccgcacgatatc

SEQ ID NO: 13435 - DNA, 34 bp, Artificial Sequence
  Synthetic oligonucleotide
acccctcaggccccacacatcgcttattcaacga

SEQ ID NO: 13436 - DNA, 37 bp, Artificial Sequence
  Synthetic oligonucleotide
atccccagccacagctttcctggcaccatcgtaggga

SEQ ID NO: 13437 - DNA, 35 bp, Artificial Sequence
  Synthetic oligonucleotide
gatcagctacgccctccgcgccctcatgctatatc

SEQ ID NO: 13438 - DNA, 37 bp, Artificial Sequence
  Synthetic oligonucleotide
gcgacacctcccccgccgctaacatcgcgttcctaga

SEQ ID NO: 13439 - DNA, 37 bp, Artificial Sequence
  Synthetic oligonucleotide
cctagcctccacgtgccttattgccctttcgcttgga

SEQ ID NO: 13440 - DNA, 35 bp, Artificial Sequence
  Synthetic oligonucleotide
gatctgctccgatcgccggctggccttaccccctc

SEQ ID NO: 13441 - DNA, 36 bp, Artificial Sequence
  Synthetic oligonucleotide
tctccccagagcaattgttatctacttgccacttga

SEQ ID NO: 13442 - DNA, 35 bp, Artificial Sequence
  Synthetic oligonucleotide
atgcctcatcctgcgattgctacacactgtcatac

SEQ ID NO: 13443 - DNA, 35 bp, Artificial Sequence
  Synthetic oligonucleotide
ttcaggccacacgagctagcacaaagccgaccaca

SEQ ID NO: 13444 - DNA, 36 bp, Artificial Sequence
  Synthetic oligonucleotide
tctgttcgcctccaagccctaagctacaacatgtta

SEQ ID NO: 13445 - DNA, 36 bp, Artificial Sequence
  Synthetic oligonucleotide
gacctccatcagctgcgatccttcgtggtcccttca

SEQ ID NO: 13446 - DNA, 35 bp, Artificial Sequence
  Synthetic oligonucleotide
ttatcaccgctcagataatctcctcgtttgcccac

SEQ ID NO: 13447 - DNA, 35 bp, Artificial Sequence
  Synthetic oligonucleotide
gtggccaccaatcacctgcatgacgtgaatcttcc

SEQ ID NO: 13448 - DNA, 35 bp, Artificial Sequence
  Synthetic oligonucleotide
tctagggcaaccgctgcatctcaacacctgatcct

SEQ ID NO: 13449 - DNA, 35 bp, Artificial Sequence
  Synthetic oligonucleotide
tgagcacgccgttctgcatttcgtggttttgttgt

SEQ ID NO: 13450 - DNA, 38 bp, Artificial Sequence
  Synthetic oligonucleotide
aaccgccgccatcgcatgcatactcataccaacgttta

SEQ ID NO: 13451 - DNA, 35 bp, Artificial Sequence
  Synthetic oligonucleotide
tgcaagtccaaattcatcgtccagaacctttgctc

SEQ ID NO: 13452 - DNA, 35 bp, Artificial Sequence
  Synthetic oligonucleotide
acccactttgcacacggcgtaaccatgcttcaccg

SEQ ID NO: 13453 - DNA, 35 bp, Artificial Sequence
  Synthetic oligonucleotide
atccgtgcccccgacccggttaacatccattgaga

SEQ ID NO: 13454 - DNA, 38 bp, Artificial Sequence
  Synthetic oligonucleotide
tgcccgtgctgcacgttacagttacccgatctacctga

SEQ ID NO: 13455 - DNA, 37 bp, Artificial Sequence
  Synthetic oligonucleotide
ttacgccaccacacatatgctttcttcgtacgattga

SEQ ID NO: 13456 - DNA, 35 bp, Artificial Sequence
  Synthetic oligonucleotide
tctcgcgtaccccggtgatcgggcacttataccac

SEQ ID NO: 13457 - DNA, 35 bp, Artificial Sequence
  Synthetic oligonucleotide
tgaacccacgaggtttttaaggttcaccctctctc

SEQ ID NO: 13458 - DNA, 36 bp, Artificial Sequence
  Synthetic oligonucleotide
tgacttgcgggcggaaaggcgtgaggagggcggcaa

SEQ ID NO: 13459 - DNA, 37 bp, Artificial Sequence
  Synthetic oligonucleotide
gccatccctgccaacatagtggtcgaattctttgcga

SEQ ID NO: 13460 - DNA, 37 bp, Artificial Sequence
  Synthetic oligonucleotide
ggggagacgtaggggctggggtcgggagggtgggtga

SEQ ID NO: 13461 - DNA, 35 bp, Artificial Sequence
  Synthetic oligonucleotide
gccaccatctacttgtgcttttggatcgctctctc

SEQ ID NO: 13462 - DNA, 35 bp, Artificial Sequence
  Synthetic oligonucleotide
tctcaacaagctgtgcgaattccactcctcccgat

SEQ ID NO: 13463 - DNA, 36 bp, Artificial Sequence
  Synthetic oligonucleotide
tatgcgtgacaggggggaggttgagggtgggagtaa

SEQ ID NO: 13464 - DNA, 36 bp, Artificial Sequence
  Synthetic oligonucleotide
ggactgccctcattcatctgccgccgtccactccca

SEQ ID NO: 13465 - DNA, 35 bp, Artificial Sequence
  Synthetic oligonucleotide
gttgacgcgtgtgcggcaccctggttcttttcgta

SEQ ID NO: 13466 - DNA, 35 bp, Artificial Sequence
  Synthetic oligonucleotide
attgccaatgtccacgcacattcattcccttgccc

SEQ ID NO: 13467 - DNA, 36 bp, Artificial Sequence
  Synthetic oligonucleotide
ttgcgcacgtgttgctcctccctctagcccgcctca

SEQ ID NO: 13468 - DNA, 36 bp, Artificial Sequence
  Synthetic oligonucleotide
aacacagaggtaatgaagggtaaggcaagggaggga

SEQ ID NO: 13469 - DNA, 38 bp, Artificial Sequence
  Synthetic oligonucleotide
gccaccgcccgcctcccaatgtccggacaacgccgtga

SEQ ID NO: 13470 - DNA, 35 bp, Artificial Sequence
  Synthetic oligonucleotide
tcgtgtcgtccgtcacttgccctcgatcgcaccta

SEQ ID NO: 13471 - DNA, 35 bp, Artificial Sequence
  Synthetic oligonucleotide
atccgccctcacgttctctttatgcccaaaacaac

SEQ ID NO: 13472 - DNA, 32 bp, Artificial Sequence
  Synthetic oligonucleotide
ggacgccgcatgaccctcctccacatcatcga

SEQ ID NO: 13473 - DNA, 36 bp, Artificial Sequence
  Synthetic oligonucleotide
gtccgggcggagggagagctaggggatggggggtga

SEQ ID NO: 13474 - DNA, 35 bp, Artificial Sequence
  Synthetic oligonucleotide
tcaatgacacaggaaataccgagccttcccaacac

SEQ ID NO: 13475 - DNA, 37 bp, Artificial Sequence
  Synthetic oligonucleotide
ttgcaaccgtctacccaccatgcccacgaatgctcga

SEQ ID NO: 13476 - DNA, 35 bp, Artificial Sequence
  Synthetic oligonucleotide
ttcaaaccctgctccccacgcccataacttacgcc

SEQ ID NO: 13477 - DNA, 35 bp, Artificial Sequence
  Synthetic oligonucleotide
atgaccgcgccttttgactttctatgattgctctc

SEQ ID NO: 13478 - DNA, 35 bp, Artificial Sequence
  Synthetic oligonucleotide
tccaccaccagttatcggccgttgtcactctcttc

SEQ ID NO: 13479 - DNA, 37 bp, Artificial Sequence
  Synthetic oligonucleotide
ggatcgcgggggggagtaggagagtgatcgggaggga

SEQ ID NO: 13480 - DNA, 38 bp, Artificial Sequence
  Synthetic oligonucleotide
agcgagatggacggggggtgaacggaatggcaaagtga

SEQ ID NO: 13481 - DNA, 35 bp, Artificial Sequence
  Synthetic oligonucleotide
acccgaacatccatctgtatcttgccatccactgc

SEQ ID NO: 13482 - DNA, 35 bp, Artificial Sequence
  Synthetic oligonucleotide
tgcacacatagcggcaacactagccccctcgttct

SEQ ID NO: 13483 - DNA, 35 bp, Artificial Sequence
  Synthetic oligonucleotide
gaccccggcgatcagaccctttgcctcttcttcga

SEQ ID NO: 13484 - DNA, 36 bp, Artificial Sequence
  Synthetic oligonucleotide
aattacgccacccctgttactgcactctctgtacca

SEQ ID NO: 13485 - DNA, 36 bp, Artificial Sequence
  Synthetic oligonucleotide
tgcatcgaacagccatctcgtacgaccacacacgca

SEQ ID NO: 13486 - DNA, 36 bp, Artificial Sequence
  Synthetic oligonucleotide
atgtgctggttcgggaggctggtggggggggacgga

SEQ ID NO: 13487 - DNA, 38 bp, Artificial Sequence
  Synthetic oligonucleotide
agtgccgcaggtagggtagggtaggaatatgggggtga

SEQ ID NO: 13488 - DNA, 36 bp, Artificial Sequence
  Synthetic oligonucleotide
aagcgcgcactcatgtccgaacaccccatcacgcta

SEQ ID NO: 13489 - DNA, 36 bp, Artificial Sequence
  Synthetic oligonucleotide
agaccaccccatcatgatacgggctaccatacctca

SEQ ID NO: 13490 - DNA, 38 bp, Artificial Sequence
  Synthetic oligonucleotide
agctggccctccgatcacctgcaaccgcctccatgtga

SEQ ID NO: 13491 - DNA, 35 bp, Artificial Sequence
  Synthetic oligonucleotide
gaagatcgcacatagttttacgccgccgcactttc

SEQ ID NO: 13492 - DNA, 36 bp, Artificial Sequence
  Synthetic oligonucleotide
tccaccgcgatgtatcttgcggccatgtcactccca

SEQ ID NO: 13493 - DNA, 38 bp, Artificial Sequence
  Synthetic oligonucleotide
gaggccaccccatttttgtcccgttagcccatctatga

SEQ ID NO: 13494 - DNA, 35 bp, Artificial Sequence
  Synthetic oligonucleotide
tgcttcaccccgtctcatgccgttttctcgcgtta

SEQ ID NO: 13495 - DNA, 35 bp, Artificial Sequence
  Synthetic oligonucleotide
aattcaccccccttgagtgccaagacctatgaaac

SEQ ID NO: 13496 - DNA, 35 bp, Artificial Sequence
  Synthetic oligonucleotide
gactctctccgtgcccaattttgtttattgccttc

SEQ ID NO: 13497 - DNA, 36 bp, Artificial Sequence
  Synthetic oligonucleotide
tcccaacttacgttggtttgtactacacccctgcca

SEQ ID NO: 13498 - DNA, 36 bp, Artificial Sequence
  Synthetic oligonucleotide
gcacgatcaacgggtcccgaagtctctccctgctca

SEQ ID NO: 13499 - DNA, 37 bp, Artificial Sequence
  Synthetic oligonucleotide
tacacctgtaccgacgaccccgaccgtctcctctcga

SEQ ID NO: 13500 - DNA, 37 bp, Artificial Sequence
  Synthetic oligonucleotide
gactcgcagtaaggggtcggaccacgaaggggaagga

SEQ ID NO: 13501 - DNA, 38 bp, Artificial Sequence
  Synthetic oligonucleotide
taacgccacagtacgccatgtaccatcttgttccttga

SEQ ID NO: 13502 - DNA, 36 bp, Artificial Sequence
  Synthetic oligonucleotide
aacccgcccctaacgaacaaatgggactccctttca

SEQ ID NO: 13503 - DNA, 34 bp, Artificial Sequence
  Synthetic oligonucleotide
gcccatcctcctgagctttcgcgtgacctgccga

SEQ ID NO: 13504 - DNA, 38 bp, Artificial Sequence
  Synthetic oligonucleotide
ttcagcctcccacacaaccccgcgaccacgttacgtga

SEQ ID NO: 13505 - DNA, 35 bp, Artificial Sequence
  Synthetic oligonucleotide
accacctcaccttggttctcccgcccgggaaactt

SEQ ID NO: 13506 - DNA, 36 bp, Artificial Sequence
  Synthetic oligonucleotide
gaggtgccccatgtcgcatttttacttcgattcacc

SEQ ID NO: 13507 - DNA, 35 bp, Artificial Sequence
  Synthetic oligonucleotide
accgcagttcctccgaatgactacttccacctatc

SEQ ID NO: 13508 - DNA, 35 bp, Artificial Sequence
  Synthetic oligonucleotide
tgtgttgccttccccaccctagttcgcgttactcc

SEQ ID NO: 13509 - DNA, 35 bp, Artificial Sequence
  Synthetic oligonucleotide
tgcgcctggccttctacttcgccccattctcattg

SEQ ID NO: 13510 - DNA, 36 bp, Artificial Sequence
  Synthetic oligonucleotide
tgtaggtcaggaaatgatctgccgcccctccatcca

SEQ ID NO: 13511 - DNA, 37 bp, Artificial Sequence
  Synthetic oligonucleotide
ttactcccgcccaatcccacgaccatcgccttcgcga

SEQ ID NO: 13512 - DNA, 35 bp, Artificial Sequence
  Synthetic oligonucleotide
gaacctgcgcctcgcgggcagagcacaccacccac

SEQ ID NO: 13513 - DNA, 35 bp, Artificial Sequence
  Synthetic oligonucleotide
tccgatcgttgcgccgcgcgatacgcccccaccca

SEQ ID NO: 13514 - DNA, 36 bp, Artificial Sequence
  Synthetic oligonucleotide
aacaccacacatgaggagagctgacctccgacttta

SEQ ID NO: 13515 - DNA, 35 bp, Artificial Sequence
  Synthetic oligonucleotide
ggttgccccacctcccaatacagacacctgatatt

SEQ ID NO: 13516 - DNA, 35 bp, Artificial Sequence
  Synthetic oligonucleotide
tcaccccccgagacgagttgtcttgggatctcttt

SEQ ID NO: 13517 - DNA, 35 bp, Artificial Sequence
  Synthetic oligonucleotide
acaatgatggacctcgtctgtaccgctccccctcg

SEQ ID NO: 13518 - DNA, 36 bp, Artificial Sequence
  Synthetic oligonucleotide
tgcaatcgccctgtccgctcatgtcacccttgggca

SEQ ID NO: 13519 - DNA, 35 bp, Artificial Sequence
  Synthetic oligonucleotide
tttacacgcctggttcccgctccgtttgctaatac

SEQ ID NO: 13520 - DNA, 37 bp, Artificial Sequence
  Synthetic oligonucleotide
gtctctgccccagcctgtcaatttacgatcctgaaga

SEQ ID NO: 13521 - DNA, 35 bp, Artificial Sequence
  Synthetic oligonucleotide
tgttgatctcagtccggttaacacacaccccacga

SEQ ID NO: 13522 - DNA, 37 bp, Artificial Sequence
  Synthetic oligonucleotide
gtgtcgctcagacctccccatttgcccaagatgccga

SEQ ID NO: 13523 - DNA, 38 bp, Artificial Sequence
  Synthetic oligonucleotide
tccactcgccgacgtacgcccggcaactttacttttga

SEQ ID NO: 13524 - DNA, 37 bp, Artificial Sequence
  Synthetic oligonucleotide
taaccccgcaagtgggcttctcatccaccgctcccga

SEQ ID NO: 13525 - DNA, 36 bp, Artificial Sequence
  Synthetic oligonucleotide
tcaccaccaccccacgcttaagacgtgctttgccaa

SEQ ID NO: 13526 - DNA, 36 bp, Artificial Sequence
  Synthetic oligonucleotide
tcacgtccaatctcggtgttcccccatctagtccga

SEQ ID NO: 13527 - DNA, 35 bp, Artificial Sequence
  Synthetic oligonucleotide
acatgcctcgtgcattataagacctaccctttcag

SEQ ID NO: 13528 - DNA, 35 bp, Artificial Sequence
  Synthetic oligonucleotide
gaaacgaggagtcaagggactaaagggaaagaggt

SEQ ID NO: 13529 - DNA, 35 bp, Artificial Sequence
  Synthetic oligonucleotide
gatccacgctccccatcgcccagtatagacgttgt

SEQ ID NO: 13530 - DNA, 33 bp, Artificial Sequence
  Synthetic oligonucleotide
gcgaactccccgctggttttggttcttttggtt

SEQ ID NO: 13531 - DNA, 36 bp, Artificial Sequence
  Synthetic oligonucleotide
gtcctagcgttcacaccgccgctaaccatgttccaa

SEQ ID NO: 13532 - DNA, 36 bp, Artificial Sequence
  Synthetic oligonucleotide
accaccgaaccccgcgttgacactttagctgcccta

SEQ ID NO: 13533 - DNA, 35 bp, Artificial Sequence
  Synthetic oligonucleotide
agtgaggaaagaacggacgggtggggaggactagg

SEQ ID NO: 13534 - DNA, 35 bp, Artificial Sequence
  Synthetic oligonucleotide
accacgtttctcgctcctccccctcgatgtgctgg

SEQ ID NO: 13535 - DNA, 36 bp, Artificial Sequence
  Synthetic oligonucleotide
gagcccagccgcctcctttgtctccggaagttgcaa

SEQ ID NO: 13536 - DNA, 35 bp, Artificial Sequence
  Synthetic oligonucleotide
tactacgtccagccttgaccacctcaactcctcag

SEQ ID NO: 13537 - DNA, 37 bp, Artificial Sequence
  Synthetic oligonucleotide
ggaaacactcgtaaggggggtggggcgggatagagga

SEQ ID NO: 13538 - DNA, 36 bp, Artificial Sequence
  Synthetic oligonucleotide
tcctcccacttgacccctttttatgacagtttcata

SEQ ID NO: 13539 - DNA, 35 bp, Artificial Sequence
  Synthetic oligonucleotide
acagccggcaacatcacacgtacttcatttgttac

SEQ ID NO: 13540 - DNA, 35 bp, Artificial Sequence
  Synthetic oligonucleotide
ttcgcaacctatcgttttaagcaccctctctatcg

SEQ ID NO: 13541 - DNA, 36 bp, Artificial Sequence
  Synthetic oligonucleotide
tagctcccaccgcagctacgggttctccaccaacca

SEQ ID NO: 13542 - DNA, 36 bp, Artificial Sequence
  Synthetic oligonucleotide
gacgaccctggtggagccgttccctgtactaccgca

SEQ ID NO: 13543 - DNA, 37 bp, Artificial Sequence
  Synthetic oligonucleotide
ttagacgtatgggggggggaaggggcattttgggtga

SEQ ID NO: 13544 - DNA, 35 bp, Artificial Sequence
  Synthetic oligonucleotide
acatcctccagcagtctctatctcgctcccagggc

SEQ ID NO: 13545 - DNA, 35 bp, Artificial Sequence
  Synthetic oligonucleotide
gccccatccgtccggttccatcttaaactcattag

SEQ ID NO: 13546 - DNA, 35 bp, Artificial Sequence
  Synthetic oligonucleotide
gtcgtggccccctcctacgtcccttctgaactact

SEQ ID NO: 13547 - DNA, 36 bp, Artificial Sequence
  Synthetic oligonucleotide
gatcggggtaaggtggggtagggtatgggctataaa

SEQ ID NO: 13548 - DNA, 35 bp, Artificial Sequence
  Synthetic oligonucleotide
gccgacctccttccctttgatcgatctgttaggaa

SEQ ID NO: 13549 - DNA, 36 bp, Artificial Sequence
  Synthetic oligonucleotide
atccccgtggctggacgcgtatgcccctattcctta

SEQ ID NO: 13550 - DNA, 35 bp, Artificial Sequence
  Synthetic oligonucleotide
gcgaagggtcatctgatttaccgcgtcgccctctc

SEQ ID NO: 13551 - DNA, 35 bp, Artificial Sequence
  Synthetic oligonucleotide
tgcacgtccacgcctactttgtactcacacccctt

SEQ ID NO: 13552 - DNA, 36 bp, Artificial Sequence
  Synthetic oligonucleotide
gtcgcataggggggataccggggtagggcatgtgaa

SEQ ID NO: 13553 - DNA, 36 bp, Artificial Sequence
  Synthetic oligonucleotide
agaccccttccaccactcgcacgtcctactgctcga

SEQ ID NO: 13554 - DNA, 36 bp, Artificial Sequence
  Synthetic oligonucleotide
caccccctgcagccaccctttgcgctcctactctga

SEQ ID NO: 13555 - DNA, 36 bp, Artificial Sequence
  Synthetic oligonucleotide
acctgggcgggtgggaagatgggtaccacccaaata

SEQ ID NO: 13556 - DNA, 35 bp, Artificial Sequence
  Synthetic oligonucleotide
gctgaccacccgggcgcccatgactttcctcgacc

SEQ ID NO: 13557 - DNA, 37 bp, Artificial Sequence
  Synthetic oligonucleotide
agagggggaggggtgccattacgagggatccgcggga

SEQ ID NO: 13558 - DNA, 35 bp, Artificial Sequence
  Synthetic oligonucleotide
gcacgcccgagtcgcttctgttaacctcctctacg

SEQ ID NO: 13559 - DNA, 36 bp, Artificial Sequence
  Synthetic oligonucleotide
gcccagcatgccccccatacgtgccccttcagccca

SEQ ID NO: 13560 - DNA, 36 bp, Artificial Sequence
  Synthetic oligonucleotide
agatggaggggaacggagattagagaagggaggtaa

SEQ ID NO: 13561 - DNA, 37 bp, Artificial Sequence
  Synthetic oligonucleotide
atcatctgcccccctagcgcctgctccgtatcatgga

SEQ ID NO: 13562 - DNA, 38 bp, Artificial Sequence
  Synthetic oligonucleotide
atccccatcgcccaatggtaaacacgttctacccatga

SEQ ID NO: 13563 - DNA, 37 bp, Artificial Sequence
  Synthetic oligonucleotide
tcgaacaggtgggggctggagcgaagaggggaaggga

SEQ ID NO: 13564 - DNA, 35 bp, Artificial Sequence
  Synthetic oligonucleotide
gtgccatatcaacctgtctctgaagacccctgcta

SEQ ID NO: 13565 - DNA, 35 bp, Artificial Sequence
  Synthetic oligonucleotide
gtcatggggacttgggggggtggtcgggagtaatg

SEQ ID NO: 13566 - DNA, 38 bp, Artificial Sequence
  Synthetic oligonucleotide
tgaacccttcccctgtgatcctagggcatatttgccga

SEQ ID NO: 13567 - DNA, 35 bp, Artificial Sequence
  Synthetic oligonucleotide
tgccccatcccgcctcacagcgatccactggtaat

SEQ ID NO: 13568 - DNA, 35 bp, Artificial Sequence
  Synthetic oligonucleotide
tcccatccgcatgttccatgcgccatttgatctct

SEQ ID NO: 13569 - DNA, 36 bp, Artificial Sequence
  Synthetic oligonucleotide
atcatcgctgtgcgcctgtccaatcccggtcctgca

SEQ ID NO: 13570 - DNA, 37 bp, Artificial Sequence
  Synthetic oligonucleotide
tgctccactcggttctttgcttactatcgtttcccga

SEQ ID NO: 13571 - DNA, 38 bp, Artificial Sequence
  Synthetic oligonucleotide
atgtggagggtatggtggagggagctgggaataattga

SEQ ID NO: 13572 - DNA, 35 bp, Artificial Sequence
  Synthetic oligonucleotide
tacacctgcgcacactcgtgctactcaatccatcc

SEQ ID NO: 13573 - DNA, 35 bp, Artificial Sequence
  Synthetic oligonucleotide
aactccgtcaccacggcattcgaattacgccctcc

SEQ ID NO: 13574 - DNA, 35 bp, Artificial Sequence
  Synthetic oligonucleotide
aacgcggtacttgtgcttctttccccccgacctgt

SEQ ID NO: 13575 - DNA, 35 bp, Artificial Sequence
  Synthetic oligonucleotide
aggtaagggaagggggggaggatgattcgcaaaag

SEQ ID NO: 13576 - DNA, 36 bp, Artificial Sequence
  Synthetic oligonucleotide
gcccaacgtgggcctggttactcttgacgcttataa

SEQ ID NO: 13577 - DNA, 35 bp, Artificial Sequence
  Synthetic oligonucleotide
gtctcgccaacgacccggtccaacttcccagcaac

SEQ ID NO: 13578 - DNA, 35 bp, Artificial Sequence
  Synthetic oligonucleotide
gatcgcacatcgggacgacgatctatcaatccacc

SEQ ID NO: 13579 - DNA, 35 bp, Artificial Sequence
  Synthetic oligonucleotide
aattcatcctgccgccctcgatcactggccatacc

SEQ ID NO: 13580 - DNA, 36 bp, Artificial Sequence
  Synthetic oligonucleotide
acacatggcccatccagcagtctttgcctgccgaaa

SEQ ID NO: 13581 - DNA, 36 bp, Artificial Sequence
  Synthetic oligonucleotide
ggacgccgccatcattatcctggtttccgtacctga

SEQ ID NO: 13582 - DNA, 35 bp, Artificial Sequence
  Synthetic oligonucleotide
actcaccacgtacagccccagataactgtaccatc

SEQ ID NO: 13583 - DNA, 35 bp, Artificial Sequence
  Synthetic oligonucleotide
aagtaaaaggtgagggatggcgggatagaggacag

SEQ ID NO: 13584 - DNA, 35 bp, Artificial Sequence
  Synthetic oligonucleotide
tatcgcccaggcctaactgtctggttaaactcact

SEQ ID NO: 13585 - DNA, 36 bp, Artificial Sequence
  Synthetic oligonucleotide
atcgcggaccgcgctgtaatttcctatgtctccaca

SEQ ID NO: 13586 - DNA, 35 bp, Artificial Sequence
  Synthetic oligonucleotide
tttgcgcccgtacacactacacctttaaggctcca

SEQ ID NO: 13587 - DNA, 37 bp, Artificial Sequence
  Synthetic oligonucleotide
acccaccacagcttgtgccgtgttatgcttttcctga

SEQ ID NO: 13588 - DNA, 35 bp, Artificial Sequence
  Synthetic oligonucleotide
gcaatggcctcccagtcgtactaccattatcttac

SEQ ID NO: 13589 - DNA, 35 bp, Artificial Sequence
  Synthetic oligonucleotide
aactcactgccaaatggaaatggcccagttccccc

SEQ ID NO: 13590 - DNA, 35 bp, Artificial Sequence
  Synthetic oligonucleotide
gtcgcccttacttcagttcttgcccccaacacgtg

SEQ ID NO: 13591 - DNA, 36 bp, Artificial Sequence
  Synthetic oligonucleotide
accgctcctccgcgactgctcctcgggctaacctca

SEQ ID NO: 13592 - DNA, 36 bp, Artificial Sequence
  Synthetic oligonucleotide
attcgcgccagcagctgacgttcaccgcacctcaca

SEQ ID NO: 13593 - DNA, 35 bp, Artificial Sequence
  Synthetic oligonucleotide
agccgggggggtgggctgaagttagtagatgggca

SEQ ID NO: 13594 - DNA, 38 bp, Artificial Sequence
  Synthetic oligonucleotide
ttgccaccccgcgcactttcattgccttacctgcttga

SEQ ID NO: 13595 - DNA, 35 bp, Artificial Sequence
  Synthetic oligonucleotide
gcctactgcccggcgagtaaactacgccttctctc

SEQ ID NO: 13596 - DNA, 35 bp, Artificial Sequence
  Synthetic oligonucleotide
accccaatcgttgtagttcatcgtcgcttttcctt

SEQ ID NO: 13597 - DNA, 37 bp, Artificial Sequence
  Synthetic oligonucleotide
aaccatctcgcatctgattctgttagtttcagtgaga

SEQ ID NO: 13598 - DNA, 35 bp, Artificial Sequence
  Synthetic oligonucleotide
gattagcctctatccgtcgttgccaacccttgtac

SEQ ID NO: 13599 - DNA, 35 bp, Artificial Sequence
  Synthetic oligonucleotide
gtgaacgcctcgccctgctcctttacaccctatcc

SEQ ID NO: 13600 - DNA, 35 bp, Artificial Sequence
  Synthetic oligonucleotide
gtgtagtgggagggaggaggcggggtgagatggaa

SEQ ID NO: 13601 - DNA, 37 bp, Artificial Sequence
  Synthetic oligonucleotide
tgacaacggccgtgggtgttgtcaacgttaaggatga

SEQ ID NO: 13602 - DNA, 36 bp, Artificial Sequence
  Synthetic oligonucleotide
gctgagctcctgacactcgttgttgactctccctta

SEQ ID NO: 13603 - DNA, 36 bp, Artificial Sequence
  Synthetic oligonucleotide
gttgccactcccgtgtctatccttatccaactttta

SEQ ID NO: 13604 - DNA, 35 bp, Artificial Sequence
  Synthetic oligonucleotide
tctcatgccggctttcttaatgcttcggttctttc

SEQ ID NO: 13605 - DNA, 35 bp, Artificial Sequence
  Synthetic oligonucleotide
gcgccggcaacagacccatccatcgttcccattac

SEQ ID NO: 13606 - DNA, 35 bp, Artificial Sequence
  Synthetic oligonucleotide
gagtggtggaatgggaaggtggcccaggcggaagg

SEQ ID NO: 13607 - DNA, 35 bp, Artificial Sequence
  Synthetic oligonucleotide
ttactgccgccagtccaacggtactcgaactctgt

SEQ ID NO: 13608 - DNA, 36 bp, Artificial Sequence
  Synthetic oligonucleotide
atgcaccacctcgtagcctgtaacacgctgttttta

SEQ ID NO: 13609 - DNA, 35 bp, Artificial Sequence
  Synthetic oligonucleotide
tttgtagtctcacatcgtccgcctgccctgtcctc

SEQ ID NO: 13610 - DNA, 38 bp, Artificial Sequence
  Synthetic oligonucleotide
aaaccccgcccacaatcagctaaagccacagtgcatga

SEQ ID NO: 13611 - DNA, 38 bp, Artificial Sequence
  Synthetic oligonucleotide
tggggacgctccatttggcattaggtttttttttttga

SEQ ID NO: 13612 - DNA, 35 bp, Artificial Sequence
  Synthetic oligonucleotide
gatctccccccgcacatccccgtatctcctgctcg

SEQ ID NO: 13613 - DNA, 35 bp, Artificial Sequence
  Synthetic oligonucleotide
ttaccttctcctgcctcaccggtatctgtattggt

SEQ ID NO: 13614 - DNA, 37 bp, Artificial Sequence
  Synthetic oligonucleotide
ttggggcaacacgcgagacggagggtgggaggggaga

SEQ ID NO: 13615 - DNA, 35 bp, Artificial Sequence
  Synthetic oligonucleotide
acaccgactaccacatgggccccaccatccacgga

SEQ ID NO: 13616 - DNA, 38 bp, Artificial Sequence
  Synthetic oligonucleotide
aagagtgggagggggatgagccgtaggccgcatgggga

SEQ ID NO: 13617 - DNA, 38 bp, Artificial Sequence
  Synthetic oligonucleotide
tccatcgtggcacccacactcctggcaaacgccactga

SEQ ID NO: 13618 - DNA, 38 bp, Artificial Sequence
  Synthetic oligonucleotide
tcctccccgccgacctagtaatagacctgccgcactga

SEQ ID NO: 13619 - DNA, 38 bp, Artificial Sequence
  Synthetic oligonucleotide
gtctactgccactgcactccgcacgacccatcccgtga

SEQ ID NO: 13620 - DNA, 35 bp, Artificial Sequence
  Synthetic oligonucleotide
gacgacgacagtcgattttatcattcttctgctat

SEQ ID NO: 13621 - DNA, 36 bp, Artificial Sequence
  Synthetic oligonucleotide
tcatcgcaagaacgcagctacgcatccgggcccctt

SEQ ID NO: 13622 - DNA, 36 bp, Artificial Sequence
  Synthetic oligonucleotide
gtagccacaaaccgtcatgaccgagtccctatgcca

SEQ ID NO: 13623 - DNA, 38 bp, Artificial Sequence
  Synthetic oligonucleotide
ttcagccccaacatctcggtcaaatcgacgcactctga

SEQ ID NO: 13624 - DNA, 35 bp, Artificial Sequence
  Synthetic oligonucleotide
actcgtaccggcgagagggaccaccgccaccatac

SEQ ID NO: 13625 - DNA, 35 bp, Artificial Sequence
  Synthetic oligonucleotide
gtggtggcccgacccctcgccttgcttctaactgc

SEQ ID NO: 13626 - DNA, 35 bp, Artificial Sequence
  Synthetic oligonucleotide
gtctcaccaccggcattcgcctcgtacttcgtttc

SEQ ID NO: 13627 - DNA, 35 bp, Artificial Sequence
  Synthetic oligonucleotide
tgtgtgggagatgtactgcgtgggtgaatgggggg

SEQ ID NO: 13628 - DNA, 35 bp, Artificial Sequence
  Synthetic oligonucleotide
tcaccaccgcaacccccgtaactgtaatttacctt

SEQ ID NO: 13629 - DNA, 36 bp, Artificial Sequence
  Synthetic oligonucleotide
tccgcgcgggtccgggacggggaggggaaagcgaaa

SEQ ID NO: 13630 - DNA, 37 bp, Artificial Sequence
  Synthetic oligonucleotide
acgaccaagtggtccaggaggggttcgggaggggaga

SEQ ID NO: 13631 - DNA, 35 bp, Artificial Sequence
  Synthetic oligonucleotide
gcatcaccattggctcacgtccgtttctacccgcg

SEQ ID NO: 13632 - DNA, 35 bp, Artificial Sequence
  Synthetic oligonucleotide
gcccatgacaactcgaaaccgcctacgagcgaatt

SEQ ID NO: 13633 - DNA, 37 bp, Artificial Sequence
  Synthetic oligonucleotide
accacaaacacccgcccatctgtagcctgcctactga

SEQ ID NO: 13634 - DNA, 35 bp, Artificial Sequence
  Synthetic oligonucleotide
acgcccctatcgcgcatatgctgcacccttccaac

SEQ ID NO: 13635 - DNA, 35 bp, Artificial Sequence
  Synthetic oligonucleotide
tccgccactttctcgatggttgcccgttgaatcac

SEQ ID NO: 13636 - DNA, 34 bp, Artificial Sequence
  Synthetic oligonucleotide
tgaacacccggccgatcgaacttcacctcaaacc

SEQ ID NO: 13637 - DNA, 36 bp, Artificial Sequence
  Synthetic oligonucleotide
tccccaccaacacatgccacctaaacttctgataga

SEQ ID NO: 13638 - DNA, 37 bp, Artificial Sequence
  Synthetic oligonucleotide
gcatgtcaaactcctgcccggcctgctccaatctaga

SEQ ID NO: 13639 - DNA, 35 bp, Artificial Sequence
  Synthetic oligonucleotide
gaggatgggttagggggcggatagtgctgaattgg

SEQ ID NO: 13640 - DNA, 36 bp, Artificial Sequence
  Synthetic oligonucleotide
gacaccctaaatggtaatcctcatgtttcgctctca

SEQ ID NO: 13641 - DNA, 37 bp, Artificial Sequence
  Synthetic oligonucleotide
acctcaccatcacacccatgcgatacacactgagaga

SEQ ID NO: 13642 - DNA, 37 bp, Artificial Sequence
  Synthetic oligonucleotide
ggagcctctgcctcctttgttcatccgtggttaccga

SEQ ID NO: 13643 - DNA, 34 bp, Artificial Sequence
  Synthetic oligonucleotide
taggccatccttcgattttcttaatgcactctgc

SEQ ID NO: 13644 - DNA, 36 bp, Artificial Sequence
  Synthetic oligonucleotide
gtctcatgccacgagtgcacctaacaccattatcca

SEQ ID NO: 13645 - DNA, 37 bp, Artificial Sequence
  Synthetic oligonucleotide
gtaccaccgcgatcgttttgctgaccactccgctcga

SEQ ID NO: 13646 - DNA, 38 bp, Artificial Sequence
  Synthetic oligonucleotide
ttacatgcccagagcctccgcagcaatcactctcttga

SEQ ID NO: 13647 - DNA, 37 bp, Artificial Sequence
  Synthetic oligonucleotide
cataaggcgggtagggaggggtggggcgcgtgtttga

SEQ ID NO: 13648 - DNA, 35 bp, Artificial Sequence
  Synthetic oligonucleotide
tgctagactgcccgcgattcccacacaccgcctca

SEQ ID NO: 13649 - DNA, 35 bp, Artificial Sequence
  Synthetic oligonucleotide
acccatgtccactgcaaattctcgactcttgttct

SEQ ID NO: 13650 - DNA, 36 bp, Artificial Sequence
  Synthetic oligonucleotide
gccgagctgtctcgtcttagccactgtcgctcccaa

SEQ ID NO: 13651 - DNA, 35 bp, Artificial Sequence
  Synthetic oligonucleotide
tctccctgcttgggactttcagtataaagtcttca

SEQ ID NO: 13652 - DNA, 36 bp, Artificial Sequence
  Synthetic oligonucleotide
gtcacaccaccatgctacggagtccctgactaatga

SEQ ID NO: 13653 - DNA, 38 bp, Artificial Sequence
  Synthetic oligonucleotide
gcaacgcacgtcgtgatcccacccggcatctgccttga

SEQ ID NO: 13654 - DNA, 35 bp, Artificial Sequence
  Synthetic oligonucleotide
gcgcggtccgctgctcgcgtgctacctttaccctc

SEQ ID NO: 13655 - DNA, 35 bp, Artificial Sequence
  Synthetic oligonucleotide
ttaggccgaactcccatcttattacgtacatgttt

SEQ ID NO: 13656 - DNA, 35 bp, Artificial Sequence
  Synthetic oligonucleotide
taagcgctcctccggtctctccacctttggctctg

SEQ ID NO: 13657 - DNA, 35 bp, Artificial Sequence
  Synthetic oligonucleotide
ttgccaccaacgggtggtttcttttccaatgatct

SEQ ID NO: 13658 - DNA, 36 bp, Artificial Sequence
  Synthetic oligonucleotide
tcctgcgcccttccatgtctttggcctgacactaca

SEQ ID NO: 13659 - DNA, 38 bp, Artificial Sequence
  Synthetic oligonucleotide
atcgggggggagagggccgagaacacaggggagactga

SEQ ID NO: 13660 - DNA, 38 bp, Artificial Sequence
  Synthetic oligonucleotide
tgcgctccatccatctcagctctatctcatgtctgtga

SEQ ID NO: 13661 - DNA, 38 bp, Artificial Sequence
  Synthetic oligonucleotide
tccgtcgggagccctccgtttcttcctgcactgcttga

SEQ ID NO: 13662 - DNA, 35 bp, Artificial Sequence
  Synthetic oligonucleotide
tgactcggcccctgcctcctatcccattgtacgta

SEQ ID NO: 13663 - DNA, 35 bp, Artificial Sequence
  Synthetic oligonucleotide
gcaacgctgacaatattatcttgtgttcccccgtt

SEQ ID NO: 13664 - DNA, 35 bp, Artificial Sequence
  Synthetic oligonucleotide
gacacctatctgttcgcacccttaaggttgtccca

SEQ ID NO: 13665 - DNA, 37 bp, Artificial Sequence
  Synthetic oligonucleotide
tcacacctcttgcgtttagcttgccgcttacctacga

SEQ ID NO: 13666 - DNA, 35 bp, Artificial Sequence
  Synthetic oligonucleotide
accctcaactcgacgtgctgttgcttttcatggcc

SEQ ID NO: 13667 - DNA, 35 bp, Artificial Sequence
  Synthetic oligonucleotide
gacagaccctgttttaccccacgtgagtggctcct

SEQ ID NO: 13668 - DNA, 36 bp, Artificial Sequence
  Synthetic oligonucleotide
gtgtaccctgcgcccaatccccagcgaacagtccca

SEQ ID NO: 13669 - DNA, 38 bp, Artificial Sequence
  Synthetic oligonucleotide
gatccccgacctgtacgctaggtcctacaataccttga

SEQ ID NO: 13670 - DNA, 35 bp, Artificial Sequence
  Synthetic oligonucleotide
atcgccattactgtgttcgcctccacttatttttg

SEQ ID NO: 13671 - DNA, 35 bp, Artificial Sequence
  Synthetic oligonucleotide
atccgcacgcattgctccgttgcgaaacctaacca

SEQ ID NO: 13672 - DNA, 36 bp, Artificial Sequence
  Synthetic oligonucleotide
agacattcgacggactgccgctttttcttcccccca

SEQ ID NO: 13673 - DNA, 36 bp, Artificial Sequence
  Synthetic oligonucleotide
ttcatccccatatgtcaggaacatctttcgcactga

SEQ ID NO: 13674 - DNA, 35 bp, Artificial Sequence
  Synthetic oligonucleotide
tctcagtagcagctacactctatacaatgcctctc

SEQ ID NO: 13675 - DNA, 35 bp, Artificial Sequence
  Synthetic oligonucleotide
gtcacagtccgttacaataaaccgacccatgtttc

SEQ ID NO: 13676 - DNA, 35 bp, Artificial Sequence
  Synthetic oligonucleotide
gccgaatgctctccggccgaactattggtctccct

SEQ ID NO: 13677 - DNA, 36 bp, Artificial Sequence
  Synthetic oligonucleotide
gatccatggtccctggttttgcaacactaccctgaa

SEQ ID NO: 13678 - DNA, 35 bp, Artificial Sequence
  Synthetic oligonucleotide
agccatagccacacgtactaccgtgtccacctcga

SEQ ID NO: 13679 - DNA, 35 bp, Artificial Sequence
  Synthetic oligonucleotide
gtacaagtgctggccgtgggtgggctgggtgtttt

SEQ ID NO: 13680 - DNA, 36 bp, Artificial Sequence
  Synthetic oligonucleotide
tgccaagccccgcgaggattctgcattcccccatca

SEQ ID NO: 13681 - DNA, 38 bp, Artificial Sequence
  Synthetic oligonucleotide
tatccgcgctattgccctcaccacacgtactccgctga

SEQ ID NO: 13682 - DNA, 35 bp, Artificial Sequence
  Synthetic oligonucleotide
tccactcactggtgcttgacttaacatgctgacct

SEQ ID NO: 13683 - DNA, 35 bp, Artificial Sequence
  Synthetic oligonucleotide
tcttgccactccgccctttacgaccaggccatctt

SEQ ID NO: 13684 - DNA, 35 bp, Artificial Sequence
  Synthetic oligonucleotide
gtgaggaggggggactagggtagaggtatgaagtt

SEQ ID NO: 13685 - DNA, 35 bp, Artificial Sequence
  Synthetic oligonucleotide
tacgcctatcgccgccgcttgtgcttccctatgac

SEQ ID NO: 13686 - DNA, 35 bp, Artificial Sequence
  Synthetic oligonucleotide
atgcacatagcgttcatccgggccaatccactacc

SEQ ID NO: 13687 - DNA, 35 bp, Artificial Sequence
  Synthetic oligonucleotide
atcacctccgaggccctttcagcgcaataccttct

SEQ ID NO: 13688 - DNA, 37 bp, Artificial Sequence
  Synthetic oligonucleotide
ggatcctacgcccccactctgcatttgcctttgacga

SEQ ID NO: 13689 - DNA, 36 bp, Artificial Sequence
  Synthetic oligonucleotide
gactcacacgcacatttccgaggacgtctacaccga

SEQ ID NO: 13690 - DNA, 35 bp, Artificial Sequence
  Synthetic oligonucleotide
atgtgacgatccgcccgcgctctactttacactac

SEQ ID NO: 13691 - DNA, 35 bp, Artificial Sequence
  Synthetic oligonucleotide
gcgaatcgcctcttcacaatacgcacacgcttttc

SEQ ID NO: 13692 - DNA, 36 bp, Artificial Sequence
  Synthetic oligonucleotide
tatttaccgcatctttgccgcccttattgggttcca

SEQ ID NO: 13693 - DNA, 38 bp, Artificial Sequence
  Synthetic oligonucleotide
tctcgacaactgtttgttaccgctcctgtacctcgtga

SEQ ID NO: 13694 - DNA, 35 bp, Artificial Sequence
  Synthetic oligonucleotide
tcattcctcgcaccagccgtatcttagtccgtggc

SEQ ID NO: 13695 - DNA, 35 bp, Artificial Sequence
  Synthetic oligonucleotide
ttatgcccctatcactgccgcagcctggagcaatc

SEQ ID NO: 13696 - DNA, 35 bp, Artificial Sequence
  Synthetic oligonucleotide
tccactcagccccgcctcctggattcttttccaag

SEQ ID NO: 13697 - DNA, 38 bp, Artificial Sequence
  Synthetic oligonucleotide
tcacagtcgcacataagcactcgtttccttgcacctga

SEQ ID NO: 13698 - DNA, 38 bp, Artificial Sequence
  Synthetic oligonucleotide
tgccccactaatgcacactcttttcttgctgtccgtga

SEQ ID NO: 13699 - DNA, 35 bp, Artificial Sequence
  Synthetic oligonucleotide
acatgccgagctagctacaccgtttcctgccacga

SEQ ID NO: 13700 - DNA, 36 bp, Artificial Sequence
  Synthetic oligonucleotide
aatcctcaccacatcattacacagtctattccaaga

SEQ ID NO: 13701 - DNA, 35 bp, Artificial Sequence
  Synthetic oligonucleotide
acgaatccaccatgcgccacatcttgcatatcggt

SEQ ID NO: 13702 - DNA, 36 bp, Artificial Sequence
  Synthetic oligonucleotide
gtcggatgccttccgcctagtacttctttgcaccca

SEQ ID NO: 13703 - DNA, 37 bp, Artificial Sequence
  Synthetic oligonucleotide
aggacggtaggacggggcattagggtgggaaatcaga

SEQ ID NO: 13704 - DNA, 38 bp, Artificial Sequence
  Synthetic oligonucleotide
gtcacaccgtcgctcttccgccactcccttgctagtga

SEQ ID NO: 13705 - DNA, 35 bp, Artificial Sequence
  Synthetic oligonucleotide
gcaagctccccccttcactcctgccattcctttcg

SEQ ID NO: 13706 - DNA, 36 bp, Artificial Sequence
  Synthetic oligonucleotide
gaccactacccgcacttgacgacgaaccagttgaga

SEQ ID NO: 13707 - DNA, 36 bp, Artificial Sequence
  Synthetic oligonucleotide
aagcgcggtgggaacggggaggaaagggcaaaacta

SEQ ID NO: 13708 - DNA, 35 bp, Artificial Sequence
  Synthetic oligonucleotide
gtccctgcccttatcttacagagatttctcgtttc

SEQ ID NO: 13709 - DNA, 36 bp, Artificial Sequence
  Synthetic oligonucleotide
gcgcgccacacatcctctgcacctcatgatacctca

SEQ ID NO: 13710 - DNA, 37 bp, Artificial Sequence
  Synthetic oligonucleotide
acgcaccctccacctcttcgttcccaatgtattggga

SEQ ID NO: 13711 - DNA, 38 bp, Artificial Sequence
  Synthetic oligonucleotide
gaacccctcatttgttttcgtgcccaatgttgacctga

SEQ ID NO: 13712 - DNA, 35 bp, Artificial Sequence
  Synthetic oligonucleotide
tgcctgcccctctgaggatccctcgttgcctctac

SEQ ID NO: 13713 - DNA, 35 bp, Artificial Sequence
  Synthetic oligonucleotide
tatgccaccattgtcgtattgtttttttgtttgcg

SEQ ID NO: 13714 - DNA, 37 bp, Artificial Sequence
  Synthetic oligonucleotide
gagaaagacgaagtaggggtaaggctggcggggcgga

SEQ ID NO: 13715 - DNA, 37 bp, Artificial Sequence
  Synthetic oligonucleotide
accaccgcccgctgctatcaccctcgtctttccctga

SEQ ID NO: 13716 - DNA, 35 bp, Artificial Sequence
  Synthetic oligonucleotide
gatacgccggtgctttcccgtgattctttacactc

SEQ ID NO: 13717 - DNA, 35 bp, Artificial Sequence
  Synthetic oligonucleotide
accaatacctgcacactgtctcttatcgcccggtg

SEQ ID NO: 13718 - DNA, 35 bp, Artificial Sequence
  Synthetic oligonucleotide
tcacagcgcacggactttccttccacttgtcttca

SEQ ID NO: 13719 - DNA, 35 bp, Artificial Sequence
  Synthetic oligonucleotide
gtccgccgcccacacaccttgtaaacagtcgaccc

SEQ ID NO: 13720 - DNA, 35 bp, Artificial Sequence
  Synthetic oligonucleotide
tttaccacctcagcttttgcgcgaatatccatatc

SEQ ID NO: 13721 - DNA, 36 bp, Artificial Sequence
  Synthetic oligonucleotide
ttacactgcgccgcccccatgtttgcgtttcacgca

SEQ ID NO: 13722 - DNA, 35 bp, Artificial Sequence
  Synthetic oligonucleotide
tcgatcgcctacttgcacgtggactaccattttcc

SEQ ID NO: 13723 - DNA, 35 bp, Artificial Sequence
  Synthetic oligonucleotide
tgccagtgccgtttggccccaccccactcatggag

SEQ ID NO: 13724 - DNA, 37 bp, Artificial Sequence
  Synthetic oligonucleotide
taccatcgccgcattggctagctttactcttcattga

SEQ ID NO: 13725 - DNA, 38 bp, Artificial Sequence
  Synthetic oligonucleotide
ccgcacaatgcccggctacccatccgcacagtccttga

SEQ ID NO: 13726 - DNA, 37 bp, Artificial Sequence
  Synthetic oligonucleotide
gccactgaagtacctgcccatccgcccattagcccga

SEQ ID NO: 13727 - DNA, 37 bp, Artificial Sequence
  Synthetic oligonucleotide
tagtgaaggggatggcgtaatgggatccctggggtga

SEQ ID NO: 13728 - DNA, 38 bp, Artificial Sequence
  Synthetic oligonucleotide
accctggccccccccccagttctataggtactttgtga

SEQ ID NO: 13729 - DNA, 35 bp, Artificial Sequence
  Synthetic oligonucleotide
gtgaaggacgggagggtactcgggcgtgggtaata

SEQ ID NO: 13730 - DNA, 35 bp, Artificial Sequence
  Synthetic oligonucleotide
atcacgccgaatcgaagtcgtcccagcatacctta

SEQ ID NO: 13731 - DNA, 35 bp, Artificial Sequence
  Synthetic oligonucleotide
gacgacccccctgcccggtttagataatgaacacc

SEQ ID NO: 13732 - DNA, 35 bp, Artificial Sequence
  Synthetic oligonucleotide
gagacggaaaggcgagagcaaggggacggggatcg

SEQ ID NO: 13733 - DNA, 35 bp, Artificial Sequence
  Synthetic oligonucleotide
atgaaggcggccaccaaagcgctctgtcctccttt

SEQ ID NO: 13734 - DNA, 38 bp, Artificial Sequence
  Synthetic oligonucleotide
tccacccccacgtgcgatcatccagcccagggcactga

SEQ ID NO: 13735 - DNA, 35 bp, Artificial Sequence
  Synthetic oligonucleotide
tccaaacacgccacacatagcctctaacgcggccc

SEQ ID NO: 13736 - DNA, 34 bp, Artificial Sequence
  Synthetic oligonucleotide
tgtctcactgctagcctgttcacgtttccaaatc

SEQ ID NO: 13737 - DNA, 35 bp, Artificial Sequence
  Synthetic oligonucleotide
aacactgccgttgtctctatttccgtcgggttcct

SEQ ID NO: 13738 - DNA, 35 bp, Artificial Sequence
  Synthetic oligonucleotide
gacccaccgcccccccgctgttacacccctcaacc

SEQ ID NO: 13739 - DNA, 35 bp, Artificial Sequence
  Synthetic oligonucleotide
ttgccgattccctgcgatcctccttccgcctgctt

SEQ ID NO: 13740 - DNA, 36 bp, Artificial Sequence
  Synthetic oligonucleotide
tgccaccctcatacctgcactttcgggaggaccgaa

SEQ ID NO: 13741 - DNA, 37 bp, Artificial Sequence
  Synthetic oligonucleotide
tacccatgccactcacccttgttacgttcacctggga

SEQ ID NO: 13742 - DNA, 35 bp, Artificial Sequence
  Synthetic oligonucleotide
gcgctacgtccccggttatatcgcaccgttgccat

SEQ ID NO: 13743 - DNA, 35 bp, Artificial Sequence
  Synthetic oligonucleotide
atcatcacgacctagctgcctttctgtttacgttt

SEQ ID NO: 13744 - DNA, 36 bp, Artificial Sequence
  Synthetic oligonucleotide
atgactacgggatcgggtggggaaggggcgtgaaca

SEQ ID NO: 13745 - DNA, 37 bp, Artificial Sequence
  Synthetic oligonucleotide
agtgaacgagaaggaggggggagaagggcctgataga

SEQ ID NO: 13746 - DNA, 37 bp, Artificial Sequence
  Synthetic oligonucleotide
tcacccccgaccaatctcccatccgtgctaataagga

SEQ ID NO: 13747 - DNA, 35 bp, Artificial Sequence
  Synthetic oligonucleotide
tcctaggaccggggtgtcgtggctcctatttccat

SEQ ID NO: 13748 - DNA, 35 bp, Artificial Sequence
  Synthetic oligonucleotide
gaccacgtcgctcatcattctagacgcccgttgac

SEQ ID NO: 13749 - DNA, 35 bp, Artificial Sequence
  Synthetic oligonucleotide
gaacacaccttgcacacggtaatgacaatcttgcc

SEQ ID NO: 13750 - DNA, 36 bp, Artificial Sequence
  Synthetic oligonucleotide
gccccatgcccagcttttgccgccatcagccctgca

SEQ ID NO: 13751 - DNA, 35 bp, Artificial Sequence
  Synthetic oligonucleotide
gtcgtgggctgccattctgctttttggttctttcc

SEQ ID NO: 13752 - DNA, 37 bp, Artificial Sequence
  Synthetic oligonucleotide
tgctctggacccatgcgctgttacccacactgaacga

SEQ ID NO: 13753 - DNA, 35 bp, Artificial Sequence
  Synthetic oligonucleotide
gcaactgccgaggtccccattgttgcacttaatca

SEQ ID NO: 13754 - DNA, 35 bp, Artificial Sequence
  Synthetic oligonucleotide
ggagccgcgcaaataagtccgccctacacttcgcc

SEQ ID NO: 13755 - DNA, 35 bp, Artificial Sequence
  Synthetic oligonucleotide
tcgaaccaacgcggcacctcccggccaccaccaat

SEQ ID NO: 13756 - DNA, 35 bp, Artificial Sequence
  Synthetic oligonucleotide
aacacgagggggtggggggaagacggataacaggt

SEQ ID NO: 13757 - DNA, 34 bp, Artificial Sequence
  Synthetic oligonucleotide
tccccccccccggtgagatatgtcccttatgttt

SEQ ID NO: 13758 - DNA, 36 bp, Artificial Sequence
  Synthetic oligonucleotide
gccgacccgtaacccaagtcttctcccacagtttca

SEQ ID NO: 13759 - DNA, 37 bp, Artificial Sequence
  Synthetic oligonucleotide
acaccgtctggccgcatctactccccgctacactgga

SEQ ID NO: 13760 - DNA, 35 bp, Artificial Sequence
  Synthetic oligonucleotide
tcatccccccggagtgccactcactagacccccgc

SEQ ID NO: 13761 - DNA, 33 bp, Artificial Sequence
  Synthetic oligonucleotide
tcacttgcacacacctgtgccgtatctctgtct

SEQ ID NO: 13762 - DNA, 37 bp, Artificial Sequence
  Synthetic oligonucleotide
gccacaagccgggaccgtagagggagggtaattggga

SEQ ID NO: 13763 - DNA, 38 bp, Artificial Sequence
  Synthetic oligonucleotide
ggccactcgcctctgcccaatttgctcacacgccttga

SEQ ID NO: 13764 - DNA, 36 bp, Artificial Sequence
  Synthetic oligonucleotide
ttggacgccttattacgttggtttggttcgtttcca

SEQ ID NO: 13765 - DNA, 36 bp, Artificial Sequence
  Synthetic oligonucleotide
gccaaaccacctatatccatggcacagtaaattgca

SEQ ID NO: 13766 - DNA, 35 bp, Artificial Sequence
  Synthetic oligonucleotide
gctgtgctgtacacctctctttgatactgccctca

SEQ ID NO: 13767 - DNA, 35 bp, Artificial Sequence
  Synthetic oligonucleotide
tttccgacgccgtaccgtgcctcacgaacaccacc

SEQ ID NO: 13768 - DNA, 35 bp, Artificial Sequence
  Synthetic oligonucleotide
tcagcccactgcccccttacgatgcactccgcctt

SEQ ID NO: 13769 - DNA, 38 bp, Artificial Sequence
  Synthetic oligonucleotide
tcatgccactatcctgctactttcgagctcttccttga

SEQ ID NO: 13770 - DNA, 36 bp, Artificial Sequence
  Synthetic oligonucleotide
gatacacgacgcatctatctcgctcacacacttcaa

SEQ ID NO: 13771 - DNA, 36 bp, Artificial Sequence
  Synthetic oligonucleotide
accatcccgcggtacggttctaggtctttctaacca

SEQ ID NO: 13772 - DNA, 35 bp, Artificial Sequence
  Synthetic oligonucleotide
gataccacccttacagatcgtcgcggctcgcccca

SEQ ID NO: 13773 - DNA, 37 bp, Artificial Sequence
  Synthetic oligonucleotide
tccatccaccattagggcacagttcttcgctttgcga

SEQ ID NO: 13774 - DNA, 35 bp, Artificial Sequence
  Synthetic oligonucleotide
agacgcttgcacctctacatgctgaacactccatc

SEQ ID NO: 13775 - DNA, 35 bp, Artificial Sequence
  Synthetic oligonucleotide
gttcgctacatcgcccccgagaacacatgcttatc

SEQ ID NO: 13776 - DNA, 35 bp, Artificial Sequence
  Synthetic oligonucleotide
ttgagcccattgagtcacagtcccactgtccttgt

SEQ ID NO: 13777 - DNA, 37 bp, Artificial Sequence
  Synthetic oligonucleotide
gccacgactacgcggctctttccctggcctcccttga

SEQ ID NO: 13778 - DNA, 36 bp, Artificial Sequence
  Synthetic oligonucleotide
ttgcccccacaattgtagaatcctgctaccttacta

SEQ ID NO: 13779 - DNA, 36 bp, Artificial Sequence
  Synthetic oligonucleotide
gccggaagtacccctgcctcatatgccccacaagca

SEQ ID NO: 13780 - DNA, 35 bp, Artificial Sequence
  Synthetic oligonucleotide
gcatctccgcaggagttaccatcctcacatattca

SEQ ID NO: 13781 - DNA, 35 bp, Artificial Sequence
  Synthetic oligonucleotide
gttctggtcgccgcccgtgcttagttaccgcatcc

SEQ ID NO: 13782 - DNA, 35 bp, Artificial Sequence
  Synthetic oligonucleotide
gtcggtgccctcacccaccgttttgcaagtttctc

SEQ ID NO: 13783 - DNA, 35 bp, Artificial Sequence
  Synthetic oligonucleotide
gcaaacacctatcccacagcgagccgttacctggt

SEQ ID NO: 13784 - DNA, 35 bp, Artificial Sequence
  Synthetic oligonucleotide
gtcaaagcctcaatcccggttatgccacgcccgtc

SEQ ID NO: 13785 - DNA, 36 bp, Artificial Sequence
  Synthetic oligonucleotide
acgatgacccgtccgccttgcccaaatccgccccca

SEQ ID NO: 13786 - DNA, 35 bp, Artificial Sequence
  Synthetic oligonucleotide
atgcacgcactactcccgtatccttttgtcgctcg

SEQ ID NO: 13787 - DNA, 35 bp, Artificial Sequence
  Synthetic oligonucleotide
tgatacctcccaccaatctgagcacgactgcaact

SEQ ID NO: 13788 - DNA, 35 bp, Artificial Sequence
  Synthetic oligonucleotide
tatgcggaacagaacgctccattaccatccagtca

SEQ ID NO: 13789 - DNA, 37 bp, Artificial Sequence
  Synthetic oligonucleotide
ggataacccccgtgttttcatgaccctcctcccgtga

SEQ ID NO: 13790 - DNA, 35 bp, Artificial Sequence
  Synthetic oligonucleotide
tcactgtaacatctaatcgcgctggagtgccctcc

SEQ ID NO: 13791 - DNA, 35 bp, Artificial Sequence
  Synthetic oligonucleotide
aaatcctaccaccgcctctcatgctgtcgttcact

SEQ ID NO: 13792 - DNA, 36 bp, Artificial Sequence
  Synthetic oligonucleotide
acactccatcgccacatcccgaccgttcgccaaaga

SEQ ID NO: 13793 - DNA, 34 bp, Artificial Sequence
  Synthetic oligonucleotide
gcaaccgttgtccaggtcaactcgcctccattcg

SEQ ID NO: 13794 - DNA, 38 bp, Artificial Sequence
  Synthetic oligonucleotide
tctgtcaccagttaccatgatcacctgcactcccgtga

SEQ ID NO: 13795 - DNA, 35 bp, Artificial Sequence
  Synthetic oligonucleotide
acccctgccccctgatcagcacctcttcacggtac

SEQ ID NO: 13796 - DNA, 35 bp, Artificial Sequence
  Synthetic oligonucleotide
tgccatgagccgttgggcttctcagttcacgcctt

SEQ ID NO: 13797 - DNA, 35 bp, Artificial Sequence
  Synthetic oligonucleotide
attacgcactgactctacgccccttgttgcacccc

SEQ ID NO: 13798 - DNA, 36 bp, Artificial Sequence
  Synthetic oligonucleotide
tgcgacatcccctgctcgtgaacactaaatctgtaa

SEQ ID NO: 13799 - DNA, 35 bp, Artificial Sequence
  Synthetic oligonucleotide
gcaccactcatcgctcgtgcttttcagatctatca

SEQ ID NO: 13800 - DNA, 36 bp, Artificial Sequence
  Synthetic oligonucleotide
gtcacgaggcgctgactcgttttgttttggttccta

SEQ ID NO: 13801 - DNA, 35 bp, Artificial Sequence
  Synthetic oligonucleotide
gtacccccccctgcgcatcgtcccgcatgtcgcct

SEQ ID NO: 13802 - DNA, 35 bp, Artificial Sequence
  Synthetic oligonucleotide
tcccaacccgtatgtatgacccccccatgtgacaa

SEQ ID NO: 13803 - DNA, 36 bp, Artificial Sequence
  Synthetic oligonucleotide
gcgatgcgggccagcactccccaaccatccgcctga

SEQ ID NO: 13804 - DNA, 38 bp, Artificial Sequence
  Synthetic oligonucleotide
agactccgccccttcctcagctccgccactacgcttga

SEQ ID NO: 13805 - DNA, 35 bp, Artificial Sequence
  Synthetic oligonucleotide
agccacggtccttgaccccacctactccttggtcc

SEQ ID NO: 13806 - DNA, 35 bp, Artificial Sequence
  Synthetic oligonucleotide
gagcggggtaggtgggcaaaaatgaggtgttgggt

SEQ ID NO: 13807 - DNA, 36 bp, Artificial Sequence
  Synthetic oligonucleotide
gatttcccccgccctctgtcacggactacgtgcaca

SEQ ID NO: 13808 - DNA, 38 bp, Artificial Sequence
  Synthetic oligonucleotide
atggggtcgccctgtcctttgccgttcattttcactga

SEQ ID NO: 13809 - DNA, 33 bp, Artificial Sequence
  Synthetic oligonucleotide
actgtaccatcccagaccatgtcctatgatata

SEQ ID NO: 13810 - DNA, 35 bp, Artificial Sequence
  Synthetic oligonucleotide
taccggctgagtactctccgtacctgttgctccac

SEQ ID NO: 13811 - DNA, 36 bp, Artificial Sequence
  Synthetic oligonucleotide
tgccaatccgtccctcgaaatgctatattcctgtca

SEQ ID NO: 13812 - DNA, 35 bp, Artificial Sequence
  Synthetic oligonucleotide
tccatgtcaagcgcgacgcactgcactgcccatac

SEQ ID NO: 13813 - DNA, 35 bp, Artificial Sequence
  Synthetic oligonucleotide
actgcatgaccatgccacactgggcaaaatactcc

SEQ ID NO: 13814 - DNA, 35 bp, Artificial Sequence
  Synthetic oligonucleotide
ttccgccccaccaaaagttttccgctgcacgctcg

SEQ ID NO: 13815 - DNA, 36 bp, Artificial Sequence
  Synthetic oligonucleotide
tgccgccctcatctgccctcgcgtgcggactcttaa

SEQ ID NO: 13816 - DNA, 36 bp, Artificial Sequence
  Synthetic oligonucleotide
tgatcagcccctgcaatcattaaaccgagtctcaca

SEQ ID NO: 13817 - DNA, 36 bp, Artificial Sequence
  Synthetic oligonucleotide
acaacgctttgtgctccgaccgacggcttctcatca

SEQ ID NO: 13818 - DNA, 37 bp, Artificial Sequence
  Synthetic oligonucleotide
gtccaacctgccgtgtacgcttccgttttgcccatga

SEQ ID NO: 13819 - DNA, 38 bp, Artificial Sequence
  Synthetic oligonucleotide
tccctacacaggattcgtacccatgcgccttcacctga

SEQ ID NO: 13820 - DNA, 35 bp, Artificial Sequence
  Synthetic oligonucleotide
attgccaccgagaaacgttcgtatccagtttttgc

SEQ ID NO: 13821 - DNA, 36 bp, Artificial Sequence
  Synthetic oligonucleotide
gtgggcctcgccatcgttctcctttttgttttacca

SEQ ID NO: 13822 - DNA, 36 bp, Artificial Sequence
  Synthetic oligonucleotide
tccacccattatctgttccttcatcgtgcactatca

SEQ ID NO: 13823 - DNA, 37 bp, Artificial Sequence
  Synthetic oligonucleotide
gcagtcaggggcgggcgatgtgatatgggagggtgga

SEQ ID NO: 13824 - DNA, 38 bp, Artificial Sequence
  Synthetic oligonucleotide
gtacacggtcccgaactgcctccgccctacccgattga

SEQ ID NO: 13825 - DNA, 36 bp, Artificial Sequence
  Synthetic oligonucleotide
ggtacgggagggggggctgacacgccaagggtggta

SEQ ID NO: 13826 - DNA, 38 bp, Artificial Sequence
  Synthetic oligonucleotide
gaaccacccttcactgtgcccccctaaactggctatga

SEQ ID NO: 13827 - DNA, 35 bp, Artificial Sequence
  Synthetic oligonucleotide
acccccgacgacgatccaaggtcatgttctgccca

SEQ ID NO: 13828 - DNA, 37 bp, Artificial Sequence
  Synthetic oligonucleotide
tagaggtggaaaatgcaggggaaggaacgagggtgga

SEQ ID NO: 13829 - DNA, 37 bp, Artificial Sequence
  Synthetic oligonucleotide
atgcacatccgcgcccatctgcatatacttcacttga

SEQ ID NO: 13830 - DNA, 35 bp, Artificial Sequence
  Synthetic oligonucleotide
ggtcaaccaccgcacgcttgcctgtacctcgaaca

SEQ ID NO: 13831 - DNA, 37 bp, Artificial Sequence
  Synthetic oligonucleotide
gagccgagactgtagtgcgcgccgactcccctcctga

SEQ ID NO: 13832 - DNA, 38 bp, Artificial Sequence
  Synthetic oligonucleotide
gccacaggaaagggtggggtgatggacatgagaggtga

SEQ ID NO: 13833 - DNA, 35 bp, Artificial Sequence
  Synthetic oligonucleotide
gacgatccactttcattcactgtgacgtgtttttc

SEQ ID NO: 13834 - DNA, 37 bp, Artificial Sequence
  Synthetic oligonucleotide
gaaatcacgcgccccatcctgctatggtgactttcga

SEQ ID NO: 13835 - DNA, 36 bp, Artificial Sequence
  Synthetic oligonucleotide
taggtcagccgcgcccggtgcctctcttcaatcata

SEQ ID NO: 13836 - DNA, 35 bp, Artificial Sequence
  Synthetic oligonucleotide
taggactcgcccacttttcaacggtagaccaatcc

SEQ ID NO: 13837 - DNA, 35 bp, Artificial Sequence
  Synthetic oligonucleotide
aattcccgcacccatcgttactgtgggtcttctcc

SEQ ID NO: 13838 - DNA, 36 bp, Artificial Sequence
  Synthetic oligonucleotide
gttacatcctgagcaaagttaagccacgttcccgca

SEQ ID NO: 13839 - DNA, 35 bp, Artificial Sequence
  Synthetic oligonucleotide
attacacccgccaatcaaatcgtccgtccacatca

SEQ ID NO: 13840 - DNA, 36 bp, Artificial Sequence
  Synthetic oligonucleotide
gaatgcccagctcgtgcaccgcgctttttttcccga

SEQ ID NO: 13841 - DNA, 36 bp, Artificial Sequence
  Synthetic oligonucleotide
aaggggcggttaggtttattaggtggggtaagggga

SEQ ID NO: 13842 - DNA, 35 bp, Artificial Sequence
  Synthetic oligonucleotide
ttgacgacgttccagctcccgcactgacgttcccc

SEQ ID NO: 13843 - DNA, 35 bp, Artificial Sequence
  Synthetic oligonucleotide
gttagggggaagggtgcataggaaaacgggacacg

SEQ ID NO: 13844 - DNA, 35 bp, Artificial Sequence
  Synthetic oligonucleotide
gtccaccatcctgtccagtacgaccatatagattt

SEQ ID NO: 13845 - DNA, 35 bp, Artificial Sequence
  Synthetic oligonucleotide
tcccggtgcattttgtcgcctgcacgtaactctac

SEQ ID NO: 13846 - DNA, 35 bp, Artificial Sequence
  Synthetic oligonucleotide
tgtggccacacttctctgattacgcacagtcattc

SEQ ID NO: 13847 - DNA, 38 bp, Artificial Sequence
  Synthetic oligonucleotide
gaacccggcccagggttctggactctacctcatcctga

SEQ ID NO: 13848 - DNA, 35 bp, Artificial Sequence
  Synthetic oligonucleotide
tgacccaggtccgtttctcatacatccgtaagtcc

SEQ ID NO: 13849 - DNA, 35 bp, Artificial Sequence
  Synthetic oligonucleotide
gtgggagaaagggtcgcatgtttgggggcttgtgg

SEQ ID NO: 13850 - DNA, 35 bp, Artificial Sequence
  Synthetic oligonucleotide
ttccccaccgcttccatagcatcgcggaaccgttt

SEQ ID NO: 13851 - DNA, 36 bp, Artificial Sequence
  Synthetic oligonucleotide
gttgcccagtaactgtcttattccgcgttttgcaca

SEQ ID NO: 13852 - DNA, 37 bp, Artificial Sequence
  Synthetic oligonucleotide
atggcaccctcacaacaccgctgaacggctccactga

SEQ ID NO: 13853 - DNA, 35 bp, Artificial Sequence
  Synthetic oligonucleotide
tgcggcccatcgcacggtgcctctcgatccatccc

SEQ ID NO: 13854 - DNA, 35 bp, Artificial Sequence
  Synthetic oligonucleotide
gacatagggaggggaaacgagtaaatagtgtgacg

SEQ ID NO: 13855 - DNA, 36 bp, Artificial Sequence
  Synthetic oligonucleotide
acttcactgccaccgatcgaggttgtacctctccca

SEQ ID NO: 13856 - DNA, 35 bp, Artificial Sequence
  Synthetic oligonucleotide
gaccggggaagggagggaagggactcgccgaggca

SEQ ID NO: 13857 - DNA, 37 bp, Artificial Sequence
  Synthetic oligonucleotide
gtaggggaggaatggtacgaaatgggtggggggatga

SEQ ID NO: 13858 - DNA, 35 bp, Artificial Sequence
  Synthetic oligonucleotide
ttatgcgggcccccttgactattcttcacgtttta

SEQ ID NO: 13859 - DNA, 35 bp, Artificial Sequence
  Synthetic oligonucleotide
gagtacacccccctctgttgtttagtccaaattgg

SEQ ID NO: 13860 - DNA, 35 bp, Artificial Sequence
  Synthetic oligonucleotide
gacgggggtgggaggataatgccgcgcggacggtg

SEQ ID NO: 13861 - DNA, 35 bp, Artificial Sequence
  Synthetic oligonucleotide
tgcccacctcctgagtaacatggtactatctattt

SEQ ID NO: 13862 - DNA, 36 bp, Artificial Sequence
  Synthetic oligonucleotide
tcacacccttgcccctcctttaacgccagactggca

SEQ ID NO: 13863 - DNA, 35 bp, Artificial Sequence
  Synthetic oligonucleotide
gtcccgtccggtcttgatccaatttgttctgccac

SEQ ID NO: 13864 - DNA, 35 bp, Artificial Sequence
  Synthetic oligonucleotide
acctatcacgcacataacccacagaagctatactc

SEQ ID NO: 13865 - DNA, 35 bp, Artificial Sequence
  Synthetic oligonucleotide
acgtgacatcttccggactgctgttcaactcctca

SEQ ID NO: 13866 - DNA, 37 bp, Artificial Sequence
  Synthetic oligonucleotide
tcctgtggcggtatcaaaagggggggcctggggtgga

SEQ ID NO: 13867 - DNA, 35 bp, Artificial Sequence
  Synthetic oligonucleotide
attatggctgaccaccgttggtctaacacaccctc

SEQ ID NO: 13868 - DNA, 35 bp, Artificial Sequence
  Synthetic oligonucleotide
acctgtccgtgcgtttttaggccttctcacccagt

SEQ ID NO: 13869 - DNA, 35 bp, Artificial Sequence
  Synthetic oligonucleotide
gtcccgtgccgccgcacctagcctggcccctttct

SEQ ID NO: 13870 - DNA, 35 bp, Artificial Sequence
  Synthetic oligonucleotide
acccgtgccgatctcaattcctgtcgcctcacgtt

SEQ ID NO: 13871 - DNA, 34 bp, Artificial Sequence
  Synthetic oligonucleotide
taccccaaccatcgccttcgttggcccctacgaa

SEQ ID NO: 13872 - DNA, 37 bp, Artificial Sequence
  Synthetic oligonucleotide
gcccaccacttacatacccgcttattggagaccgtga

SEQ ID NO: 13873 - DNA, 38 bp, Artificial Sequence
  Synthetic oligonucleotide
gagacaagggaaggaggagcgatgagaggcttaggtga

SEQ ID NO: 13874 - DNA, 38 bp, Artificial Sequence
  Synthetic oligonucleotide
aagcctgcctccatcctgccatgcactgtcaatcgtga

SEQ ID NO: 13875 - DNA, 35 bp, Artificial Sequence
  Synthetic oligonucleotide
ggagtgcaacgcacggactccatggccccttgtac

SEQ ID NO: 13876 - DNA, 35 bp, Artificial Sequence
  Synthetic oligonucleotide
gtactgcgcaatcacggcacccccgagcaacacct

SEQ ID NO: 13877 - DNA, 36 bp, Artificial Sequence
  Synthetic oligonucleotide
cgcgcccaccaacttggtctgtctaacacgcctcca

SEQ ID NO: 13878 - DNA, 35 bp, Artificial Sequence
  Synthetic oligonucleotide
agccttcccaccatagttctatagtacctgcatgc

SEQ ID NO: 13879 - DNA, 37 bp, Artificial Sequence
  Synthetic oligonucleotide
ttgaccacggccgtatttctgttttttctgcacacga

SEQ ID NO: 13880 - DNA, 38 bp, Artificial Sequence
  Synthetic oligonucleotide
tcgaggagggggggaaggaagtgaggttgcggagttga

SEQ ID NO: 13881 - DNA, 35 bp, Artificial Sequence
  Synthetic oligonucleotide
tttgcaccatccgcaccgctacctaagttcagcta

SEQ ID NO: 13882 - DNA, 36 bp, Artificial Sequence
  Synthetic oligonucleotide
ttacctccccgtccgccggctcacctctcttgttta

SEQ ID NO: 13883 - DNA, 35 bp, Artificial Sequence
  Synthetic oligonucleotide
aacaacgcatgcccacatcccgactgatctctacc

SEQ ID NO: 13884 - DNA, 35 bp, Artificial Sequence
  Synthetic oligonucleotide
acgtgggatgggcagggtgggtagtcttacgctgc

SEQ ID NO: 13885 - DNA, 35 bp, Artificial Sequence
  Synthetic oligonucleotide
gagggacgtgccgaggtaggtgtggggcaaatggt

SEQ ID NO: 13886 - DNA, 37 bp, Artificial Sequence
  Synthetic oligonucleotide
gagctgcaggtggaacacggggaatggggctggaaga

SEQ ID NO: 13887 - DNA, 36 bp, Artificial Sequence
  Synthetic oligonucleotide
ttgcgtgcatggaagggttattggggggggccggga

SEQ ID NO: 13888 - DNA, 35 bp, Artificial Sequence
  Synthetic oligonucleotide
acacccacgcccggctacccttgcacatacaaccc

SEQ ID NO: 13889 - DNA, 36 bp, Artificial Sequence
  Synthetic oligonucleotide
ttagctagctggtggggaggggtgtggggtgggtga

SEQ ID NO: 13890 - DNA, 34 bp, Artificial Sequence
  Synthetic oligonucleotide
actaccgatcctgttactttgtagctagcttatc

SEQ ID NO: 13891 - DNA, 35 bp, Artificial Sequence
  Synthetic oligonucleotide
accacactcgctgttccggtcggagaccaaattgt

SEQ ID NO: 13892 - DNA, 37 bp, Artificial Sequence
  Synthetic oligonucleotide
gcccacccccactctatggttttttaatattgcatga

SEQ ID NO: 13893 - DNA, 38 bp, Artificial Sequence
  Synthetic oligonucleotide
gctacggtggggggagaatggcggaaacggtacggtga

SEQ ID NO: 13894 - DNA, 35 bp, Artificial Sequence
  Synthetic oligonucleotide
actaaactgtgtccaccttgtcccatccccgagtg

SEQ ID NO: 13895 - DNA, 35 bp, Artificial Sequence
  Synthetic oligonucleotide
gtgggcgccaccctttcgaactgaattgcatgcct

SEQ ID NO: 13896 - DNA, 36 bp, Artificial Sequence
  Synthetic oligonucleotide
gccactgttagtcccgtagttccgccaccgatttca

SEQ ID NO: 13897 - DNA, 35 bp, Artificial Sequence
  Synthetic oligonucleotide
tggggggcctcaccatcctttctacgttacccata

SEQ ID NO: 13898 - DNA, 36 bp, Artificial Sequence
  Synthetic oligonucleotide
tgcgcctcgcccaccaacctgcctcgaatcagttta

SEQ ID NO: 13899 - DNA, 35 bp, Artificial Sequence
  Synthetic oligonucleotide
ggtacctgcccaagttccgtaatcatactccgtac

SEQ ID NO: 13900 - DNA, 35 bp, Artificial Sequence
  Synthetic oligonucleotide
gcaccggcgctcctttattgtctgttctccttcgc

SEQ ID NO: 13901 - DNA, 35 bp, Artificial Sequence
  Synthetic oligonucleotide
acacctctcacgcgcgaacatactccctaggattc

SEQ ID NO: 13902 - DNA, 35 bp, Artificial Sequence
  Synthetic oligonucleotide
gatcctcctcgcccttccgcttcagcccatgcgtg

SEQ ID NO: 13903 - DNA, 35 bp, Artificial Sequence
  Synthetic oligonucleotide
gactcccattacacagtgtatcgttctccctcaat

SEQ ID NO: 13904 - DNA, 38 bp, Artificial Sequence
  Synthetic oligonucleotide
ttggagccgacatctaccatccctgccgtaatacgtga

SEQ ID NO: 13905 - DNA, 35 bp, Artificial Sequence
  Synthetic oligonucleotide
accagctccactgctcccaattaaatgcgcttgcc

SEQ ID NO: 13906 - DNA, 35 bp, Artificial Sequence
  Synthetic oligonucleotide
agtctgcgcaccacacctatcgcacggatactaca

SEQ ID NO: 13907 - DNA, 35 bp, Artificial Sequence
  Synthetic oligonucleotide
tcccactcacttatcgaattggcgcacacttcgca

SEQ ID NO: 13908 - DNA, 37 bp, Artificial Sequence
  Synthetic oligonucleotide
gacgccacatcgcatccgccttgaaacgttatcctga

SEQ ID NO: 13909 - DNA, 36 bp, Artificial Sequence
  Synthetic oligonucleotide
taccgccagtatctcttgtttgcgtaccctttttta

SEQ ID NO: 13910 - DNA, 35 bp, Artificial Sequence
  Synthetic oligonucleotide
gactccgcacatttccgttgatccacttgctgtgc

SEQ ID NO: 13911 - DNA, 35 bp, Artificial Sequence
  Synthetic oligonucleotide
gggagagacggaggagacggtgagggaacggggat

SEQ ID NO: 13912 - DNA, 36 bp, Artificial Sequence
  Synthetic oligonucleotide
gccgcaggtccttcctttacgcctcccccgctgaga

SEQ ID NO: 13913 - DNA, 38 bp, Artificial Sequence
  Synthetic oligonucleotide
taactcccgccacctctgtacatgctttccagtgttga

SEQ ID NO: 13914 - DNA, 35 bp, Artificial Sequence
  Synthetic oligonucleotide
tcaatgacggtacagccgacgttccttcttgtccc

SEQ ID NO: 13915 - DNA, 35 bp, Artificial Sequence
  Synthetic oligonucleotide
ggtggccacgagcattatttgtgttctttccattc

SEQ ID NO: 13916 - DNA, 35 bp, Artificial Sequence
  Synthetic oligonucleotide
ttaccacgcactggatcatcaggcaattcgacctc

SEQ ID NO: 13917 - DNA, 36 bp, Artificial Sequence
  Synthetic oligonucleotide
tgaagcctcagcggttgaccaacataccctttccca

SEQ ID NO: 13918 - DNA, 35 bp, Artificial Sequence
  Synthetic oligonucleotide
tccaccttcagcctcggccgccatccactcgtcac

SEQ ID NO: 13919 - DNA, 35 bp, Artificial Sequence
  Synthetic oligonucleotide
gtcgcaggacggtactccggcctcactgcctctac

SEQ ID NO: 13920 - DNA, 35 bp, Artificial Sequence
  Synthetic oligonucleotide
tctgacggggcgtcacacgtcccattcatcattcc

SEQ ID NO: 13921 - DNA, 35 bp, Artificial Sequence
  Synthetic oligonucleotide
aaccagcactacatctccctcgcactctcaagtgg

SEQ ID NO: 13922 - DNA, 35 bp, Artificial Sequence
  Synthetic oligonucleotide
atacacgtcgcacctgcaccttggactactttcta

SEQ ID NO: 13923 - DNA, 35 bp, Artificial Sequence
  Synthetic oligonucleotide
tcctgccagtgcctgactcccatcctttgtttcac

SEQ ID NO: 13924 - DNA, 35 bp, Artificial Sequence
  Synthetic oligonucleotide
gttgacacgccctccgatttctttagttgattccg

SEQ ID NO: 13925 - DNA, 35 bp, Artificial Sequence
  Synthetic oligonucleotide
ttgcgccgcacggacatgggccaatacctccccct

SEQ ID NO: 13926 - DNA, 36 bp, Artificial Sequence
  Synthetic oligonucleotide
tgcctccgcagcagcctgtctcattacttcaatgca

SEQ ID NO: 13927 - DNA, 33 bp, Artificial Sequence
  Synthetic oligonucleotide
tccaccgatgaacttcacacgttgctctcgtac

SEQ ID NO: 13928 - DNA, 35 bp, Artificial Sequence
  Synthetic oligonucleotide
tgagacaccacccattcgttcgctctgtacactgt

SEQ ID NO: 13929 - DNA, 36 bp, Artificial Sequence
  Synthetic oligonucleotide
gcgtaaggggggtgcgggaatggagggacggggcaa

SEQ ID NO: 13930 - DNA, 36 bp, Artificial Sequence
  Synthetic oligonucleotide
ttcgccggccccctcttttctcgtctacctgttgca

SEQ ID NO: 13931 - DNA, 35 bp, Artificial Sequence
  Synthetic oligonucleotide
gaaccatcgggacgtggtgctgcctgttacactct

SEQ ID NO: 13932 - DNA, 37 bp, Artificial Sequence
  Synthetic oligonucleotide
gcggggtagggtgggggaaaagatgattcagggagga

SEQ ID NO: 13933 - DNA, 36 bp, Artificial Sequence
  Synthetic oligonucleotide
aatcgacgacccgttgccctgcccgagccacctata

SEQ ID NO: 13934 - DNA, 35 bp, Artificial Sequence
  Synthetic oligonucleotide
tagtaccacgtcctgggcaaaagcttctcgcctcc

SEQ ID NO: 13935 - DNA, 35 bp, Artificial Sequence
  Synthetic oligonucleotide
gtcacactggcacctcctgcttacacctcgaccga

SEQ ID NO: 13936 - DNA, 36 bp, Artificial Sequence
  Synthetic oligonucleotide
gtctgggcgggtgaaaagctggggggggtgctagga

SEQ ID NO: 13937 - DNA, 35 bp, Artificial Sequence
  Synthetic oligonucleotide
gcaccccgccccagcgtcggctccccctaaaaaac

SEQ ID NO: 13938 - DNA, 35 bp, Artificial Sequence
  Synthetic oligonucleotide
gcctctacccccatctgatagatctgaatccgttc

SEQ ID NO: 13939 - DNA, 35 bp, Artificial Sequence
  Synthetic oligonucleotide
gacaccggcgttgttcgcgctttctggcctattcg

SEQ ID NO: 13940 - DNA, 37 bp, Artificial Sequence
  Synthetic oligonucleotide
gaagacgaacaggtaggagagtgggggtgggaaaaga

SEQ ID NO: 13941 - DNA, 38 bp, Artificial Sequence
  Synthetic oligonucleotide
ttgagcgcaccacccactctgataccgattcgcgatga

SEQ ID NO: 13942 - DNA, 37 bp, Artificial Sequence
  Synthetic oligonucleotide
acattcccaactggtggtcttctgccatatttcctga

SEQ ID NO: 13943 - DNA, 35 bp, Artificial Sequence
  Synthetic oligonucleotide
ttgccaatccccgcgccgccctgaagttgctttct

SEQ ID NO: 13944 - DNA, 36 bp, Artificial Sequence
  Synthetic oligonucleotide
gtgcaacactacacatgcctcaacgtacacgtgaaa

SEQ ID NO: 13945 - DNA, 35 bp, Artificial Sequence
  Synthetic oligonucleotide
gatcgcgtgccttactttctatgatagctcctacc

SEQ ID NO: 13946 - DNA, 35 bp, Artificial Sequence
  Synthetic oligonucleotide
gtgcaaatgggtgcagaagggggatttagggaggg

SEQ ID NO: 13947 - DNA, 35 bp, Artificial Sequence
  Synthetic oligonucleotide
acacgcattcccacagctgtatccacgcggtaatt

SEQ ID NO: 13948 - DNA, 38 bp, Artificial Sequence
  Synthetic oligonucleotide
gacgctgctacgaatcgtccccttgcctgccattttga

SEQ ID NO: 13949 - DNA, 35 bp, Artificial Sequence
  Synthetic oligonucleotide
gcgctgccgccactgccaaacgttagtattcccac

SEQ ID NO: 13950 - DNA, 35 bp, Artificial Sequence
  Synthetic oligonucleotide
tgttccgttctgcagtaatacttcgccctatcacg

SEQ ID NO: 13951 - DNA, 35 bp, Artificial Sequence
  Synthetic oligonucleotide
gaaggacgaggaacagtttgagggtggcgaagggg

SEQ ID NO: 13952 - DNA, 37 bp, Artificial Sequence
  Synthetic oligonucleotide
actgttacggcccggacgtccttttatgcactatcga

SEQ ID NO: 13953 - DNA, 35 bp, Artificial Sequence
  Synthetic oligonucleotide
aaacccgccacccggatgaccctccgttcacattc

SEQ ID NO: 13954 - DNA, 37 bp, Artificial Sequence
  Synthetic oligonucleotide
tgcattcgtcgacattatcatgctaactcttccccga

SEQ ID NO: 13955 - DNA, 38 bp, Artificial Sequence
  Synthetic oligonucleotide
tcgagctcccgcactctgtctctttcctagtcacctga

SEQ ID NO: 13956 - DNA, 35 bp, Artificial Sequence
  Synthetic oligonucleotide
gtgacctccatcgggctaattcagacaggcccaaa

SEQ ID NO: 13957 - DNA, 35 bp, Artificial Sequence
  Synthetic oligonucleotide
gtgcaccccagaccccagttcccatacttccacaa

SEQ ID NO: 13958 - DNA, 37 bp, Artificial Sequence
  Synthetic oligonucleotide
gcacaaccgcactgcaccgtacgccttcacccatcga

SEQ ID NO: 13959 - DNA, 35 bp, Artificial Sequence
  Synthetic oligonucleotide
gcacccacatgtaggctaaatcaaccttctatcta

SEQ ID NO: 13960 - DNA, 35 bp, Artificial Sequence
  Synthetic oligonucleotide
agccaccatcgacatagcccttccgtatcacacag

SEQ ID NO: 13961 - DNA, 35 bp, Artificial Sequence
  Synthetic oligonucleotide
tgagaagccgaagaaggaagaaaggggtgcgggtt

SEQ ID NO: 13962 - DNA, 36 bp, Artificial Sequence
  Synthetic oligonucleotide
gcaaagcttccactgcggtatcacacctctgtcaca

SEQ ID NO: 13963 - DNA, 36 bp, Artificial Sequence
  Synthetic oligonucleotide
gccgtcgacgccgaatcaaccattgcccgcctctca

SEQ ID NO: 13964 - DNA, 37 bp, Artificial Sequence
  Synthetic oligonucleotide
gtggccgaacggggaggacaaaagttggcagggggga

SEQ ID NO: 13965 - DNA, 37 bp, Artificial Sequence
  Synthetic oligonucleotide
gacgaccctcccgcttgtcttttagcccgacgaatga

SEQ ID NO: 13966 - DNA, 35 bp, Artificial Sequence
  Synthetic oligonucleotide
gctgagagcgctgaaaaaatggggtggaatggaac

SEQ ID NO: 13967 - DNA, 35 bp, Artificial Sequence
  Synthetic oligonucleotide
tcaacccagctcatttcgtgcattttcctttccgc

SEQ ID NO: 13968 - DNA, 35 bp, Artificial Sequence
  Synthetic oligonucleotide
tgcgcacgtctcgttgattgctatccgccctctct

SEQ ID NO: 13969 - DNA, 35 bp, Artificial Sequence
  Synthetic oligonucleotide
gacgccaagccgcgtactacctgaatttttcacgt

SEQ ID NO: 13970 - DNA, 35 bp, Artificial Sequence
  Synthetic oligonucleotide
gctggaaaggaaagagggataatcgggggtgggag

SEQ ID NO: 13971 - DNA, 35 bp, Artificial Sequence
  Synthetic oligonucleotide
gttaccccgtgtggactcgttttagtggtcatcct

SEQ ID NO: 13972 - DNA, 35 bp, Artificial Sequence
  Synthetic oligonucleotide
tatgtccatgtggttatatctcgtccacctgcaac

SEQ ID NO: 13973 - DNA, 35 bp, Artificial Sequence
  Synthetic oligonucleotide
attgccctacccctatgcacgatgctatcttacgc

SEQ ID NO: 13974 - DNA, 35 bp, Artificial Sequence
  Synthetic oligonucleotide
gcacacaccctgaccaatgcactatcgtcaccgct

SEQ ID NO: 13975 - DNA, 36 bp, Artificial Sequence
  Synthetic oligonucleotide
gtggggagaggggaaactgattggggaaggggaaaa

SEQ ID NO: 13976 - DNA, 37 bp, Artificial Sequence
  Synthetic oligonucleotide
acctgcccccccggcgtatctccctaatggcacttga

SEQ ID NO: 13977 - DNA, 37 bp, Artificial Sequence
  Synthetic oligonucleotide
gagtgggactgcgggagggatactcagaccgggttga

SEQ ID NO: 13978 - DNA, 35 bp, Artificial Sequence
  Synthetic oligonucleotide
gttgcacgggcaccacctttgtagccaatccttac

SEQ ID NO: 13979 - DNA, 35 bp, Artificial Sequence
  Synthetic oligonucleotide
tcatacaccccggactctgtcgttctgcggagccc

SEQ ID NO: 13980 - DNA, 35 bp, Artificial Sequence
  Synthetic oligonucleotide
ttccgcacgagtccctatctctatttggtgccgcc

SEQ ID NO: 13981 - DNA, 35 bp, Artificial Sequence
  Synthetic oligonucleotide
atctcacacacacatgaccggactattcgatcgtc

SEQ ID NO: 13982 - DNA, 35 bp, Artificial Sequence
  Synthetic oligonucleotide
tgttgagctctcgttcttgcctcctaaagtttctc

SEQ ID NO: 13983 - DNA, 35 bp, Artificial Sequence
  Synthetic oligonucleotide
gttccgtccatagtaccatccgttatgtcttttat

SEQ ID NO: 13984 - DNA, 37 bp, Artificial Sequence
  Synthetic oligonucleotide
ggaccgcagagtccgtccgcccccacataacttccga

SEQ ID NO: 13985 - DNA, 37 bp, Artificial Sequence
  Synthetic oligonucleotide
agcagaacgtaggggggcgggaatgggttcgcgggga

SEQ ID NO: 13986 - DNA, 38 bp, Artificial Sequence
  Synthetic oligonucleotide
ttgacacgcaccctgttcacaagacttccatgcgctga

SEQ ID NO: 13987 - DNA, 35 bp, Artificial Sequence
  Synthetic oligonucleotide
accgccgtatccgtcgcaaactttgttgacctgtc

SEQ ID NO: 13988 - DNA, 35 bp, Artificial Sequence
  Synthetic oligonucleotide
accccccatgcctgtgttcaatcgaactatatttc

SEQ ID NO: 13989 - DNA, 37 bp, Artificial Sequence
  Synthetic oligonucleotide
tccacacaccccctgccctgtgctataatgaccgaga

SEQ ID NO: 13990 - DNA, 38 bp, Artificial Sequence
  Synthetic oligonucleotide
taaatgcacagaaagggaatgggttcgggaggggttga

SEQ ID NO: 13991 - DNA, 36 bp, Artificial Sequence
  Synthetic oligonucleotide
gaccgcctatgccgttcaactgactaatttttatca

SEQ ID NO: 13992 - DNA, 37 bp, Artificial Sequence
  Synthetic oligonucleotide
gaaccacccgttcaataactgctatccactcatccga

SEQ ID NO: 13993 - DNA, 37 bp, Artificial Sequence
  Synthetic oligonucleotide
cacgaggcattaatactttccaacacagtcgatgcga

SEQ ID NO: 13994 - DNA, 36 bp, Artificial Sequence
  Synthetic oligonucleotide
gtccccttccgttccgacacgcctcaccttcaggga

SEQ ID NO: 13995 - DNA, 35 bp, Artificial Sequence
  Synthetic oligonucleotide
aacttccgcccaagacccagcctcgtttaaccgcg

SEQ ID NO: 13996 - DNA, 36 bp, Artificial Sequence
  Synthetic oligonucleotide
gtccatcttacctgtcgcataatgcgggtcacctca

SEQ ID NO: 13997 - DNA, 35 bp, Artificial Sequence
  Synthetic oligonucleotide
tcccatcccgtgtacttactgcgattttgtcttac

SEQ ID NO: 13998 - DNA, 35 bp, Artificial Sequence
  Synthetic oligonucleotide
tccaaccctctctgtcatggcccggttcggtctgg

SEQ ID NO: 13999 - DNA, 35 bp, Artificial Sequence
  Synthetic oligonucleotide
ggagggtggggggggagggatcagactgcctacga

SEQ ID NO: 14000 - DNA, 37 bp, Artificial Sequence
  Synthetic oligonucleotide
tccaacacaccatccctttccttccgtcatggacgga

SEQ ID NO: 14001 - DNA, 38 bp, Artificial Sequence
  Synthetic oligonucleotide
gtacctgccactaatgcatccgctcctcaaatttttga

SEQ ID NO: 14002 - DNA, 35 bp, Artificial Sequence
  Synthetic oligonucleotide
tctaacaccacctacagcacgccacagattcgacg

SEQ ID NO: 14003 - DNA, 35 bp, Artificial Sequence
  Synthetic oligonucleotide
tccatgcaccatcagtgacgcacaatgccactact

SEQ ID NO: 14004 - DNA, 35 bp, Artificial Sequence
  Synthetic oligonucleotide
gtggccaaggacgccaccccctaccttcctcctga

SEQ ID NO: 14005 - DNA, 36 bp, Artificial Sequence
  Synthetic oligonucleotide
atactgggggcaggtgggaaggggaatggaaaaata

SEQ ID NO: 14006 - DNA, 35 bp, Artificial Sequence
  Synthetic oligonucleotide
tgccgactcaaatctcagttcgtccttacttctgg

SEQ ID NO: 14007 - DNA, 35 bp, Artificial Sequence
  Synthetic oligonucleotide
actcttgcccgctctcgctgtcttacccggtctct

SEQ ID NO: 14008 - DNA, 35 bp, Artificial Sequence
  Synthetic oligonucleotide
atgactgggccttagcgctacacctgccatccaac

SEQ ID NO: 14009 - DNA, 35 bp, Artificial Sequence
  Synthetic oligonucleotide
tgcaggccacatgcgtgcactcccacattcccgct

SEQ ID NO: 14010 - DNA, 35 bp, Artificial Sequence
  Synthetic oligonucleotide
agttccacctccatatgtcctctgcggtaagcctt

SEQ ID NO: 14011 - DNA, 38 bp, Artificial Sequence
  Synthetic oligonucleotide
aaggacagtccaatccgccttagtgcccgttcccttga

SEQ ID NO: 14012 - DNA, 35 bp, Artificial Sequence
  Synthetic oligonucleotide
ttagtccgccacatttgccccgcacgataacctta

SEQ ID NO: 14013 - DNA, 36 bp, Artificial Sequence
  Synthetic oligonucleotide
tcggcgtgccacggacgcgcttatctccgcaaataa

SEQ ID NO: 14014 - DNA, 35 bp, Artificial Sequence
  Synthetic oligonucleotide
gacccctacagccctcaccccaccgctattatgcg

SEQ ID NO: 14015 - DNA, 36 bp, Artificial Sequence
  Synthetic oligonucleotide
acgcgagtcctcctcccgatgccccccaccccgcga

SEQ ID NO: 14016 - DNA, 37 bp, Artificial Sequence
  Synthetic oligonucleotide
acgatggggtagtgcggtatggaacggagggaattga

SEQ ID NO: 14017 - DNA, 38 bp, Artificial Sequence
  Synthetic oligonucleotide
gttgaccctccgcctcagctctaccctgggacacttga

SEQ ID NO: 14018 - DNA, 37 bp, Artificial Sequence
  Synthetic oligonucleotide
gcaccatctggcctaccaataccattccacaggttga

SEQ ID NO: 14019 - DNA, 32 bp, Artificial Sequence
  Synthetic oligonucleotide
gacaccgccctgtggaccacaccccttgctaa

SEQ ID NO: 14020 - DNA, 35 bp, Artificial Sequence
  Synthetic oligonucleotide
tcattacccagattgcgttcggcctgacctcttta

SEQ ID NO: 14021 - DNA, 35 bp, Artificial Sequence
  Synthetic oligonucleotide
actgctccccctcgtcgcctctacgccggtttgct

SEQ ID NO: 14022 - DNA, 35 bp, Artificial Sequence
  Synthetic oligonucleotide
ggaacagccccccacctctttccagacgacgttaa

SEQ ID NO: 14023 - DNA, 35 bp, Artificial Sequence
  Synthetic oligonucleotide
tacttgccgccattagcgtaatggacttcctctca

SEQ ID NO: 14024 - DNA, 37 bp, Artificial Sequence
  Synthetic oligonucleotide
tacgcgaaaatacgaatgggaggagcgggtggtgaga

SEQ ID NO: 14025 - DNA, 37 bp, Artificial Sequence
  Synthetic oligonucleotide
tctcactgccctcacctttgaattggtacgccctaga

SEQ ID NO: 14026 - DNA, 35 bp, Artificial Sequence
  Synthetic oligonucleotide
gaccctgtccgctttacctatgaatagctcacact

SEQ ID NO: 14027 - DNA, 32 bp, Artificial Sequence
  Synthetic oligonucleotide
taacaccgatcccgggcctatgggtgcactct

SEQ ID NO: 14028 - DNA, 35 bp, Artificial Sequence
  Synthetic oligonucleotide
tccaccgcattttttttctcgcctggttcccaagt

SEQ ID NO: 14029 - DNA, 35 bp, Artificial Sequence
  Synthetic oligonucleotide
gtgacatcgatgcttctcttactttactgtcctgt

SEQ ID NO: 14030 - DNA, 36 bp, Artificial Sequence
  Synthetic oligonucleotide
ggaccgctacgtcctgatcccgcccaacctttatca

SEQ ID NO: 14031 - DNA, 38 bp, Artificial Sequence
  Synthetic oligonucleotide
acgcccctgcccctctccgttcccgaactgcttggtga

SEQ ID NO: 14032 - DNA, 35 bp, Artificial Sequence
  Synthetic oligonucleotide
tacatcaccgaggcatacctgtcctatctccttgc

SEQ ID NO: 14033 - DNA, 35 bp, Artificial Sequence
  Synthetic oligonucleotide
taacaggccacctccaccaccacatgatacggatc

SEQ ID NO: 14034 - DNA, 35 bp, Artificial Sequence
  Synthetic oligonucleotide
atagcccgctcctatcttactttcccgttcgacct

SEQ ID NO: 14035 - DNA, 36 bp, Artificial Sequence
  Synthetic oligonucleotide
ttggacgagcgctccgccatataccttttcctctca

SEQ ID NO: 14036 - DNA, 35 bp, Artificial Sequence
  Synthetic oligonucleotide
ttcagcctccctcatgttccttcgggaaactctcc

SEQ ID NO: 14037 - DNA, 35 bp, Artificial Sequence
  Synthetic oligonucleotide
aagcctcacatcgccctctagcttactgctctatc

SEQ ID NO: 14038 - DNA, 35 bp, Artificial Sequence
  Synthetic oligonucleotide
gctggggacagacggagttgcagggggaggaaggg

SEQ ID NO: 14039 - DNA, 35 bp, Artificial Sequence
  Synthetic oligonucleotide
gccatctaactgcgtttagggtccgccacttcctg

SEQ ID NO: 14040 - DNA, 35 bp, Artificial Sequence
  Synthetic oligonucleotide
aaggccagggaacagcaggggaagggagggtgcca

SEQ ID NO: 14041 - DNA, 37 bp, Artificial Sequence
  Synthetic oligonucleotide
gaccacctcctgcatcccagtttttatgaacctttga

SEQ ID NO: 14042 - DNA, 35 bp, Artificial Sequence
  Synthetic oligonucleotide
gcaggagcgggggcgaaaaaaagggcgtgagcgga

SEQ ID NO: 14043 - DNA, 35 bp, Artificial Sequence
  Synthetic oligonucleotide
tcaccgcctctgtccttacatgcctccgagacata

SEQ ID NO: 14044 - DNA, 33 bp, Artificial Sequence
  Synthetic oligonucleotide
tggtcacccacgccgtttcttgctttgctgacc

SEQ ID NO: 14045 - DNA, 35 bp, Artificial Sequence
  Synthetic oligonucleotide
tgcactgcatagcctctcgtttttgcgatctcgta

SEQ ID NO: 14046 - DNA, 34 bp, Artificial Sequence
  Synthetic oligonucleotide
tcaccttcatcacacgcgcctgctccattttaca

SEQ ID NO: 14047 - DNA, 36 bp, Artificial Sequence
  Synthetic oligonucleotide
agcggacaaaccgccctttctgtcaattgcacacca

SEQ ID NO: 14048 - DNA, 37 bp, Artificial Sequence
  Synthetic oligonucleotide
ggggagttggtcgcagggaggcggagtaacggaggga

SEQ ID NO: 14049 - DNA, 38 bp, Artificial Sequence
  Synthetic oligonucleotide
gccccttcctgctcctattgcccactcacctacggtga

SEQ ID NO: 14050 - DNA, 35 bp, Artificial Sequence
  Synthetic oligonucleotide
tacgccacactcactcggtcatcttgcggtaattc

SEQ ID NO: 14051 - DNA, 37 bp, Artificial Sequence
  Synthetic oligonucleotide
gaaggcgggtgaggagaataaaggtaggatgagcgga

SEQ ID NO: 14052 - DNA, 38 bp, Artificial Sequence
  Synthetic oligonucleotide
gtgcacctttgcttaatattgattacctctgctcctga

SEQ ID NO: 14053 - DNA, 36 bp, Artificial Sequence
  Synthetic oligonucleotide
tgcacatccccgattagcattgttctcgatctacga

SEQ ID NO: 14054 - DNA, 35 bp, Artificial Sequence
  Synthetic oligonucleotide
atcccctcctgacccgaaaggcctcctgttctagg

SEQ ID NO: 14055 - DNA, 35 bp, Artificial Sequence
  Synthetic oligonucleotide
tgccgcaccatctgcttctgttctatcggattatt

SEQ ID NO: 14056 - DNA, 38 bp, Artificial Sequence
  Synthetic oligonucleotide
ttcgccacctgcttccggcccataattcgctattgtga

SEQ ID NO: 14057 - DNA, 35 bp, Artificial Sequence
  Synthetic oligonucleotide
actgcggccaaaccacgctgggcctgtgcacactc

SEQ ID NO: 14058 - DNA, 35 bp, Artificial Sequence
  Synthetic oligonucleotide
tgcgccactggttttagcaaacttcccactgatct

SEQ ID NO: 14059 - DNA, 36 bp, Artificial Sequence
  Synthetic oligonucleotide
gcctggcgtagagccaccgctcagaacctcccacca

SEQ ID NO: 14060 - DNA, 36 bp, Artificial Sequence
  Synthetic oligonucleotide
tgatgccgcctcgcctcgacacaaagtgcgccttca

SEQ ID NO: 14061 - DNA, 38 bp, Artificial Sequence
  Synthetic oligonucleotide
acctggcccacagtggtcaccaagttccgccgttctga

SEQ ID NO: 14062 - DNA, 38 bp, Artificial Sequence
  Synthetic oligonucleotide
gttgggagggccggctggaattgggggcggagtgttga

SEQ ID NO: 14063 - DNA, 37 bp, Artificial Sequence
  Synthetic oligonucleotide
tgtagcctgcaccattgctacgcccttcccactcgga

SEQ ID NO: 14064 - DNA, 35 bp, Artificial Sequence
  Synthetic oligonucleotide
agccgcatcaaccacgtcttcagtcggtccatcac

SEQ ID NO: 14065 - DNA, 35 bp, Artificial Sequence
  Synthetic oligonucleotide
tatgtgcggtcccttgcatgtctaaattgtccact

SEQ ID NO: 14066 - DNA, 36 bp, Artificial Sequence
  Synthetic oligonucleotide
gaccgcaccacctgaccatgccgaatttgcgtcgca

SEQ ID NO: 14067 - DNA, 35 bp, Artificial Sequence
  Synthetic oligonucleotide
gtgccccactcgccccgttttaatatattttcgca

SEQ ID NO: 14068 - DNA, 36 bp, Artificial Sequence
  Synthetic oligonucleotide
gtcccgcaccctttctctcgaaccaaggccactgca

SEQ ID NO: 14069 - DNA, 35 bp, Artificial Sequence
  Synthetic oligonucleotide
gttacgcgccggaccatcctaccttgttccttcga

SEQ ID NO: 14070 - DNA, 35 bp, Artificial Sequence
  Synthetic oligonucleotide
aaccacagccacatcttttcattggctattttgcc

SEQ ID NO: 14071 - DNA, 36 bp, Artificial Sequence
  Synthetic oligonucleotide
gccaccacgttgacctactcttccgtgagtttacca

SEQ ID NO: 14072 - DNA, 38 bp, Artificial Sequence
  Synthetic oligonucleotide
tgcgacacccccactagggccgttcccctgctccatga

SEQ ID NO: 14073 - DNA, 37 bp, Artificial Sequence
  Synthetic oligonucleotide
atcgatccgtcctgcgcacatttcgcctctcgattga

SEQ ID NO: 14074 - DNA, 35 bp, Artificial Sequence
  Synthetic oligonucleotide
tgtggataaatggccgaggtggaggagggataggt

SEQ ID NO: 14075 - DNA, 36 bp, Artificial Sequence
  Synthetic oligonucleotide
tccacctccagttcagttaatagagtccctctgcca

SEQ ID NO: 14076 - DNA, 35 bp, Artificial Sequence
  Synthetic oligonucleotide
tcgaacatctgtcacctcgctgaattgctcctttc

SEQ ID NO: 14077 - DNA, 37 bp, Artificial Sequence
  Synthetic oligonucleotide
atcacgcccttgccgccaactgccagacctccgcaaa

SEQ ID NO: 14078 - DNA, 35 bp, Artificial Sequence
  Synthetic oligonucleotide
gttcatacccccgctgatgcgccttttacgcctcg

SEQ ID NO: 14079 - DNA, 35 bp, Artificial Sequence
  Synthetic oligonucleotide
ttacctgccctgtgctccccacgttgtttcgtagg

SEQ ID NO: 14080 - DNA, 37 bp, Artificial Sequence
  Synthetic oligonucleotide
gctaacgcctcaaggtcatatctacctgcgcccacga

SEQ ID NO: 14081 - DNA, 35 bp, Artificial Sequence
  Synthetic oligonucleotide
aatgcagtgtcatccatatgctcccctgttccggc

SEQ ID NO: 14082 - DNA, 35 bp, Artificial Sequence
  Synthetic oligonucleotide
ggtggacgccaccctctctgttacgtatcccgctc

SEQ ID NO: 14083 - DNA, 35 bp, Artificial Sequence
  Synthetic oligonucleotide
tagcccacccctcactgacacgcgcctaccatacg

SEQ ID NO: 14084 - DNA, 37 bp, Artificial Sequence
  Synthetic oligonucleotide
ttccacccgcacagggtcatcaatgatcttccctcga

SEQ ID NO: 14085 - DNA, 36 bp, Artificial Sequence
  Synthetic oligonucleotide
accatgcctccttagttatcatcctccgtagacata

SEQ ID NO: 14086 - DNA, 35 bp, Artificial Sequence
  Synthetic oligonucleotide
gccgcaccgtaacttctttggctcacacatcggta

SEQ ID NO: 14087 - DNA, 35 bp, Artificial Sequence
  Synthetic oligonucleotide
ttgcacccgtcttttgcatcctttcatccctgcac

SEQ ID NO: 14088 - DNA, 35 bp, Artificial Sequence
  Synthetic oligonucleotide
gaagcaccctcctactgagccctatactcgtcctt

SEQ ID NO: 14089 - DNA, 36 bp, Artificial Sequence
  Synthetic oligonucleotide
ttatcatccgccccattgttacgacccaaccggaga

SEQ ID NO: 14090 - DNA, 37 bp, Artificial Sequence
  Synthetic oligonucleotide
aaaagagccagaatgaggggagggtcagagcggcgga

SEQ ID NO: 14091 - DNA, 37 bp, Artificial Sequence
  Synthetic oligonucleotide
actcctgccgtccctatcgccgtcgccatactaaaca

SEQ ID NO: 14092 - DNA, 35 bp, Artificial Sequence
  Synthetic oligonucleotide
tgcaccctatcacggtcttttcgatatacccagca

SEQ ID NO: 14093 - DNA, 36 bp, Artificial Sequence
  Synthetic oligonucleotide
gccctcccatcagtgctccctcaaatgtcgcgccta

SEQ ID NO: 14094 - DNA, 35 bp, Artificial Sequence
  Synthetic oligonucleotide
atctcacgtactagcttgcacgcccacccgttgaa

SEQ ID NO: 14095 - DNA, 35 bp, Artificial Sequence
  Synthetic oligonucleotide
actcccctcataggagggtattacacctcttgctt

SEQ ID NO: 14096 - DNA, 36 bp, Artificial Sequence
  Synthetic oligonucleotide
tcgatcctcatcacacaggctcgtatcgtactcaca

SEQ ID NO: 14097 - DNA, 35 bp, Artificial Sequence
  Synthetic oligonucleotide
tcatccaccgactaagggctttaaactgtcgacac

SEQ ID NO: 14098 - DNA, 35 bp, Artificial Sequence
  Synthetic oligonucleotide
tggagttcgctctgcctgctaccttgcctccggtg

SEQ ID NO: 14099 - DNA, 35 bp, Artificial Sequence
  Synthetic oligonucleotide
tatccactccggcgactaccacccgatgtcgcttt

SEQ ID NO: 14100 - DNA, 37 bp, Artificial Sequence
  Synthetic oligonucleotide
ggtgggggaggtcgggacgaaagattggataggctga

SEQ ID NO: 14101 - DNA, 35 bp, Artificial Sequence
  Synthetic oligonucleotide
ttgaaaatgcgccaatccgtgcccccgttgcctcc

SEQ ID NO: 14102 - DNA, 37 bp, Artificial Sequence
  Synthetic oligonucleotide
atccctgccctccgctcttggacccgaccgttaagga

SEQ ID NO: 14103 - DNA, 35 bp, Artificial Sequence
  Synthetic oligonucleotide
attgccatccgtacagcttccaaggccttgttcta

SEQ ID NO: 14104 - DNA, 35 bp, Artificial Sequence
  Synthetic oligonucleotide
tcactgtttcgacaccagccgtactctacccgcct

SEQ ID NO: 14105 - DNA, 35 bp, Artificial Sequence
  Synthetic oligonucleotide
tgaccacatcgcactctcttacaagcatcttcgaa

SEQ ID NO: 14106 - DNA, 36 bp, Artificial Sequence
  Synthetic oligonucleotide
ttgtgcgccgaccgcgttaccacttttttccgttaa

SEQ ID NO: 14107 - DNA, 38 bp, Artificial Sequence
  Synthetic oligonucleotide
taccacgaccacccatttactaataaactgcccattga

SEQ ID NO: 14108 - DNA, 37 bp, Artificial Sequence
  Synthetic oligonucleotide
atcactaccccgcccccatcgctaatgccgagactga

SEQ ID NO: 14109 - DNA, 35 bp, Artificial Sequence
  Synthetic oligonucleotide
agtcaccattcctctgtaaccacgcctatttactg

SEQ ID NO: 14110 - DNA, 35 bp, Artificial Sequence
  Synthetic oligonucleotide
tgtgagtgaggcgaataagatgggggctagggtgt

SEQ ID NO: 14111 - DNA, 36 bp, Artificial Sequence
  Synthetic oligonucleotide
gccatcctcactagaatcgcgaatgtgccctctcaa

SEQ ID NO: 14112 - DNA, 37 bp, Artificial Sequence
  Synthetic oligonucleotide
gccaggaggacagggaacagggggggattggagaaga

SEQ ID NO: 14113 - DNA, 35 bp, Artificial Sequence
  Synthetic oligonucleotide
atccgcccacttactcgttcggtgttgtgctacac

SEQ ID NO: 14114 - DNA, 35 bp, Artificial Sequence
  Synthetic oligonucleotide
gctcacaccgccgacgggtcgtttttgttatccac

SEQ ID NO: 14115 - DNA, 35 bp, Artificial Sequence
  Synthetic oligonucleotide
tcgcatggtcggcttacctcggaacacttcccccc

SEQ ID NO: 14116 - DNA, 35 bp, Artificial Sequence
  Synthetic oligonucleotide
tgcagactcttgttgctgtctcctgcgccgttatc

SEQ ID NO: 14117 - DNA, 35 bp, Artificial Sequence
  Synthetic oligonucleotide
gcttcaacctggccacagcacaccgacttgggtct

SEQ ID NO: 14118 - DNA, 36 bp, Artificial Sequence
  Synthetic oligonucleotide
tacacactgcctcccagctctaagggcttacataca

SEQ ID NO: 14119 - DNA, 35 bp, Artificial Sequence
  Synthetic oligonucleotide
tccacccagcccctgaccacgatctatcttagaga

SEQ ID NO: 14120 - DNA, 37 bp, Artificial Sequence
  Synthetic oligonucleotide
gtgtgggggaccaggagagaaaggacaatggcaggga

SEQ ID NO: 14121 - DNA, 38 bp, Artificial Sequence
  Synthetic oligonucleotide
accgatcgctcgttgtacttcgttgcctctcacactga

SEQ ID NO: 14122 - DNA, 35 bp, Artificial Sequence
  Synthetic oligonucleotide
atctccgccgttcatcggcctcactcaagagttcc

SEQ ID NO: 14123 - DNA, 36 bp, Artificial Sequence
  Synthetic oligonucleotide
actgccaccggacaacttaatcccacccttggtcca

SEQ ID NO: 14124 - DNA, 35 bp, Artificial Sequence
  Synthetic oligonucleotide
ttcaccggctctctctccactttgcccgcctgcgc

SEQ ID NO: 14125 - DNA, 35 bp, Artificial Sequence
  Synthetic oligonucleotide
gttccgctcccgtgatctcatacgttcatacctgg

SEQ ID NO: 14126 - DNA, 37 bp, Artificial Sequence
  Synthetic oligonucleotide
tgcctgcacactagtattcactccccacctcagcgga

SEQ ID NO: 14127 - DNA, 37 bp, Artificial Sequence
  Synthetic oligonucleotide
gaagaagatgcatgggaacgcaaggatcagggaggga

SEQ ID NO: 14128 - DNA, 35 bp, Artificial Sequence
  Synthetic oligonucleotide
actacctctgccattttttgctggtcaatcattcc

SEQ ID NO: 14129 - DNA, 35 bp, Artificial Sequence
  Synthetic oligonucleotide
ttatgcctcaaccgactcgctcccgccttgtcaca

SEQ ID NO: 14130 - DNA, 36 bp, Artificial Sequence
  Synthetic oligonucleotide
ttgcacgccacaactctatatcctatgatccggcca

SEQ ID NO: 14131 - DNA, 35 bp, Artificial Sequence
  Synthetic oligonucleotide
tcctccgccaactggtgtctctactctctcagaaa

SEQ ID NO: 14132 - DNA, 36 bp, Artificial Sequence
  Synthetic oligonucleotide
actacctccatacagactgctttttgtttccgccca

SEQ ID NO: 14133 - DNA, 36 bp, Artificial Sequence
  Synthetic oligonucleotide
cccgccccacatggcaaacacggacctacatcccta

SEQ ID NO: 14134 - DNA, 35 bp, Artificial Sequence
  Synthetic oligonucleotide
actccaccactacagacttcctgcctgtcagcaaa

SEQ ID NO: 14135 - DNA, 35 bp, Artificial Sequence
  Synthetic oligonucleotide
tcatgcaacgtacgcccgtcaatccctttgcgcca

SEQ ID NO: 14136 - DNA, 36 bp, Artificial Sequence
  Synthetic oligonucleotide
atatgcctcccgcccgcctttagtccgttagttcca

SEQ ID NO: 14137 - DNA, 36 bp, Artificial Sequence
  Synthetic oligonucleotide
tcaatccccctggcatgttactaatcctccgttcta

SEQ ID NO: 14138 - DNA, 36 bp, Artificial Sequence
  Synthetic oligonucleotide
accccgttcgtggcgtaaaacgcacaactgccctta

SEQ ID NO: 14139 - DNA, 35 bp, Artificial Sequence
  Synthetic oligonucleotide
atgcccccgccttctacagcatgctagttatccgc

SEQ ID NO: 14140 - DNA, 35 bp, Artificial Sequence
  Synthetic oligonucleotide
gactcgggcgatcccttcccgctactgcgcaccca

SEQ ID NO: 14141 - DNA, 38 bp, Artificial Sequence
  Synthetic oligonucleotide
atcaccgacacttgattcatcgtactatctcatgttga

SEQ ID NO: 14142 - DNA, 35 bp, Artificial Sequence
  Synthetic oligonucleotide
accaccggctcttgacttgcctaccttttggacac

SEQ ID NO: 14143 - DNA, 35 bp, Artificial Sequence
  Synthetic oligonucleotide
agtgccctcagtaatccagctgtccgcttctaccc

SEQ ID NO: 14144 - DNA, 35 bp, Artificial Sequence
  Synthetic oligonucleotide
taaacctgccccccgactcatcgtcgccgcttagc

SEQ ID NO: 14145 - DNA, 35 bp, Artificial Sequence
  Synthetic oligonucleotide
tctcgattccagcgccccgatccggtcctctcgcg

SEQ ID NO: 14146 - DNA, 35 bp, Artificial Sequence
  Synthetic oligonucleotide
agttcgccccagtccgtccgactccttaccgctca

SEQ ID NO: 14147 - DNA, 36 bp, Artificial Sequence
  Synthetic oligonucleotide
acgagccctacgccttgaccggtccttgctttacta

SEQ ID NO: 14148 - DNA, 35 bp, Artificial Sequence
  Synthetic oligonucleotide
tgttgtgccccccatataccctcaggtgttttacc

SEQ ID NO: 14149 - DNA, 35 bp, Artificial Sequence
  Synthetic oligonucleotide
gcctcacctctcgcggttacttggtcaccactgcc

SEQ ID NO: 14150 - DNA, 36 bp, Artificial Sequence
  Synthetic oligonucleotide
acctctcccgcggtcacgagtgccatttacgcctca

SEQ ID NO: 14151 - DNA, 37 bp, Artificial Sequence
  Synthetic oligonucleotide
aatggtggtgggaggagggaccgagaggatgggaaga

SEQ ID NO: 14152 - DNA, 36 bp, Artificial Sequence
  Synthetic oligonucleotide
attgcccctcaattgcgactaccaatctcttccgca

SEQ ID NO: 14153 - DNA, 37 bp, Artificial Sequence
  Synthetic oligonucleotide
acccctgcgtcgttttccggcctcccacttcacgcga

SEQ ID NO: 14154 - DNA, 37 bp, Artificial Sequence
  Synthetic oligonucleotide
acctcccatgcacctccgttgttttgaaaatgacgga

SEQ ID NO: 14155 - DNA, 37 bp, Artificial Sequence
  Synthetic oligonucleotide
acacctcctgaccctatctgacccagtttttgtgtga

SEQ ID NO: 14156 - DNA, 35 bp, Artificial Sequence
  Synthetic oligonucleotide
tccgctgccacgccgcccgacaactaggtctccac

SEQ ID NO: 14157 - DNA, 35 bp, Artificial Sequence
  Synthetic oligonucleotide
gcccatgtgggcggaaccttgcaaccctggccccc

SEQ ID NO: 14158 - DNA, 35 bp, Artificial Sequence
  Synthetic oligonucleotide
tcaataccggaccgcttcacctcatgccactgccc

SEQ ID NO: 14159 - DNA, 35 bp, Artificial Sequence
  Synthetic oligonucleotide
tagcatccataccaatcacctgtcgttccttggcc

SEQ ID NO: 14160 - DNA, 36 bp, Artificial Sequence
  Synthetic oligonucleotide
gtcacctatcccgtcgtggccacccttcggacctca

SEQ ID NO: 14161 - DNA, 36 bp, Artificial Sequence
  Synthetic oligonucleotide
tgcactacgctttcaccgctttgacctgttacttca

SEQ ID NO: 14162 - DNA, 37 bp, Artificial Sequence
  Synthetic oligonucleotide
gtacactcgcccgcctcattctcccccctaacgggga

SEQ ID NO: 14163 - DNA, 38 bp, Artificial Sequence
  Synthetic oligonucleotide
aacgcccccacttatttcaaggacacctcacgctttga

SEQ ID NO: 14164 - DNA, 37 bp, Artificial Sequence
  Synthetic oligonucleotide
gtccgtcgctcgttgcaacttatcccatcctctcaga

SEQ ID NO: 14165 - DNA, 37 bp, Artificial Sequence
  Synthetic oligonucleotide
tccgaaccacgcagccccgacgcctactatctatcga

SEQ ID NO: 14166 - DNA, 35 bp, Artificial Sequence
  Synthetic oligonucleotide
acagacagcctatgcgcgctaaaatcctttccacc

SEQ ID NO: 14167 - DNA, 35 bp, Artificial Sequence
  Synthetic oligonucleotide
gcgctcgcctcctctctatcgtctataatgtcccc

SEQ ID NO: 14168 - DNA, 35 bp, Artificial Sequence
  Synthetic oligonucleotide
gtggccccgcctgtttcatcattcgacttgtccgt

SEQ ID NO: 14169 - DNA, 37 bp, Artificial Sequence
  Synthetic oligonucleotide
tatcccgcataaccataagccacgtcctctcccgaga

SEQ ID NO: 14170 - DNA, 36 bp, Artificial Sequence
  Synthetic oligonucleotide
accactcgctcttcgcctttcaccccaccttgagga

SEQ ID NO: 14171 - DNA, 37 bp, Artificial Sequence
  Synthetic oligonucleotide
taggaagtgacgaggatagggcggtgacggtgaggga

SEQ ID NO: 14172 - DNA, 37 bp, Artificial Sequence
  Synthetic oligonucleotide
tacgcaccctaggccctccactccaaagtcctctgga

SEQ ID NO: 14173 - DNA, 35 bp, Artificial Sequence
  Synthetic oligonucleotide
gcctcgtgaactctgctgttacatccttgcgtgac

SEQ ID NO: 14174 - DNA, 35 bp, Artificial Sequence
  Synthetic oligonucleotide
ggttgacaccccgttctttcgttgcattaataccg

SEQ ID NO: 14175 - DNA, 35 bp, Artificial Sequence
  Synthetic oligonucleotide
gccacacgcgcccgttccggtaacagcctcgccat

SEQ ID NO: 14176 - DNA, 35 bp, Artificial Sequence
  Synthetic oligonucleotide
gcctccccatagctagtttgtcactgcctcgatct

SEQ ID NO: 14177 - DNA, 37 bp, Artificial Sequence
  Synthetic oligonucleotide
acgcacatcatggacctcgacccctattctccccgga

SEQ ID NO: 14178 - DNA, 36 bp, Artificial Sequence
  Synthetic oligonucleotide
gtaccatcgttctacagctcttcccactagttgtga

SEQ ID NO: 14179 - DNA, 35 bp, Artificial Sequence
  Synthetic oligonucleotide
agccaggtaggctcatcgtatccgttatctctccg

SEQ ID NO: 14180 - DNA, 35 bp, Artificial Sequence
  Synthetic oligonucleotide
tcctccaccctctgaattgttttaagtccactcat

SEQ ID NO: 14181 - DNA, 38 bp, Artificial Sequence
  Synthetic oligonucleotide
gacacggacgggggggggaggctaaggcccacgggtga

SEQ ID NO: 14182 - DNA, 37 bp, Artificial Sequence
  Synthetic oligonucleotide
gtaggtgacgatgagggggaaaaatgaaggggaatga

SEQ ID NO: 14183 - DNA, 35 bp, Artificial Sequence
  Synthetic oligonucleotide
ggatagccactctgtctattttgatccttgttagc

SEQ ID NO: 14184 - DNA, 38 bp, Artificial Sequence
  Synthetic oligonucleotide
gatcgcacagcatgttgccgccctcgaatgatttctga

SEQ ID NO: 14185 - DNA, 35 bp, Artificial Sequence
  Synthetic oligonucleotide
gagccccgcgcagtacactctacttccgcgactcc

SEQ ID NO: 14186 - DNA, 35 bp, Artificial Sequence
  Synthetic oligonucleotide
atgcgagcacacgcaccccatcgataaactccaca

SEQ ID NO: 14187 - DNA, 36 bp, Artificial Sequence
  Synthetic oligonucleotide
gcactagtcacggtaacactccaccaacgctgctga

SEQ ID NO: 14188 - DNA, 37 bp, Artificial Sequence
  Synthetic oligonucleotide
gttcagttggcgccatgtctgcacactctcatcttga

SEQ ID NO: 14189 - DNA, 36 bp, Artificial Sequence
  Synthetic oligonucleotide
tgtgaccatcctgactcatattgcgaattatttcta

SEQ ID NO: 14190 - DNA, 35 bp, Artificial Sequence
  Synthetic oligonucleotide
ttcagtcacacgcttagcacacattttagcctatc

SEQ ID NO: 14191 - DNA, 35 bp, Artificial Sequence
  Synthetic oligonucleotide
ggaatggcgcactcatcgacacaccgtccttcccg

SEQ ID NO: 14192 - DNA, 35 bp, Artificial Sequence
  Synthetic oligonucleotide
tcctacttacgcagccaccgaatttctctccgctg

SEQ ID NO: 14193 - DNA, 35 bp, Artificial Sequence
  Synthetic oligonucleotide
gttcgaagctcagcagctcggtgtccgccttcctt

SEQ ID NO: 14194 - DNA, 35 bp, Artificial Sequence
  Synthetic oligonucleotide
accatcgatcctgccccacactgcccaggtgcgtt

SEQ ID NO: 14195 - DNA, 35 bp, Artificial Sequence
  Synthetic oligonucleotide
atacccgtctggtgtcactcccggttgtacttccc

SEQ ID NO: 14196 - DNA, 36 bp, Artificial Sequence
  Synthetic oligonucleotide
gtcccccccgtcccactgagttttctttgcgttcga

SEQ ID NO: 14197 - DNA, 38 bp, Artificial Sequence
  Synthetic oligonucleotide
gcgcaccgaactgctctcatactcccgccgtcgcttga

SEQ ID NO: 14198 - DNA, 35 bp, Artificial Sequence
  Synthetic oligonucleotide
tacgccagttgcgtttttgcccgtttcactctcgt

SEQ ID NO: 14199 - DNA, 36 bp, Artificial Sequence
  Synthetic oligonucleotide
acgcgttgggaggcaatacgtggaaggggggagaaa

SEQ ID NO: 14200 - DNA, 36 bp, Artificial Sequence
  Synthetic oligonucleotide
tgcctgagcctgtctctcactacttgtcccgcctta

SEQ ID NO: 14201 - DNA, 36 bp, Artificial Sequence
  Synthetic oligonucleotide
tgcgcctcaccctagctatgttgaactacccgttac

SEQ ID NO: 14202 - DNA, 35 bp, Artificial Sequence
  Synthetic oligonucleotide
ttcgcacttgcaatcagttcttccaatgctccctc

SEQ ID NO: 14203 - DNA, 35 bp, Artificial Sequence
  Synthetic oligonucleotide
tcaacaccactcatgctgcatatggaaccttcact

SEQ ID NO: 14204 - DNA, 36 bp, Artificial Sequence
  Synthetic oligonucleotide
gtacgcgccccactcagtcttccgcgcacgatttca

SEQ ID NO: 14205 - DNA, 37 bp, Artificial Sequence
  Synthetic oligonucleotide
gcgctaccccttgcggtgtcatcatactacatctcga

SEQ ID NO: 14206 - DNA, 37 bp, Artificial Sequence
  Synthetic oligonucleotide
atgcgccgtccctcacttatctcgccgctctgacgga

SEQ ID NO: 14207 - DNA, 37 bp, Artificial Sequence
  Synthetic oligonucleotide
atggtggggaggacggaggatggaccggccgtaatga

SEQ ID NO: 14208 - DNA, 38 bp, Artificial Sequence
  Synthetic oligonucleotide
tgtcccggcacagggttacctggcgtcatactctctga

SEQ ID NO: 14209 - DNA, 38 bp, Artificial Sequence
  Synthetic oligonucleotide
gtgtggagcaggtagttaggacggagtgtgggtggtga

SEQ ID NO: 14210 - DNA, 37 bp, Artificial Sequence
  Synthetic oligonucleotide
aaaggggggggaggaggtggtaggtaacggtatttga

SEQ ID NO: 14211 - DNA, 35 bp, Artificial Sequence
  Synthetic oligonucleotide
gacgacctcatcttatctgcggccgagctccacta

SEQ ID NO: 14212 - DNA, 35 bp, Artificial Sequence
  Synthetic oligonucleotide
ttgaccatcggcgtcactcaagtcttcccaccgcc

SEQ ID NO: 14213 - DNA, 35 bp, Artificial Sequence
  Synthetic oligonucleotide
atcagccttggtgccccccctgttaatcctgctag

SEQ ID NO: 14214 - DNA, 36 bp, Artificial Sequence
  Synthetic oligonucleotide
atcaccatattgtgcacctactccgtgtctacatca

SEQ ID NO: 14215 - DNA, 36 bp, Artificial Sequence
  Synthetic oligonucleotide
aacactcagctggtcaccgaactggttttgccttca

SEQ ID NO: 14216 - DNA, 35 bp, Artificial Sequence
  Synthetic oligonucleotide
atgccgatagcgcaacccacagccacacttcaacc

SEQ ID NO: 14217 - DNA, 35 bp, Artificial Sequence
  Synthetic oligonucleotide
tcataccgtacgctgctgcggacctcggtcttcct

SEQ ID NO: 14218 - DNA, 35 bp, Artificial Sequence
  Synthetic oligonucleotide
ggagcacgccctcaactgtctttctatccctataa

SEQ ID NO: 14219 - DNA, 36 bp, Artificial Sequence
  Synthetic oligonucleotide
ttgtcacccgcatttgcctttacattagccctccga

SEQ ID NO: 14220 - DNA, 35 bp, Artificial Sequence
  Synthetic oligonucleotide
gacgggaaggggaagaaggaacgtgaatgtactgg

SEQ ID NO: 14221 - DNA, 35 bp, Artificial Sequence
  Synthetic oligonucleotide
tgctgagcacgtttttagtttcatcaccctgttct

SEQ ID NO: 14222 - DNA, 35 bp, Artificial Sequence
  Synthetic oligonucleotide
acactcgccaagcgcagcactcacaactccctctt

SEQ ID NO: 14223 - DNA, 33 bp, Artificial Sequence
  Synthetic oligonucleotide
tccggagtcgactcgtacgcactatcacctacc

SEQ ID NO: 14224 - DNA, 35 bp, Artificial Sequence
  Synthetic oligonucleotide
tccccacgttgtctatcagccagcgccactttccc

SEQ ID NO: 14225 - DNA, 35 bp, Artificial Sequence
  Synthetic oligonucleotide
tcacccgccgtgcacttagggtctactacccactc

SEQ ID NO: 14226 - DNA, 35 bp, Artificial Sequence
  Synthetic oligonucleotide
acccgacccccctgacgtttgccgtgcaatttcgt

SEQ ID NO: 14227 - DNA, 36 bp, Artificial Sequence
  Synthetic oligonucleotide
gcaccggtagcttgggtctcctttacacatctgcaa

SEQ ID NO: 14228 - DNA, 37 bp, Artificial Sequence
  Synthetic oligonucleotide
gagccgcaacggtaggggaatcgaagggtgggttgga

SEQ ID NO: 14229 - DNA, 36 bp, Artificial Sequence
  Synthetic oligonucleotide
tgcttcgccgccaccgcccccaaagtgccacggtta

SEQ ID NO: 14230 - DNA, 35 bp, Artificial Sequence
  Synthetic oligonucleotide
gtgtcagccccgacccgtgttttccgccgcactgt

SEQ ID NO: 14231 - DNA, 36 bp, Artificial Sequence
  Synthetic oligonucleotide
tctcggactacctaacgtgcacgatcccttcctgtt

SEQ ID NO: 14232 - DNA, 36 bp, Artificial Sequence
  Synthetic oligonucleotide
gacacactgtccagcgctctttggcctttaccacca

SEQ ID NO: 14233 - DNA, 36 bp, Artificial Sequence
  Synthetic oligonucleotide
agccgccggctacgtcttccccgcacatactagtca

SEQ ID NO: 14234 - DNA, 38 bp, Artificial Sequence
  Synthetic oligonucleotide
gagccgttcctgcccggtattcacatcttgcaatctga

SEQ ID NO: 14235 - DNA, 35 bp, Artificial Sequence
  Synthetic oligonucleotide
tgtcctgttccccccgcttggctgccttacttgtc

SEQ ID NO: 14236 - DNA, 35 bp, Artificial Sequence
  Synthetic oligonucleotide
gtcctcgcacagcacttggcacattacaaccctgg

SEQ ID NO: 14237 - DNA, 35 bp, Artificial Sequence
  Synthetic oligonucleotide
tccacgtccccactccctccaggctctttgaagaa

SEQ ID NO: 14238 - DNA, 35 bp, Artificial Sequence
  Synthetic oligonucleotide
tcatgccctcccctgctcagctattgcttccacga

SEQ ID NO: 14239 - DNA, 36 bp, Artificial Sequence
  Synthetic oligonucleotide
gtctctactgccctcctcgccgtgacgatttacgta

SEQ ID NO: 14240 - DNA, 37 bp, Artificial Sequence
  Synthetic oligonucleotide
tccagccacatctcctctgcttaacggatgcccatga

SEQ ID NO: 14241 - DNA, 37 bp, Artificial Sequence
  Synthetic oligonucleotide
gcaccagcccttacctctacagcccagccagcattga

SEQ ID NO: 14242 - DNA, 37 bp, Artificial Sequence
  Synthetic oligonucleotide
tacacacccctgcaactgacacatcctcggacgggga

SEQ ID NO: 14243 - DNA, 35 bp, Artificial Sequence
  Synthetic oligonucleotide
tcatgccgactgcccggttgaatccatttcatttc

SEQ ID NO: 14244 - DNA, 37 bp, Artificial Sequence
  Synthetic oligonucleotide
gaatggggaaggtacggtaagaagataaggctgcaga

SEQ ID NO: 14245 - DNA, 37 bp, Artificial Sequence
  Synthetic oligonucleotide
tcatcggcacgccctgaacacgtacctcctgcctcga

SEQ ID NO: 14246 - DNA, 38 bp, Artificial Sequence
  Synthetic oligonucleotide
gatgcccaggtgccgcccctgctttcctcttgtaatga

SEQ ID NO: 14247 - DNA, 37 bp, Artificial Sequence
  Synthetic oligonucleotide
ttgtcatccactctcgcccagttcctttttggtccga

SEQ ID NO: 14248 - DNA, 36 bp, Artificial Sequence
  Synthetic oligonucleotide
gctaccgatcgctgttccctgacccatcccatgcga

SEQ ID NO: 14249 - DNA, 37 bp, Artificial Sequence
  Synthetic oligonucleotide
taccgttgccctcctgctggttcacctcccaaatgga

SEQ ID NO: 14250 - DNA, 35 bp, Artificial Sequence
  Synthetic oligonucleotide
gacaccacccggctgtgggttcgcctccttcacta

SEQ ID NO: 14251 - DNA, 36 bp, Artificial Sequence
  Synthetic oligonucleotide
tgacagagcacagcacctccacttgtctcccggtta

SEQ ID NO: 14252 - DNA, 35 bp, Artificial Sequence
  Synthetic oligonucleotide
gtacgactgagtgcctgtccatttccgtattcctg

SEQ ID NO: 14253 - DNA, 35 bp, Artificial Sequence
  Synthetic oligonucleotide
gcacaagtgtactgtcccgttgactgccccgcccc

SEQ ID NO: 14254 - DNA, 35 bp, Artificial Sequence
  Synthetic oligonucleotide
tacacacccagcgcacccctggtaatataatgttc

SEQ ID NO: 14255 - DNA, 35 bp, Artificial Sequence
  Synthetic oligonucleotide
agtcaacgcggccacaaatttacccaccctccgag

SEQ ID NO: 14256 - DNA, 37 bp, Artificial Sequence
  Synthetic oligonucleotide
tgcgaacaccgacctccacatcttgcccgccttgcga

SEQ ID NO: 14257 - DNA, 36 bp, Artificial Sequence
  Synthetic oligonucleotide
gcttgacagacgtatctaccatctgctccctcttga

SEQ ID NO: 14258 - DNA, 35 bp, Artificial Sequence
  Synthetic oligonucleotide
tgcgccgtcgccgcttccacatcgctccgtttacg

SEQ ID NO: 14259 - DNA, 37 bp, Artificial Sequence
  Synthetic oligonucleotide
gaccagcatccgtaccaccaacatctctccgcctgga

SEQ ID NO: 14260 - DNA, 36 bp, Artificial Sequence
  Synthetic oligonucleotide
gtcggacggccctcacacttagctatgcatcaccta

SEQ ID NO: 14261 - DNA, 36 bp, Artificial Sequence
  Synthetic oligonucleotide
acccttcgcaccgtgctgacctccacctacggccta

SEQ ID NO: 14262 - DNA, 36 bp, Artificial Sequence
  Synthetic oligonucleotide
atgcggcacccagcacctcttgttcacgttttggca

SEQ ID NO: 14263 - DNA, 35 bp, Artificial Sequence
  Synthetic oligonucleotide
gccactgcgcactccgcatgtcacaacatctactg

SEQ ID NO: 14264 - DNA, 35 bp, Artificial Sequence
  Synthetic oligonucleotide
acttggcggtctcaccatcgtttcctccgtttttg

SEQ ID NO: 14265 - DNA, 35 bp, Artificial Sequence
  Synthetic oligonucleotide
gctcacgaactcgcacgccatggacaccactccct

SEQ ID NO: 14266 - DNA, 35 bp, Artificial Sequence
  Synthetic oligonucleotide
ggaacctacctgccaccgggaaacatgaccttcat

SEQ ID NO: 14267 - DNA, 35 bp, Artificial Sequence
  Synthetic oligonucleotide
cacaggacactgccgtttatacttacctctcttcc

SEQ ID NO: 14268 - DNA, 35 bp, Artificial Sequence
  Synthetic oligonucleotide
accgaaccgccgcacaccatccagtaatctcgtgt

SEQ ID NO: 14269 - DNA, 35 bp, Artificial Sequence
  Synthetic oligonucleotide
acaccctgactccagagccccgcctcctttcacca

SEQ ID NO: 14270 - DNA, 35 bp, Artificial Sequence
  Synthetic oligonucleotide
acccctatcccgaccctgcggcacccccgctgact

SEQ ID NO: 14271 - DNA, 35 bp, Artificial Sequence
  Synthetic oligonucleotide
ttacccaaacgctgacttgatacgatcccgctgac

SEQ ID NO: 14272 - DNA, 35 bp, Artificial Sequence
  Synthetic oligonucleotide
gtggtaatcgggaaccggattagggtgggaaaggg

SEQ ID NO: 14273 - DNA, 37 bp, Artificial Sequence
  Synthetic oligonucleotide
tcgagccgccatgacttcatttacctccctcactgga

SEQ ID NO: 14274 - DNA, 35 bp, Artificial Sequence
  Synthetic oligonucleotide
tcgatcccgcctacatggtcccacgccacgtaaac

SEQ ID NO: 14275 - DNA, 35 bp, Artificial Sequence
  Synthetic oligonucleotide
ggtgtgtcccagttttctgcctgtcccattcgaac

SEQ ID NO: 14276 - DNA, 35 bp, Artificial Sequence
  Synthetic oligonucleotide
attgggcgccacctcattgcagtcccgccatccca

SEQ ID NO: 14277 - DNA, 38 bp, Artificial Sequence
  Synthetic oligonucleotide
gtcccgccagggctatacctatgcaatcacttccctga

SEQ ID NO: 14278 - DNA, 35 bp, Artificial Sequence
  Synthetic oligonucleotide
tgcgaaaagaccgcaagggatagggcgggggggcg

SEQ ID NO: 14279 - DNA, 36 bp, Artificial Sequence
  Synthetic oligonucleotide
aacccgcacccggtgatcccgtcccagtatctggca

SEQ ID NO: 14280 - DNA, 36 bp, Artificial Sequence
  Synthetic oligonucleotide
gagataccactccatttgcttacgacccatgttgca

SEQ ID NO: 14281 - DNA, 37 bp, Artificial Sequence
  Synthetic oligonucleotide
tcgagggactgtaggcacgggggaaggaagtgaagga

SEQ ID NO: 14282 - DNA, 35 bp, Artificial Sequence
  Synthetic oligonucleotide
ggccggacaggtcattgccatccaccaccacgctg

SEQ ID NO: 14283 - DNA, 35 bp, Artificial Sequence
  Synthetic oligonucleotide
gttggctgtacgtcctgccatttttttctctcctg

SEQ ID NO: 14284 - DNA, 35 bp, Artificial Sequence
  Synthetic oligonucleotide
accacgccctagtcccgccggctcggtaacctttt

SEQ ID NO: 14285 - DNA, 37 bp, Artificial Sequence
  Synthetic oligonucleotide
tatcatcccgacacccctgctcagttcactctgggga

SEQ ID NO: 14286 - DNA, 35 bp, Artificial Sequence
  Synthetic oligonucleotide
atcgaaccccggtgaattggcgcccactactctgc

SEQ ID NO: 14287 - DNA, 35 bp, Artificial Sequence
  Synthetic oligonucleotide
gaggttatggtgggggggggacatgggagaataag

SEQ ID NO: 14288 - DNA, 35 bp, Artificial Sequence
  Synthetic oligonucleotide
acctgcctcccccactcataccagccggattggat

SEQ ID NO: 14289 - DNA, 36 bp, Artificial Sequence
  Synthetic oligonucleotide
gttgtaagccacaacccgcgagactgccctccttca

SEQ ID NO: 14290 - DNA, 38 bp, Artificial Sequence
  Synthetic oligonucleotide
gcgacacgaccacgcacacacgccctcaatggacttga

SEQ ID NO: 14291 - DNA, 36 bp, Artificial Sequence
  Synthetic oligonucleotide
aagccccgcctacctacggatctgtgcttcttccta

SEQ ID NO: 14292 - DNA, 35 bp, Artificial Sequence
  Synthetic oligonucleotide
gtctcctcccatgctgttttgtctggtccatttgc

SEQ ID NO: 14293 - DNA, 35 bp, Artificial Sequence
  Synthetic oligonucleotide
gcatggtgcggcctcctcgtttttctgcattttcg

SEQ ID NO: 14294 - DNA, 34 bp, Artificial Sequence
  Synthetic oligonucleotide
taccctcgacactagctgtaactgctctgttaat

SEQ ID NO: 14295 - DNA, 35 bp, Artificial Sequence
  Synthetic oligonucleotide
gacccacaggatatgcgcaggccccactgttccat

SEQ ID NO: 14296 - DNA, 35 bp, Artificial Sequence
  Synthetic oligonucleotide
agaacccgcaccccggatctgctcattaacttcct

SEQ ID NO: 14297 - DNA, 35 bp, Artificial Sequence
  Synthetic oligonucleotide
gcacttgctcgccgtgagcgcatctacgtacctct

SEQ ID NO: 14298 - DNA, 35 bp, Artificial Sequence
  Synthetic oligonucleotide
gtccactacgggccctgcctttccgactctttcga

SEQ ID NO: 14299 - DNA, 36 bp, Artificial Sequence
  Synthetic oligonucleotide
agcgccacccccagtcttgctttattccactggtta

SEQ ID NO: 14300 - DNA, 35 bp, Artificial Sequence
  Synthetic oligonucleotide
tacgtcccggctagccttgcctgagtccccacaac

SEQ ID NO: 14301 - DNA, 35 bp, Artificial Sequence
  Synthetic oligonucleotide
atgtgacacctacggacgcacgtgccctcccttaa

SEQ ID NO: 14302 - DNA, 37 bp, Artificial Sequence
  Synthetic oligonucleotide
tgacccccaccttagtagtccccctcccctgggctga

SEQ ID NO: 14303 - DNA, 35 bp, Artificial Sequence
  Synthetic oligonucleotide
tagtcacccgctcgcatttaacgctggtcacccat

SEQ ID NO: 14304 - DNA, 35 bp, Artificial Sequence
  Synthetic oligonucleotide
tcatcaccgccgcaaatcccgctttcctaccgggt

SEQ ID NO: 14305 - DNA, 35 bp, Artificial Sequence
  Synthetic oligonucleotide
ttgccggtaggccatacatttgtcctgtactctaa

SEQ ID NO: 14306 - DNA, 36 bp, Artificial Sequence
  Synthetic oligonucleotide
gatcaccctctctgtaccaggaatcgcacttggcca

SEQ ID NO: 14307 - DNA, 37 bp, Artificial Sequence
  Synthetic oligonucleotide
gaccaacgcttccctgcctacggagtttcacttgcga

SEQ ID NO: 14308 - DNA, 37 bp, Artificial Sequence
  Synthetic oligonucleotide
gtgacggaaagtgggtgcgggggggagttaagtcaga

SEQ ID NO: 14309 - DNA, 34 bp, Artificial Sequence
  Synthetic oligonucleotide
tccccctggaaggacccgccgcccttcagagccc

SEQ ID NO: 14310 - DNA, 36 bp, Artificial Sequence
  Synthetic oligonucleotide
ttctggccccccctcgtgaagccttcctgccggtta

SEQ ID NO: 14311 - DNA, 37 bp, Artificial Sequence
  Synthetic oligonucleotide
tcacaccgtagccacgttcatcctttagcatagctga

SEQ ID NO: 14312 - DNA, 36 bp, Artificial Sequence
  Synthetic oligonucleotide
gtatgcgcacagccaaacgcacaacaccccccctta

SEQ ID NO: 14313 - DNA, 35 bp, Artificial Sequence
  Synthetic oligonucleotide
tacgctccacacgagctctattgggccttcaaaac

SEQ ID NO: 14314 - DNA, 35 bp, Artificial Sequence
  Synthetic oligonucleotide
gagtgatgaagtcaaggaggtaggaggtcgtagtg

SEQ ID NO: 14315 - DNA, 35 bp, Artificial Sequence
  Synthetic oligonucleotide
gacactgccgcccgctttcagctctctcggtctct

SEQ ID NO: 14316 - DNA, 35 bp, Artificial Sequence
  Synthetic oligonucleotide
tgttaccgcccacctgcattttaccggccgttgtc

SEQ ID NO: 14317 - DNA, 35 bp, Artificial Sequence
  Synthetic oligonucleotide
gatcccagctgtcatcttttcatgtaccctccgct

SEQ ID NO: 14318 - DNA, 35 bp, Artificial Sequence
  Synthetic oligonucleotide
tccaacaacccgtccacttcataggtctcagccca

SEQ ID NO: 14319 - DNA, 35 bp, Artificial Sequence
  Synthetic oligonucleotide
actggaccaaggcacagtaccaccctacgcccacc

SEQ ID NO: 14320 - DNA, 35 bp, Artificial Sequence
  Synthetic oligonucleotide
ggtgcgcatacctatgtgacctccatcaacctctc

SEQ ID NO: 14321 - DNA, 37 bp, Artificial Sequence
  Synthetic oligonucleotide
gctacgggtggagaatgggatggccggtttagggtga

SEQ ID NO: 14322 - DNA, 37 bp, Artificial Sequence
  Synthetic oligonucleotide
tcaccctgccatcttagtcgccctcgccacccattga

SEQ ID NO: 14323 - DNA, 35 bp, Artificial Sequence
  Synthetic oligonucleotide
atatcccatcctgtctagttcgttcttgcctttag

SEQ ID NO: 14324 - DNA, 35 bp, Artificial Sequence
  Synthetic oligonucleotide
gccggctacggcaaaccgccattctgttcctacct

SEQ ID NO: 14325 - DNA, 36 bp, Artificial Sequence
  Synthetic oligonucleotide
tgccgccatcgcttcgtggccactacctagcctgca

SEQ ID NO: 14326 - DNA, 38 bp, Artificial Sequence
  Synthetic oligonucleotide
gtagtccagtcgtactgctttttgtgcctcccctgtga

SEQ ID NO: 14327 - DNA, 35 bp, Artificial Sequence
  Synthetic oligonucleotide
gactcctatgacgcaccgaccacgcccaccgcgcg

SEQ ID NO: 14328 - DNA, 35 bp, Artificial Sequence
  Synthetic oligonucleotide
gacacgcacgaaccgcccatgtaccacctccgttg

SEQ ID NO: 14329 - DNA, 35 bp, Artificial Sequence
  Synthetic oligonucleotide
gcccattcaagttggccctccccataccatactgt

SEQ ID NO: 14330 - DNA, 35 bp, Artificial Sequence
  Synthetic oligonucleotide
gtggacggaaaggaaggctcgtggagaaggcaaaa

SEQ ID NO: 14331 - DNA, 36 bp, Artificial Sequence
  Synthetic oligonucleotide
gtcccctccacattgcccaccattgtaagtagaata

SEQ ID NO: 14332 - DNA, 35 bp, Artificial Sequence
  Synthetic oligonucleotide
tagtgctcacaatccgtctatttagtactcgcctc

SEQ ID NO: 14333 - DNA, 35 bp, Artificial Sequence
  Synthetic oligonucleotide
gcactagtccgtttcttgctttcgctcccccgtgg

SEQ ID NO: 14334 - DNA, 35 bp, Artificial Sequence
  Synthetic oligonucleotide
gaccacctcacccatcctcaagtagatgcacctat

SEQ ID NO: 14335 - DNA, 35 bp, Artificial Sequence
  Synthetic oligonucleotide
tgacatcatccaccagttgcctgcttctgttcctt

SEQ ID NO: 14336 - DNA, 36 bp, Artificial Sequence
  Synthetic oligonucleotide
tgtgccttcgccggttccgaatcgttgcccccacga

SEQ ID NO: 14337 - DNA, 35 bp, Artificial Sequence
  Synthetic oligonucleotide
acaccgatggtctctgtgtccagctgcacttcatc

SEQ ID NO: 14338 - DNA, 36 bp, Artificial Sequence
  Synthetic oligonucleotide
gaactctccgcccgactttagtccgaattctccgaa

SEQ ID NO: 14339 - DNA, 34 bp, Artificial Sequence
  Synthetic oligonucleotide
tcgtgccatcctcgcagagcgcctccatcctcca

SEQ ID NO: 14340 - DNA, 35 bp, Artificial Sequence
  Synthetic oligonucleotide
tatgcttggcccatcgaccgtccttcctcctcatg

SEQ ID NO: 14341 - DNA, 35 bp, Artificial Sequence
  Synthetic oligonucleotide
tctcacacaatcaggacgttttttatccattcatg

SEQ ID NO: 14342 - DNA, 36 bp, Artificial Sequence
  Synthetic oligonucleotide
tcagccacctatccaccggttatctgtcgaccaaaa

SEQ ID NO: 14343 - DNA, 37 bp, Artificial Sequence
  Synthetic oligonucleotide
gatcgccctccactgccgtgaataattcatgtaccga

SEQ ID NO: 14344 - DNA, 38 bp, Artificial Sequence
  Synthetic oligonucleotide
ggttacatcgcccacctctcgtcccactcagatgctga

SEQ ID NO: 14345 - DNA, 37 bp, Artificial Sequence
  Synthetic oligonucleotide
acacctccatccagtttggccttacgatcagccatga

SEQ ID NO: 14346 - DNA, 35 bp, Artificial Sequence
  Synthetic oligonucleotide
tgtgagcgcatacatttcgttattatcttgcccgg

SEQ ID NO: 14347 - DNA, 36 bp, Artificial Sequence
  Synthetic oligonucleotide
gctcccgcggggcgcccactcttctccccgtcccaa

SEQ ID NO: 14348 - DNA, 36 bp, Artificial Sequence
  Synthetic oligonucleotide
aatgcgagcagtgctgcctccattccaccccacgca

SEQ ID NO: 14349 - DNA, 36 bp, Artificial Sequence
  Synthetic oligonucleotide
tatgcgcattgtgctttgtcttcctagcccttctca

SEQ ID NO: 14350 - DNA, 36 bp, Artificial Sequence
  Synthetic oligonucleotide
atggaggggaaaaacggaggtaatggactggatcta

SEQ ID NO: 14351 - DNA, 35 bp, Artificial Sequence
  Synthetic oligonucleotide
gtccaccacaacgcgcgggcatacaatttcgttcc

SEQ ID NO: 14352 - DNA, 35 bp, Artificial Sequence
  Synthetic oligonucleotide
tgaccatccagcccgccccttacacgtgaactgag

SEQ ID NO: 14353 - DNA, 35 bp, Artificial Sequence
  Synthetic oligonucleotide
gatgcgtagccgttttcccgcaatccctgagccct

SEQ ID NO: 14354 - DNA, 36 bp, Artificial Sequence
  Synthetic oligonucleotide
tcactacaccgcgaggtccacgcacctgattcctta

SEQ ID NO: 14355 - DNA, 35 bp, Artificial Sequence
  Synthetic oligonucleotide
gcctcccaacccgataccgccgcgaattgtcaacc

SEQ ID NO: 14356 - DNA, 35 bp, Artificial Sequence
  Synthetic oligonucleotide
tgacccccaattgctgaacctacagcgatctttcc

SEQ ID NO: 14357 - DNA, 35 bp, Artificial Sequence
  Synthetic oligonucleotide
ttgcggtcccatcctaggcgaatccgctttgtttc

SEQ ID NO: 14358 - DNA, 36 bp, Artificial Sequence
  Synthetic oligonucleotide
gacgaggtccacgcgcgcgctttccatacttaccat

SEQ ID NO: 14359 - DNA, 35 bp, Artificial Sequence
  Synthetic oligonucleotide
tcgatactgccttgccccgccgggacacctcactt

SEQ ID NO: 14360 - DNA, 37 bp, Artificial Sequence
  Synthetic oligonucleotide
acccaccgccatcaccacattgcagttaattactcga

SEQ ID NO: 14361 - DNA, 36 bp, Artificial Sequence
  Synthetic oligonucleotide
tgaccacttgccgatcctagctccagcctaatttga

SEQ ID NO: 14362 - DNA, 35 bp, Artificial Sequence
  Synthetic oligonucleotide
accatccctcaacgactgtatcgagctccattagc

SEQ ID NO: 14363 - DNA, 35 bp, Artificial Sequence
  Synthetic oligonucleotide
ttactgtgttccgtttgcccatgcccatcactcgc

SEQ ID NO: 14364 - DNA, 34 bp, Artificial Sequence
  Synthetic oligonucleotide
ttgagcctcctactgcatacttcatctgttattg

SEQ ID NO: 14365 - DNA, 35 bp, Artificial Sequence
  Synthetic oligonucleotide
ccacgacgtgcctattgaacaggaacgaacttaat

SEQ ID NO: 14366 - DNA, 35 bp, Artificial Sequence
  Synthetic oligonucleotide
tctcaccctgatcctggcctcctttatgctgcaca

SEQ ID NO: 14367 - DNA, 36 bp, Artificial Sequence
  Synthetic oligonucleotide
acacgccacattttgaactcgcacacggctaacgca

SEQ ID NO: 14368 - DNA, 35 bp, Artificial Sequence
  Synthetic oligonucleotide
tgctgccccgtcatttcctgcgccgtttcgatata

SEQ ID NO: 14369 - DNA, 35 bp, Artificial Sequence
  Synthetic oligonucleotide
tcactcccattgtttgcttcgagtcacttaacttc

SEQ ID NO: 14370 - DNA, 35 bp, Artificial Sequence
  Synthetic oligonucleotide
gtaggagtgcgggagaactgggtggggaaaggaag

SEQ ID NO: 14371 - DNA, 35 bp, Artificial Sequence
  Synthetic oligonucleotide
aacatcctgccccccacgccgaagccgaacgcctg

SEQ ID NO: 14372 - DNA, 35 bp, Artificial Sequence
  Synthetic oligonucleotide
gacccgtcggaattgggggggaggggggaggaagt

SEQ ID NO: 14373 - DNA, 35 bp, Artificial Sequence
  Synthetic oligonucleotide
gcccataccgcccgacctgtagcccgtcccgggca

SEQ ID NO: 14374 - DNA, 36 bp, Artificial Sequence
  Synthetic oligonucleotide
taccgtgccgcctgccctctcttgttcagcttcata

SEQ ID NO: 14375 - DNA, 35 bp, Artificial Sequence
  Synthetic oligonucleotide
tgacgcaagacccgtcacgtccaatctgacccacc

SEQ ID NO: 14376 - DNA, 35 bp, Artificial Sequence
  Synthetic oligonucleotide
gtccctcgactgtccccccttctgaccatctttcg

SEQ ID NO: 14377 - DNA, 35 bp, Artificial Sequence
  Synthetic oligonucleotide
gagggaagagaggaagtggcgtagtgtccggtagt

SEQ ID NO: 14378 - DNA, 34 bp, Artificial Sequence
  Synthetic oligonucleotide
gaacctctgtcccaccgtgcttggtcccacccaa

SEQ ID NO: 14379 - DNA, 37 bp, Artificial Sequence
  Synthetic oligonucleotide
gatgcgcgaacacggggggaagggggtcgtgaatcga

SEQ ID NO: 14380 - DNA, 33 bp, Artificial Sequence
  Synthetic oligonucleotide
acagtcggccttcacataactcagccacacaac

SEQ ID NO: 14381 - DNA, 35 bp, Artificial Sequence
  Synthetic oligonucleotide
ccacgacgcactcgtacgcttacttcctcagtacc

SEQ ID NO: 14382 - DNA, 36 bp, Artificial Sequence
  Synthetic oligonucleotide
atgactggacaccgggtgtctagctatctttctcca

SEQ ID NO: 14383 - DNA, 36 bp, Artificial Sequence
  Synthetic oligonucleotide
attgccgcagacttaatcacatcttggatcctagca

SEQ ID NO: 14384 - DNA, 36 bp, Artificial Sequence
  Synthetic oligonucleotide
gcactcgccgaccatcaaatacccctttctccggga

SEQ ID NO: 14385 - DNA, 36 bp, Artificial Sequence
  Synthetic oligonucleotide
gacaaaccggtcattataagcccacgtacatccagc

SEQ ID NO: 14386 - DNA, 35 bp, Artificial Sequence
  Synthetic oligonucleotide
tgcctctcagcgcatcgaaccaccgtatctcatca

SEQ ID NO: 14387 - DNA, 37 bp, Artificial Sequence
  Synthetic oligonucleotide
acaccccgccacagtgatttccttctgaccgcacaga

SEQ ID NO: 14388 - DNA, 38 bp, Artificial Sequence
  Synthetic oligonucleotide
gagtgcgagcggaataggggggagtggggcggcattga

SEQ ID NO: 14389 - DNA, 38 bp, Artificial Sequence
  Synthetic oligonucleotide
gttcagcaacaattcacaaaaccgccggccttacttga

SEQ ID NO: 14390 - DNA, 35 bp, Artificial Sequence
  Synthetic oligonucleotide
accatcccccgcttaccgtcgaaacacctaaggcc

SEQ ID NO: 14391 - DNA, 36 bp, Artificial Sequence
  Synthetic oligonucleotide
agccgccgcatcgggaaacgccccactctctttcaa

SEQ ID NO: 14392 - DNA, 37 bp, Artificial Sequence
  Synthetic oligonucleotide
aactgcctggctctcatcttgtacaccttactcccga

SEQ ID NO: 14393 - DNA, 38 bp, Artificial Sequence
  Synthetic oligonucleotide
tccaccgccaggacatgttctacttctcgcttacctga

SEQ ID NO: 14394 - DNA, 35 bp, Artificial Sequence
  Synthetic oligonucleotide
gaacaaggaaaggaagggctaactacggcgacata

SEQ ID NO: 14395 - DNA, 35 bp, Artificial Sequence
  Synthetic oligonucleotide
atccaacccctcacctcgacaacagcatggggtac

SEQ ID NO: 14396 - DNA, 35 bp, Artificial Sequence
  Synthetic oligonucleotide
tacaccatccctttcctgacttcgagtactagtat

SEQ ID NO: 14397 - DNA, 35 bp, Artificial Sequence
  Synthetic oligonucleotide
tcattccacccctttcgtatagcgtgcgctgcaca

SEQ ID NO: 14398 - DNA, 35 bp, Artificial Sequence
  Synthetic oligonucleotide
gccataataccggatcggagtatgctacatcttcc

SEQ ID NO: 14399 - DNA, 37 bp, Artificial Sequence
  Synthetic oligonucleotide
atcctcgctcccaccattgaagttgagtctcctggga

SEQ ID NO: 14400 - DNA, 35 bp, Artificial Sequence
  Synthetic oligonucleotide
tgcgtgcacatctcttgggtcttttttcgccctga

SEQ ID NO: 14401 - DNA, 36 bp, Artificial Sequence
  Synthetic oligonucleotide
acgcccactcaggcttttttggtgtctctattctta

SEQ ID NO: 14402 - DNA, 38 bp, Artificial Sequence
  Synthetic oligonucleotide
atcgcctgagcctccccactttgtacatggtgccttga

SEQ ID NO: 14403 - DNA, 35 bp, Artificial Sequence
  Synthetic oligonucleotide
gacgtccatcgatcatgtctgctttctatatcccc

SEQ ID NO: 14404 - DNA, 35 bp, Artificial Sequence
  Synthetic oligonucleotide
acgtgacaccctgcaatttttgctctagcactctc

SEQ ID NO: 14405 - DNA, 34 bp, Artificial Sequence
  Synthetic oligonucleotide
gcatgcacatggattctttttgctacccctgtct

SEQ ID NO: 14406 - DNA, 35 bp, Artificial Sequence
  Synthetic oligonucleotide
gacccttgcccgccaccccgagtagtacagtacaa

SEQ ID NO: 14407 - DNA, 36 bp, Artificial Sequence
  Synthetic oligonucleotide
aacatacgcccgacgccccttaacagttgcgcctca

SEQ ID NO: 14408 - DNA, 37 bp, Artificial Sequence
  Synthetic oligonucleotide
tgctctccaccccccggtctgacatctcgttatgaga

SEQ ID NO: 14409 - DNA, 36 bp, Artificial Sequence
  Synthetic oligonucleotide
gttgccgccatatcccgatctcgccccgatcaacga

SEQ ID NO: 14410 - DNA, 37 bp, Artificial Sequence
  Synthetic oligonucleotide
ggaccacacgctagctagaataccgaaacaacgatga

SEQ ID NO: 14411 - DNA, 36 bp, Artificial Sequence
  Synthetic oligonucleotide
acccatgacaccttctcccatacgtccggtgacgta

SEQ ID NO: 14412 - DNA, 35 bp, Artificial Sequence
  Synthetic oligonucleotide
atcaatgcatcaccaccaccccatccgtctgtaga

SEQ ID NO: 14413 - DNA, 38 bp, Artificial Sequence
  Synthetic oligonucleotide
tgaggtggggcccggtggtggggtaaaaagggagatga

SEQ ID NO: 14414 - DNA, 35 bp, Artificial Sequence
  Synthetic oligonucleotide
gcccgcctgtcgtgctcatcctcccgttttgtgtc

SEQ ID NO: 14415 - DNA, 36 bp, Artificial Sequence
  Synthetic oligonucleotide
acccgcctaagtgcacacccggtctaaccctacaca

SEQ ID NO: 14416 - DNA, 36 bp, Artificial Sequence
  Synthetic oligonucleotide
gtgtctcgctcaacgtccactgacgccccccctcga

SEQ ID NO: 14417 - DNA, 38 bp, Artificial Sequence
  Synthetic oligonucleotide
tggtgggcggggcgggaggggagggagctcactgctga

SEQ ID NO: 14418 - DNA, 35 bp, Artificial Sequence
  Synthetic oligonucleotide
gaggagaaacggtggtggctggtgacggggtgcta

SEQ ID NO: 14419 - DNA, 36 bp, Artificial Sequence
  Synthetic oligonucleotide
tagaccagacgctccgagcatgccttccttcaactc

SEQ ID NO: 14420 - DNA, 36 bp, Artificial Sequence
  Synthetic oligonucleotide
tgcttacaccgtacaactggctcttccgattatcga

SEQ ID NO: 14421 - DNA, 36 bp, Artificial Sequence
  Synthetic oligonucleotide
acgcgtcgtgggcgaaaaggctagggaaggggggga

SEQ ID NO: 14422 - DNA, 35 bp, Artificial Sequence
  Synthetic oligonucleotide
ggtccgaccacctgtttgcatgggccccttgttct

SEQ ID NO: 14423 - DNA, 35 bp, Artificial Sequence
  Synthetic oligonucleotide
gccatctccctgaaatgagtgctccaattccccca

SEQ ID NO: 14424 - DNA, 37 bp, Artificial Sequence
  Synthetic oligonucleotide
acagccatcatcataccaatggcacactctttaacga

SEQ ID NO: 14425 - DNA, 35 bp, Artificial Sequence
  Synthetic oligonucleotide
acacatgagccccgagccctggaggatccacccga

SEQ ID NO: 14426 - DNA, 36 bp, Artificial Sequence
  Synthetic oligonucleotide
tgatgcacactccaccgtggtcggccaccatgttta

SEQ ID NO: 14427 - DNA, 35 bp, Artificial Sequence
  Synthetic oligonucleotide
gtactgccacacgcttctcccattcatttctaaga

SEQ ID NO: 14428 - DNA, 37 bp, Artificial Sequence
  Synthetic oligonucleotide
aactgacgccctgtttgcaaccgcctattcactctga

SEQ ID NO: 14429 - DNA, 35 bp, Artificial Sequence
  Synthetic oligonucleotide
gatttccgtaggctcacatcccttgtctttcgcac

SEQ ID NO: 14430 - DNA, 35 bp, Artificial Sequence
  Synthetic oligonucleotide
tcccgcacttccaaactgcctatgatctgttcgac

SEQ ID NO: 14431 - DNA, 35 bp, Artificial Sequence
  Synthetic oligonucleotide
gcgcaagtcataccccctccgctgcttttgaagcc

SEQ ID NO: 14432 - DNA, 35 bp, Artificial Sequence
  Synthetic oligonucleotide
atccaccaatcaaagtactctagcctgttgcctcg

SEQ ID NO: 14433 - DNA, 36 bp, Artificial Sequence
  Synthetic oligonucleotide
tcagacgatcagcagttcccacaaatggccacacga

SEQ ID NO: 14434 - DNA, 38 bp, Artificial Sequence
  Synthetic oligonucleotide
atcggggaggggttgaggtttgggacgggaatacttga

SEQ ID NO: 14435 - DNA, 35 bp, Artificial Sequence
  Synthetic oligonucleotide
taccgttcgcctgaaacgcattcacactgaggtcc

SEQ ID NO: 14436 - DNA, 35 bp, Artificial Sequence
  Synthetic oligonucleotide
gcaccccaactgtccagcctttcccacttgcaatg

SEQ ID NO: 14437 - DNA, 35 bp, Artificial Sequence
  Synthetic oligonucleotide
gatactcgcgacgctctgatttctcactgtacctg

SEQ ID NO: 14438 - DNA, 35 bp, Artificial Sequence
  Synthetic oligonucleotide
tcacgcgcgcgcttcattcctacacccgagccgct

SEQ ID NO: 14439 - DNA, 35 bp, Artificial Sequence
  Synthetic oligonucleotide
tttgacacgtctcatttggcctgtcactctatgct

SEQ ID NO: 14440 - DNA, 35 bp, Artificial Sequence
  Synthetic oligonucleotide
tcagttgcccccgttttttttgattgcgatgcttt

SEQ ID NO: 14441 - DNA, 38 bp, Artificial Sequence
  Synthetic oligonucleotide
gtcaccgtgccccttcgtctattaccgaccctgcatga

SEQ ID NO: 14442 - DNA, 38 bp, Artificial Sequence
  Synthetic oligonucleotide
ggagagggcacggattgggaggttgggtgggtcattga

SEQ ID NO: 14443 - DNA, 35 bp, Artificial Sequence
  Synthetic oligonucleotide
tcttgacagccgctgcttctctttcagtccctaac

SEQ ID NO: 14444 - DNA, 35 bp, Artificial Sequence
  Synthetic oligonucleotide
gtacgagcccctattcatgacgccccagcctgacc

SEQ ID NO: 14445 - DNA, 36 bp, Artificial Sequence
  Synthetic oligonucleotide
ttggccccacctacttagtgccattgcccatgccga

SEQ ID NO: 14446 - DNA, 35 bp, Artificial Sequence
  Synthetic oligonucleotide
ggtcactctcggtctatttccacggactcacctgc

SEQ ID NO: 14447 - DNA, 35 bp, Artificial Sequence
  Synthetic oligonucleotide
acagcgaccctccggtctttcgttgcgttccctgc

SEQ ID NO: 14448 - DNA, 35 bp, Artificial Sequence
  Synthetic oligonucleotide
tagacagccggtgcctcatcgatgctattcccatc

SEQ ID NO: 14449 - DNA, 34 bp, Artificial Sequence
  Synthetic oligonucleotide
accgccccctcgtgcgtgttggcgcccatgacca

SEQ ID NO: 14450 - DNA, 35 bp, Artificial Sequence
  Synthetic oligonucleotide
agccccagttggctcatgctccctggtaccaccca

SEQ ID NO: 14451 - DNA, 37 bp, Artificial Sequence
  Synthetic oligonucleotide
ggatgccaccgcccttacgaagcacacgtacccacga

SEQ ID NO: 14452 - DNA, 35 bp, Artificial Sequence
  Synthetic oligonucleotide
gcgcatcagttttacgccatctcgccgtttcccgc

SEQ ID NO: 14453 - DNA, 35 bp, Artificial Sequence
  Synthetic oligonucleotide
cacgacggattgtccgccccgctcatgaatgcctg

SEQ ID NO: 14454 - DNA, 35 bp, Artificial Sequence
  Synthetic oligonucleotide
gccgcactctcgactcgcgcatgacatcatcaaca

SEQ ID NO: 14455 - DNA, 37 bp, Artificial Sequence
  Synthetic oligonucleotide
gggggtagggtgggtcggggtgagagcgctgggacga

SEQ ID NO: 14456 - DNA, 35 bp, Artificial Sequence
  Synthetic oligonucleotide
tacaatcctcacattgccttctgccggtccctacg

SEQ ID NO: 14457 - DNA, 36 bp, Artificial Sequence
  Synthetic oligonucleotide
tccgcgcgagcccccgtcgctaaaccatcatgttaa

SEQ ID NO: 14458 - DNA, 37 bp, Artificial Sequence
  Synthetic oligonucleotide
agaggagggaggagaacacgataggagagacgagaga

SEQ ID NO: 14459 - DNA, 37 bp, Artificial Sequence
  Synthetic oligonucleotide
gcaccgcataccgtcgccattggccctctcgatttga

SEQ ID NO: 14460 - DNA, 36 bp, Artificial Sequence
  Synthetic oligonucleotide
actccttgtccctgtgatccacagtcttcgctccta

SEQ ID NO: 14461 - DNA, 36 bp, Artificial Sequence
  Synthetic oligonucleotide
gacacacccccatggttacaactcgactcagcccaa

SEQ ID NO: 14462 - DNA, 35 bp, Artificial Sequence
  Synthetic oligonucleotide
aatagcccgcacaccgctcctcccttgggctcgca

SEQ ID NO: 14463 - DNA, 35 bp, Artificial Sequence
  Synthetic oligonucleotide
tacgatgaccggccactcaaggaccccaccactga

SEQ ID NO: 14464 - DNA, 38 bp, Artificial Sequence
  Synthetic oligonucleotide
gagcacacactggtccctgcctcacctgccaccactga

SEQ ID NO: 14465 - DNA, 35 bp, Artificial Sequence
  Synthetic oligonucleotide
aagcccgctgtgcccactgatccgccgtgagtccc

SEQ ID NO: 14466 - DNA, 35 bp, Artificial Sequence
  Synthetic oligonucleotide
tggagtcgcacaagcagcttgactgcccacggctc

SEQ ID NO: 14467 - DNA, 35 bp, Artificial Sequence
  Synthetic oligonucleotide
agcacaccaccctcactagctcgacgcttctttgg

SEQ ID NO: 14468 - DNA, 35 bp, Artificial Sequence
  Synthetic oligonucleotide
tgctccggcgtccccatccctggcctttgatctgt

SEQ ID NO: 14469 - DNA, 35 bp, Artificial Sequence
  Synthetic oligonucleotide
ccactacgccttctacgccctccattcaggatgtt

SEQ ID NO: 14470 - DNA, 36 bp, Artificial Sequence
  Synthetic oligonucleotide
tgcacacgcctccgaccctgtcccatcagcaggcta

SEQ ID NO: 14471 - DNA, 35 bp, Artificial Sequence
  Synthetic oligonucleotide
actcccaggggtttccatctcagtattcttgcttc

SEQ ID NO: 14472 - DNA, 35 bp, Artificial Sequence
  Synthetic oligonucleotide
tctactgcacccgcgctgggacttaatccactctc

SEQ ID NO: 14473 - DNA, 35 bp, Artificial Sequence
  Synthetic oligonucleotide
ccgcgggtccgcaaatccactgcatacgccccttt

SEQ ID NO: 14474 - DNA, 35 bp, Artificial Sequence
  Synthetic oligonucleotide
gtcgcttcccacctggccctgtacggtgattttca

SEQ ID NO: 14475 - DNA, 37 bp, Artificial Sequence
  Synthetic oligonucleotide
ggagtgggagtgggggttggagagggagaagattgga

SEQ ID NO: 14476 - DNA, 35 bp, Artificial Sequence
  Synthetic oligonucleotide
tcctaaccaacagtggttttggtcttagtttaatc

SEQ ID NO: 14477 - DNA, 35 bp, Artificial Sequence
  Synthetic oligonucleotide
tcagacacccccaggcacatggtcggtctcatctt

SEQ ID NO: 14478 - DNA, 36 bp, Artificial Sequence
  Synthetic oligonucleotide
gtcgaacctcatggaaccgtctacctttcttttgca

SEQ ID NO: 14479 - DNA, 36 bp, Artificial Sequence
  Synthetic oligonucleotide
gtacccccgcccatccctccatagtaaccacggcta

SEQ ID NO: 14480 - DNA, 35 bp, Artificial Sequence
  Synthetic oligonucleotide
gccccccccttgtgttccttggcccccttgtctcg

SEQ ID NO: 14481 - DNA, 36 bp, Artificial Sequence
  Synthetic oligonucleotide
agaccagtaagcaaaaaggcaggaaggaggtagtaa

SEQ ID NO: 14482 - DNA, 37 bp, Artificial Sequence
  Synthetic oligonucleotide
tcacccaccgctccaatttctcgacgttgcatcggga

SEQ ID NO: 14483 - DNA, 37 bp, Artificial Sequence
  Synthetic oligonucleotide
gagtcacgcatattgcatctcaccctcactttcatga

SEQ ID NO: 14484 - DNA, 35 bp, Artificial Sequence
  Synthetic oligonucleotide
tcacatcccgaaacatcgacacctcaggcaattgc

SEQ ID NO: 14485 - DNA, 35 bp, Artificial Sequence
  Synthetic oligonucleotide
taggaggttgccgggagggcggggtaggaaaagag

SEQ ID NO: 14486 - DNA, 36 bp, Artificial Sequence
  Synthetic oligonucleotide
actggggaggtggagcgagctatcagggggatggta

SEQ ID NO: 14487 - DNA, 35 bp, Artificial Sequence
  Synthetic oligonucleotide
gacatagacgttccaccgtggcctggtctcccatc

SEQ ID NO: 14488 - DNA, 38 bp, Artificial Sequence
  Synthetic oligonucleotide
accttcgccgccctacgcctatgaccacaattctctga

SEQ ID NO: 14489 - DNA, 35 bp, Artificial Sequence
  Synthetic oligonucleotide
tgccatccccaggccgaccaatctttgtccctgtt

SEQ ID NO: 14490 - DNA, 35 bp, Artificial Sequence
  Synthetic oligonucleotide
ggagggaggggggtaaagggcgggcttgttgcgga

SEQ ID NO: 14491 - DNA, 38 bp, Artificial Sequence
  Synthetic oligonucleotide
gatgtcatcagtatcgttccccactgcttctgtcctga

SEQ ID NO: 14492 - DNA, 34 bp, Artificial Sequence
  Synthetic oligonucleotide
ttgttatgcccggtgaaacagtactccctccccc

SEQ ID NO: 14493 - DNA, 35 bp, Artificial Sequence
  Synthetic oligonucleotide
atgtccctaacccccgtacctgccgactgcatggc

SEQ ID NO: 14494 - DNA, 35 bp, Artificial Sequence
  Synthetic oligonucleotide
ggagtgcttacgaccttccgctccccattcgcctc

SEQ ID NO: 14495 - DNA, 36 bp, Artificial Sequence
  Synthetic oligonucleotide
ttggaaagggtggctgaggaccgtagggagggcgaa

SEQ ID NO: 14496 - DNA, 36 bp, Artificial Sequence
  Synthetic oligonucleotide
gttgtccacatcgctcttgacatagcccatgtttca

SEQ ID NO: 14497 - DNA, 37 bp, Artificial Sequence
  Synthetic oligonucleotide
tacacccatgcattttgccctgtatccacccattgga

SEQ ID NO: 14498 - DNA, 37 bp, Artificial Sequence
  Synthetic oligonucleotide
actcacccagaatgatccctccgttcctgcatactga

SEQ ID NO: 14499 - DNA, 35 bp, Artificial Sequence
  Synthetic oligonucleotide
acatccgtgcagactgatcacagtcggcttgtacc

SEQ ID NO: 14500 - DNA, 35 bp, Artificial Sequence
  Synthetic oligonucleotide
aatcgctgctccccaccaggcttaacagccacccc

SEQ ID NO: 14501 - DNA, 37 bp, Artificial Sequence
  Synthetic oligonucleotide
taacccccgcatctcggtgctctacttttgatctcga

SEQ ID NO: 14502 - DNA, 35 bp, Artificial Sequence
  Synthetic oligonucleotide
aagacccccgcgtctcagcccttatctcgcgtacc

SEQ ID NO: 14503 - DNA, 35 bp, Artificial Sequence
  Synthetic oligonucleotide
tccccatgatcgcttggtctcttcagaacactgtc

SEQ ID NO: 14504 - DNA, 35 bp, Artificial Sequence
  Synthetic oligonucleotide
gaacgggggaaattacggaagggcaagagggataa

SEQ ID NO: 14505 - DNA, 35 bp, Artificial Sequence
  Synthetic oligonucleotide
ttaactcacgccccaatgtttcgtttacccccccg

SEQ ID NO: 14506 - DNA, 37 bp, Artificial Sequence
  Synthetic oligonucleotide
gatcaccccctacaattttgcttatgacctgcttgga

SEQ ID NO: 14507 - DNA, 35 bp, Artificial Sequence
  Synthetic oligonucleotide
gcacattgcgcaaggtctcatgctgcttactttgc

SEQ ID NO: 14508 - DNA, 35 bp, Artificial Sequence
  Synthetic oligonucleotide
atgcgaggggtgagtcagggagaacggggaaatgt

SEQ ID NO: 14509 - DNA, 35 bp, Artificial Sequence
  Synthetic oligonucleotide
tgccgctcgtaacatcgtttactgcaacatctcct

SEQ ID NO: 14510 - DNA, 35 bp, Artificial Sequence
  Synthetic oligonucleotide
tagccaatacccctgctgctgacaactggattcct

SEQ ID NO: 14511 - DNA, 36 bp, Artificial Sequence
  Synthetic oligonucleotide
accacctcgtccgtccgacttagcttccacaggcca

SEQ ID NO: 14512 - DNA, 36 bp, Artificial Sequence
  Synthetic oligonucleotide
actccagctctcccctgtgcctcccgccttagctca

SEQ ID NO: 14513 - DNA, 38 bp, Artificial Sequence
  Synthetic oligonucleotide
ttcagcatcctgttccactccagcttgccccctgatga

SEQ ID NO: 14514 - DNA, 38 bp, Artificial Sequence
  Synthetic oligonucleotide
acgcgccacatactccccttctacacgcactccggtga

SEQ ID NO: 14515 - DNA, 36 bp, Artificial Sequence
  Synthetic oligonucleotide
atgtacaccgcgttacttgtcagcacttttttccaa

SEQ ID NO: 14516 - DNA, 38 bp, Artificial Sequence
  Synthetic oligonucleotide
gcaacgccctccttgtccttccccccagattggtctga

SEQ ID NO: 14517 - DNA, 35 bp, Artificial Sequence
  Synthetic oligonucleotide
tcctacaccgctttcccatcggggatccacctcgc

SEQ ID NO: 14518 - DNA, 35 bp, Artificial Sequence
  Synthetic oligonucleotide
gcgccgcctcttgcgcgagtactcatatcgttctc

SEQ ID NO: 14519 - DNA, 35 bp, Artificial Sequence
  Synthetic oligonucleotide
acactccccacgtctgtcccgggccgcctcactca

SEQ ID NO: 14520 - DNA, 37 bp, Artificial Sequence
  Synthetic oligonucleotide
tctccaactgtcggttgcgtgccccttggcctctaca

SEQ ID NO: 14521 - DNA, 37 bp, Artificial Sequence
  Synthetic oligonucleotide
aacggcggaagaggggggaatacggttaggggtgaga

SEQ ID NO: 14522 - DNA, 38 bp, Artificial Sequence
  Synthetic oligonucleotide
gcccacatcgcatgccttatccccctgaccttcactga

SEQ ID NO: 14523 - DNA, 38 bp, Artificial Sequence
  Synthetic oligonucleotide
gttgctgccccgactttgcacgcccttccatgttttga

SEQ ID NO: 14524 - DNA, 35 bp, Artificial Sequence
  Synthetic oligonucleotide
atcactggagagagggaggggaattataacgggta

SEQ ID NO: 14525 - DNA, 35 bp, Artificial Sequence
  Synthetic oligonucleotide
tataccccgccgtggagtcagtgtcacggccccac

SEQ ID NO: 14526 - DNA, 35 bp, Artificial Sequence
  Synthetic oligonucleotide
tcccatgcagctccttttgttaggccatgcctctc

SEQ ID NO: 14527 - DNA, 35 bp, Artificial Sequence
  Synthetic oligonucleotide
gcgttgcgcagtccaattcctctatgtcccagcct

SEQ ID NO: 14528 - DNA, 35 bp, Artificial Sequence
  Synthetic oligonucleotide
aatacctcgccgatgcattagccacatacgtcctt

SEQ ID NO: 14529 - DNA, 35 bp, Artificial Sequence
  Synthetic oligonucleotide
gcctcggccacatccgccgctctcacgtccccaac

SEQ ID NO: 14530 - DNA, 35 bp, Artificial Sequence
  Synthetic oligonucleotide
aaccagcgactactgctcactttgttccttccgtg

SEQ ID NO: 14531 - DNA, 35 bp, Artificial Sequence
  Synthetic oligonucleotide
gccactccactatacgtacctcgttccctacgtaa

SEQ ID NO: 14532 - DNA, 35 bp, Artificial Sequence
  Synthetic oligonucleotide
atgctgcgcactttgcttttctaatgccctcacca

SEQ ID NO: 14533 - DNA, 36 bp, Artificial Sequence
  Synthetic oligonucleotide
ttccgcccactctatcacataatagtcccaggccca

SEQ ID NO: 14534 - DNA, 37 bp, Artificial Sequence
  Synthetic oligonucleotide
gcaaacggggtggggcttactcacgggggatacggga

SEQ ID NO: 14535 - DNA, 34 bp, Artificial Sequence
  Synthetic oligonucleotide
ggtcgccgcactcttcgtctaatcggtgccttcc

SEQ ID NO: 14536 - DNA, 35 bp, Artificial Sequence
  Synthetic oligonucleotide
tagattgcccgtgctggcctcccaatacatccgaa

SEQ ID NO: 14537 - DNA, 37 bp, Artificial Sequence
  Synthetic oligonucleotide
taccccagcccgtgtatcgttttgatttccacctcga

SEQ ID NO: 14538 - DNA, 38 bp, Artificial Sequence
  Synthetic oligonucleotide
acagacctaactgctgtgctcctccaccgattcattga

SEQ ID NO: 14539 - DNA, 36 bp, Artificial Sequence
  Synthetic oligonucleotide
gattccgcggcgtcccccatcccgtcccgttctgcc

SEQ ID NO: 14540 - DNA, 35 bp, Artificial Sequence
  Synthetic oligonucleotide
gtacgacagggggaaaaacaaagagggtgaatcgg

SEQ ID NO: 14541 - DNA, 35 bp, Artificial Sequence
  Synthetic oligonucleotide
gagccgctaggccacgtagagaaagggagcacggg

SEQ ID NO: 14542 - DNA, 35 bp, Artificial Sequence
  Synthetic oligonucleotide
tcagggccccggtttgtcatttcttatacgtttct

SEQ ID NO: 14543 - DNA, 36 bp, Artificial Sequence
  Synthetic oligonucleotide
atgtaggtgaaatggggtgggagggagttggggcga

SEQ ID NO: 14544 - DNA, 38 bp, Artificial Sequence
  Synthetic oligonucleotide
ttcggaccaaacgttacttgcgttccatctttccgtga

SEQ ID NO: 14545 - DNA, 37 bp, Artificial Sequence
  Synthetic oligonucleotide
gatggaggaggagggactagggatctgtacgggaaga

SEQ ID NO: 14546 - DNA, 38 bp, Artificial Sequence
  Synthetic oligonucleotide
acggtcaagcccccacagcacactctccgcccgcatga

SEQ ID NO: 14547 - DNA, 38 bp, Artificial Sequence
  Synthetic oligonucleotide
gatgtgctcagccgcgtaccatgccgattaacttttga

SEQ ID NO: 14548 - DNA, 35 bp, Artificial Sequence
  Synthetic oligonucleotide
acgctgtgtacatcaaattgctgggcgctaccttc

SEQ ID NO: 14549 - DNA, 36 bp, Artificial Sequence
  Synthetic oligonucleotide
gcctgcacaccccatcagcccccatcctcaaggaga

SEQ ID NO: 14550 - DNA, 37 bp, Artificial Sequence
  Synthetic oligonucleotide
gtgccccatccttgacattatgctacgggccatgaga

SEQ ID NO: 14551 - DNA, 37 bp, Artificial Sequence
  Synthetic oligonucleotide
gccacgcaagggcgaggagagggaggggttgttgaga

SEQ ID NO: 14552 - DNA, 37 bp, Artificial Sequence
  Synthetic oligonucleotide
tatgccaccacacttttggccacaggttccctaacga

SEQ ID NO: 14553 - DNA, 38 bp, Artificial Sequence
  Synthetic oligonucleotide
tgacacccgcgattgccggccctttctcgtcccgttga

SEQ ID NO: 14554 - DNA, 35 bp, Artificial Sequence
  Synthetic oligonucleotide
tctagcgcgggaggagggggattgggctataggcg

SEQ ID NO: 14555 - DNA, 35 bp, Artificial Sequence
  Synthetic oligonucleotide
tcacaccttgttctcttgtctcccagtgcacctgg

SEQ ID NO: 14556 - DNA, 37 bp, Artificial Sequence
  Synthetic oligonucleotide
tactcgcttgcctctcttgttatcgcttctatcacga

SEQ ID NO: 14557 - DNA, 38 bp, Artificial Sequence
  Synthetic oligonucleotide
aattccgcccgaacgaatttgtgagccccttgccttga

SEQ ID NO: 14558 - DNA, 35 bp, Artificial Sequence
  Synthetic oligonucleotide
atcaaccccgggtcgcttataccggttcacaaccc

SEQ ID NO: 14559 - DNA, 35 bp, Artificial Sequence
  Synthetic oligonucleotide
gaggggcctggccactaccctatttacccatctgc

SEQ ID NO: 14560 - DNA, 36 bp, Artificial Sequence
  Synthetic oligonucleotide
tcaccactgcagattcctttacacgccgctgtaaca

SEQ ID NO: 14561 - DNA, 35 bp, Artificial Sequence
  Synthetic oligonucleotide
ttcccccgcactgactgtacagcctctatatctac

SEQ ID NO: 14562 - DNA, 35 bp, Artificial Sequence
  Synthetic oligonucleotide
tcaactcactgtcgcatcactacccaagaaccctc

SEQ ID NO: 14563 - DNA, 36 bp, Artificial Sequence
  Synthetic oligonucleotide
gtaaggggtgggaacaggtggtggtaattagtggat

SEQ ID NO: 14564 - DNA, 36 bp, Artificial Sequence
  Synthetic oligonucleotide
gaccactgcacgtccgaccttcaccctggaattgca

SEQ ID NO: 14565 - DNA, 35 bp, Artificial Sequence
  Synthetic oligonucleotide
gacgcagggtggttgcgtgcttttggttaatttct

SEQ ID NO: 14566 - DNA, 37 bp, Artificial Sequence
  Synthetic oligonucleotide
agcaaacgggggagacctggaaagggggaaagggtga

SEQ ID NO: 14567 - DNA, 35 bp, Artificial Sequence
  Synthetic oligonucleotide
gcctgccaagccccggttttggtgacccgctgacc

SEQ ID NO: 14568 - DNA, 35 bp, Artificial Sequence
  Synthetic oligonucleotide
tttgtacccaacgccgcgccatcttcctagcccgc

SEQ ID NO: 14569 - DNA, 35 bp, Artificial Sequence
  Synthetic oligonucleotide
gaccaccaagccgattgcacttagcccactctttc

SEQ ID NO: 14570 - DNA, 36 bp, Artificial Sequence
  Synthetic oligonucleotide
aatatccgccatgtgcattccaggtcccatcttgca

SEQ ID NO: 14571 - DNA, 37 bp, Artificial Sequence
  Synthetic oligonucleotide
taactgacgtcccgtatgttgccctccttccctgtga

SEQ ID NO: 14572 - DNA, 36 bp, Artificial Sequence
  Synthetic oligonucleotide
tgcatactgcgcaccgcaacccctcacgccgaaata

SEQ ID NO: 14573 - DNA, 35 bp, Artificial Sequence
  Synthetic oligonucleotide
tccccaatgttcgcctcgccccacgcgttttgctc

SEQ ID NO: 14574 - DNA, 35 bp, Artificial Sequence
  Synthetic oligonucleotide
atcaagcctgagctgcgtttgccgttttccatcat

SEQ ID NO: 14575 - DNA, 35 bp, Artificial Sequence
  Synthetic oligonucleotide
actcacggccttctccgccgactgcctgcacatct

SEQ ID NO: 14576 - DNA, 35 bp, Artificial Sequence
  Synthetic oligonucleotide
gacccgctcctgcgcctaacctcttacctgcgctt

SEQ ID NO: 14577 - DNA, 35 bp, Artificial Sequence
  Synthetic oligonucleotide
gtctcacacaccatcatcgaccgctatggtcctat

SEQ ID NO: 14578 - DNA, 38 bp, Artificial Sequence
  Synthetic oligonucleotide
gccaccacagggcacctcctttgcaataacattgctga

SEQ ID NO: 14579 - DNA, 36 bp, Artificial Sequence
  Synthetic oligonucleotide
gtacaaccctgtcaaacttactagtgcatgccttta

SEQ ID NO: 14580 - DNA, 35 bp, Artificial Sequence
  Synthetic oligonucleotide
gtcatgccatccctgatattctgtcgcaaccctgt

SEQ ID NO: 14581 - DNA, 38 bp, Artificial Sequence
  Synthetic oligonucleotide
actgccttagcccctcctactcctgaccagtcctctga

SEQ ID NO: 14582 - DNA, 37 bp, Artificial Sequence
  Synthetic oligonucleotide
tgagcccacagtaccggcgcattttctcacatattga

SEQ ID NO: 14583 - DNA, 35 bp, Artificial Sequence
  Synthetic oligonucleotide
acctcgccgcagtcgttttacctgtttaaccatcc

SEQ ID NO: 14584 - DNA, 35 bp, Artificial Sequence
  Synthetic oligonucleotide
atgcccttgcacccccaccgccccgtacacagaag

SEQ ID NO: 14585 - DNA, 35 bp, Artificial Sequence
  Synthetic oligonucleotide
attgctccgccacatctcctttacaaccgttcggg

SEQ ID NO: 14586 - DNA, 35 bp, Artificial Sequence
  Synthetic oligonucleotide
gacctattccaccgtcacccggttctgttttatct

SEQ ID NO: 14587 - DNA, 35 bp, Artificial Sequence
  Synthetic oligonucleotide
tccacgatcaaccactcaatagctgtctcctctgt

SEQ ID NO: 14588 - DNA, 36 bp, Artificial Sequence
  Synthetic oligonucleotide
accgctcgaccgcatagaaccccctgcgcactttca

SEQ ID NO: 14589 - DNA, 36 bp, Artificial Sequence
  Synthetic oligonucleotide
gaaggggggattgggttagaagggcggaaacgtata

SEQ ID NO: 14590 - DNA, 35 bp, Artificial Sequence
  Synthetic oligonucleotide
gttggcccctggaccgtggaacgtggactcccctc

SEQ ID NO: 14591 - DNA, 35 bp, Artificial Sequence
  Synthetic oligonucleotide
tgtactccttagcctctgtgacggctctgtccctc

SEQ ID NO: 14592 - DNA, 36 bp, Artificial Sequence
  Synthetic oligonucleotide
acccacagctgcaatacgtttttttggcttgataca

SEQ ID NO: 14593 - DNA, 37 bp, Artificial Sequence
  Synthetic oligonucleotide
gagacaagagctctgttgggaggaagggtggagggga

SEQ ID NO: 14594 - DNA, 35 bp, Artificial Sequence
  Synthetic oligonucleotide
agaccgcaccgcctggttagcctcttaaatcgtac

SEQ ID NO: 14595 - DNA, 37 bp, Artificial Sequence
  Synthetic oligonucleotide
atcatcgtccgtcaggtttttttcctgccaccctcga

SEQ ID NO: 14596 - DNA, 35 bp, Artificial Sequence
  Synthetic oligonucleotide
tcccgtccccgtctttttccgcgacacaatatacg

SEQ ID NO: 14597 - DNA, 37 bp, Artificial Sequence
  Synthetic oligonucleotide
gaaagggcacggggggttaggggtcatcgatgacgga

SEQ ID NO: 14598 - DNA, 36 bp, Artificial Sequence
  Synthetic oligonucleotide
ggacgaagaagaggggggcaagggccagaaagggga

SEQ ID NO: 14599 - DNA, 37 bp, Artificial Sequence
  Synthetic oligonucleotide
gacccgtcggggcaacgggggaggggagggttatgga

SEQ ID NO: 14600 - DNA, 37 bp, Artificial Sequence
  Synthetic oligonucleotide
tctacagacggccggagcgttacccccccttgctgga

SEQ ID NO: 14601 - DNA, 37 bp, Artificial Sequence
  Synthetic oligonucleotide
acgcacccacctcgcttgtacctggtttggacttgga

SEQ ID NO: 14602 - DNA, 36 bp, Artificial Sequence
  Synthetic oligonucleotide
ttagccctcgtactgctcgcgcctgtcccgccgtta

SEQ ID NO: 14603 - DNA, 35 bp, Artificial Sequence
  Synthetic oligonucleotide
tgccccacacacctcgacaaccttccagtgctttg

SEQ ID NO: 14604 - DNA, 36 bp, Artificial Sequence
  Synthetic oligonucleotide
gagccaacccgtgccattagcctccatcgcaacaca

SEQ ID NO: 14605 - DNA, 35 bp, Artificial Sequence
  Synthetic oligonucleotide
tcgatcctgtcgccatccacgcgtttattttcgac

SEQ ID NO: 14606 - DNA, 35 bp, Artificial Sequence
  Synthetic oligonucleotide
acgaaccgagcctgggctccaacctccttcatgtc

SEQ ID NO: 14607 - DNA, 35 bp, Artificial Sequence
  Synthetic oligonucleotide
acatactccgctcacttttcgttgatcaccgggcg

SEQ ID NO: 14608 - DNA, 35 bp, Artificial Sequence
  Synthetic oligonucleotide
gaaggtgagtcggtaaaaaatggccgggaggtagt

SEQ ID NO: 14609 - DNA, 35 bp, Artificial Sequence
  Synthetic oligonucleotide
tactacgctgtggtccatctttctttgtgcacggt

SEQ ID NO: 14610 - DNA, 35 bp, Artificial Sequence
  Synthetic oligonucleotide
gcacccaccgccccctccaagcgccttgtcgagaa

SEQ ID NO: 14611 - DNA, 37 bp, Artificial Sequence
  Synthetic oligonucleotide
tgatccctcgcgactaatacgttcataccacccttga

SEQ ID NO: 14612 - DNA, 35 bp, Artificial Sequence
  Synthetic oligonucleotide
tcgcacaccctctcctgtgcaccactggaattcta

SEQ ID NO: 14613 - DNA, 35 bp, Artificial Sequence
  Synthetic oligonucleotide
gctgacgatcgccccggttttcttttcctcctgat

SEQ ID NO: 14614 - DNA, 35 bp, Artificial Sequence
  Synthetic oligonucleotide
tttcgtacgcccagctcttccgtttgctctgttca

SEQ ID NO: 14615 - DNA, 37 bp, Artificial Sequence
  Synthetic oligonucleotide
tgacccagccccgcctatcgtgtcacttcgctcccga

SEQ ID NO: 14616 - DNA, 35 bp, Artificial Sequence
  Synthetic oligonucleotide
attcatacaccacacttgttggacctagtggttct

SEQ ID NO: 14617 - DNA, 35 bp, Artificial Sequence
  Synthetic oligonucleotide
ttgtggccgccatataggcgccgatacccctttct

SEQ ID NO: 14618 - DNA, 35 bp, Artificial Sequence
  Synthetic oligonucleotide
gaaccaacacacaagctactctaaccagccttggt

SEQ ID NO: 14619 - DNA, 36 bp, Artificial Sequence
  Synthetic oligonucleotide
tgcctagcttgacctcgccctctactgttcgccgca

SEQ ID NO: 14620 - DNA, 37 bp, Artificial Sequence
  Synthetic oligonucleotide
gtcactccatccttcgttgtctgatccatcacactga

SEQ ID NO: 14621 - DNA, 38 bp, Artificial Sequence
  Synthetic oligonucleotide
gtcccgtccaaagcgtctccgccaccccgacctcctga

SEQ ID NO: 14622 - DNA, 38 bp, Artificial Sequence
  Synthetic oligonucleotide
ttgatgccctgcctttgctttatgaaacccgactatga

SEQ ID NO: 14623 - DNA, 38 bp, Artificial Sequence
  Synthetic oligonucleotide
actccaaagccccctgaccgtggtagcctatcccttga

SEQ ID NO: 14624 - DNA, 35 bp, Artificial Sequence
  Synthetic oligonucleotide
tcataaacccctgccaccgcattcctaggtgcata

SEQ ID NO: 14625 - DNA, 35 bp, Artificial Sequence
  Synthetic oligonucleotide
gcccaccacacgcgtcttaacaccgcctggtttcg

SEQ ID NO: 14626 - DNA, 35 bp, Artificial Sequence
  Synthetic oligonucleotide
accgccggggtcaacccaactcgccccatgaagcc

SEQ ID NO: 14627 - DNA, 35 bp, Artificial Sequence
  Synthetic oligonucleotide
gcccaagcgaggattccgaccttccttccatccca

SEQ ID NO: 14628 - DNA, 35 bp, Artificial Sequence
  Synthetic oligonucleotide
agtggatccgtgcagccatgagtcacacttcctca

SEQ ID NO: 14629 - DNA, 35 bp, Artificial Sequence
  Synthetic oligonucleotide
acttacctccacgatattgctgttacgcgcttacc

SEQ ID NO: 14630 - DNA, 35 bp, Artificial Sequence
  Synthetic oligonucleotide
gcactgctcccttgatcgtttcccattaggccagt

SEQ ID NO: 14631 - DNA, 38 bp, Artificial Sequence
  Synthetic oligonucleotide
aagccgccgcgactagttgtcctgccgaccccccctga

SEQ ID NO: 14632 - DNA, 37 bp, Artificial Sequence
  Synthetic oligonucleotide
ttacaccccggagcacgcacgcacccgactcccctga

SEQ ID NO: 14633 - DNA, 35 bp, Artificial Sequence
  Synthetic oligonucleotide
agcgaaccccccgacgctgatacacgcatttaaac

SEQ ID NO: 14634 - DNA, 37 bp, Artificial Sequence
  Synthetic oligonucleotide
aactcgcgccttttccagctacacctatccgcccgga

SEQ ID NO: 14635 - DNA, 38 bp, Artificial Sequence
  Synthetic oligonucleotide
gtgctttgcctctgactaaacgttccatccctccgtga

SEQ ID NO: 14636 - DNA, 38 bp, Artificial Sequence
  Synthetic oligonucleotide
gagccgtctgcagactctttcgtccttcttcaccttga

SEQ ID NO: 14637 - DNA, 36 bp, Artificial Sequence
  Synthetic oligonucleotide
tcacccgcaagctgtccgccacccatgcctgcgcta

SEQ ID NO: 14638 - DNA, 35 bp, Artificial Sequence
  Synthetic oligonucleotide
gccactttcccatgcccttgctacagccacgaccc

SEQ ID NO: 14639 - DNA, 35 bp, Artificial Sequence
  Synthetic oligonucleotide
tacagcgctattgcctttccccgcccactcacatg

SEQ ID NO: 14640 - DNA, 35 bp, Artificial Sequence
  Synthetic oligonucleotide
ttatgcagccgccgactgtccatcagctcctttat

SEQ ID NO: 14641 - DNA, 36 bp, Artificial Sequence
  Synthetic oligonucleotide
ttgaactgcgcccatccgtcctagtttttcctctca

SEQ ID NO: 14642 - DNA, 36 bp, Artificial Sequence
  Synthetic oligonucleotide
taggggggagagtgagtgcgggtgttttttggtggg

SEQ ID NO: 14643 - DNA, 35 bp, Artificial Sequence
  Synthetic oligonucleotide
ggagctccaccggttacgtgcaaccccacctcgtt

SEQ ID NO: 14644 - DNA, 35 bp, Artificial Sequence
  Synthetic oligonucleotide
tatctgcactccctttgttgtcacttttacactca

SEQ ID NO: 14645 - DNA, 37 bp, Artificial Sequence
  Synthetic oligonucleotide
gaggtgaggacggggaagttcacgggcagtagaggga

SEQ ID NO: 14646 - DNA, 35 bp, Artificial Sequence
  Synthetic oligonucleotide
ttcgcccacctggccatcgacggaatccatgccgt

SEQ ID NO: 14647 - DNA, 36 bp, Artificial Sequence
  Synthetic oligonucleotide
acccacgtctccaccatggctaactgatttcaccaa

SEQ ID NO: 14648 - DNA, 35 bp, Artificial Sequence
  Synthetic oligonucleotide
gtcactgacgatccattatcctgtaaccatctaca

SEQ ID NO: 14649 - DNA, 36 bp, Artificial Sequence
  Synthetic oligonucleotide
tgccacgccaaaccatcctatgacccgcatgtagca

SEQ ID NO: 14650 - DNA, 37 bp, Artificial Sequence
  Synthetic oligonucleotide
tgttcgtacaccccaagacctcgcgtattccccccga

SEQ ID NO: 14651 - DNA, 37 bp, Artificial Sequence
  Synthetic oligonucleotide
acgacactcccccgctccttcaccggtatgtaggtga

SEQ ID NO: 14652 - DNA, 35 bp, Artificial Sequence
  Synthetic oligonucleotide
aaccactcagacctttgtcgcggttctcattctct

SEQ ID NO: 14653 - DNA, 35 bp, Artificial Sequence
  Synthetic oligonucleotide
acctgcacatcaaatcgcaagatcccacctaccta

SEQ ID NO: 14654 - DNA, 35 bp, Artificial Sequence
  Synthetic oligonucleotide
attactgcctcctgggacacgactacccttcttct

SEQ ID NO: 14655 - DNA, 36 bp, Artificial Sequence
  Synthetic oligonucleotide
tcccccacacaacggtccacataatcacgtggcaca

SEQ ID NO: 14656 - DNA, 37 bp, Artificial Sequence
  Synthetic oligonucleotide
accccccccatcagtagcgtggtgacgcccctgccga

SEQ ID NO: 14657 - DNA, 37 bp, Artificial Sequence
  Synthetic oligonucleotide
ttcaccccgcttactgttctggtcattgttcgcttga

SEQ ID NO: 14658 - DNA, 35 bp, Artificial Sequence
  Synthetic oligonucleotide
gttccacgtgctccatcttcttgggtcctcgtacc

SEQ ID NO: 14659 - DNA, 35 bp, Artificial Sequence
  Synthetic oligonucleotide
gatggaaaccgcctaacccgcctatctgagcaatc

SEQ ID NO: 14660 - DNA, 36 bp, Artificial Sequence
  Synthetic oligonucleotide
gtgacacggccggctatttttctttgtcttggtcca

SEQ ID NO: 14661 - DNA, 36 bp, Artificial Sequence
  Synthetic oligonucleotide
gtagccaccctcgatcgtagagtagcgtacctctca

SEQ ID NO: 14662 - DNA, 37 bp, Artificial Sequence
  Synthetic oligonucleotide
gaagggaaggggggagaggctgagcggtcctgtctga

SEQ ID NO: 14663 - DNA, 38 bp, Artificial Sequence
  Synthetic oligonucleotide
taggccaccttcacatccgcattccttagacggtttga

SEQ ID NO: 14664 - DNA, 34 bp, Artificial Sequence
  Synthetic oligonucleotide
gtcacgagctccattctatgtccgagtacttccc

SEQ ID NO: 14665 - DNA, 35 bp, Artificial Sequence
  Synthetic oligonucleotide
tacaccctcactaacggcgttttgccctttggtcc

SEQ ID NO: 14666 - DNA, 35 bp, Artificial Sequence
  Synthetic oligonucleotide
actgtaccaccattttatgcgctattgcttgttgc

SEQ ID NO: 14667 - DNA, 35 bp, Artificial Sequence
  Synthetic oligonucleotide
tccccgcctgtacccgccctggcctcttacactga

SEQ ID NO: 14668 - DNA, 37 bp, Artificial Sequence
  Synthetic oligonucleotide
agcatccctagacgcctattggtccttcccttcctga

SEQ ID NO: 14669 - DNA, 38 bp, Artificial Sequence
  Synthetic oligonucleotide
aacccaccaccgccccttctgtagagtcgcactggtga

SEQ ID NO: 14670 - DNA, 36 bp, Artificial Sequence
  Synthetic oligonucleotide
gattgtagcccacacccccagaaccagccctcgcta

SEQ ID NO: 14671 - DNA, 35 bp, Artificial Sequence
  Synthetic oligonucleotide
acccgggagcagggccaagcctccccttcatacac

SEQ ID NO: 14672 - DNA, 37 bp, Artificial Sequence
  Synthetic oligonucleotide
gttccaggaaggaggggtactgggaaggggagccgga

SEQ ID NO: 14673 - DNA, 37 bp, Artificial Sequence
  Synthetic oligonucleotide
gccccctccgaacccgatatcagctggacccacctga

SEQ ID NO: 14674 - DNA, 37 bp, Artificial Sequence
  Synthetic oligonucleotide
agaccatgagagttgctgggtgaggggcggagggtga

SEQ ID NO: 14675 - DNA, 37 bp, Artificial Sequence
  Synthetic oligonucleotide
atccgtaccgaacctgagcttaaaccgcctgtcttga

SEQ ID NO: 14676 - DNA, 35 bp, Artificial Sequence
  Synthetic oligonucleotide
gccggtacgcaggtcccttcctggtctttttttta

SEQ ID NO: 14677 - DNA, 35 bp, Artificial Sequence
  Synthetic oligonucleotide
ttaacccacgaccgctgttttgccgcttgattcct

SEQ ID NO: 14678 - DNA, 35 bp, Artificial Sequence
  Synthetic oligonucleotide
tttgagcctgcgtaccgcttctcccttgtcatccc

SEQ ID NO: 14679 - DNA, 38 bp, Artificial Sequence
  Synthetic oligonucleotide
agtgtctgccgcctacccgtttagcactcactgactga

SEQ ID NO: 14680 - DNA, 38 bp, Artificial Sequence
  Synthetic oligonucleotide
gaaagcgctcgtgccttcgttccggacctcctccctga

SEQ ID NO: 14681 - DNA, 35 bp, Artificial Sequence
  Synthetic oligonucleotide
gcacccgctcgaatcctctcgccagccactcatcc

SEQ ID NO: 14682 - DNA, 35 bp, Artificial Sequence
  Synthetic oligonucleotide
ctagacttagcgtgtctcgacgcgtcctgtactcc

SEQ ID NO: 14683 - DNA, 35 bp, Artificial Sequence
  Synthetic oligonucleotide
tgtggactacagagctcatcacagccgaatctcct

SEQ ID NO: 14684 - DNA, 35 bp, Artificial Sequence
  Synthetic oligonucleotide
tgcgcgcacgctcgccgacccacctgaatgctgca

SEQ ID NO: 14685 - DNA, 35 bp, Artificial Sequence
  Synthetic oligonucleotide
tcgcgaacgcggcactcttcattaggcttctctca

SEQ ID NO: 14686 - DNA, 38 bp, Artificial Sequence
  Synthetic oligonucleotide
gacggcgtaagccgtggtccctctctctatccagctga

SEQ ID NO: 14687 - DNA, 34 bp, Artificial Sequence
  Synthetic oligonucleotide
ggatcgctagcacgttccccctggtcattctctc

SEQ ID NO: 14688 - DNA, 35 bp, Artificial Sequence
  Synthetic oligonucleotide
tgaccctcactgtagccgtgccagcccatgttttt

SEQ ID NO: 14689 - DNA, 36 bp, Artificial Sequence
  Synthetic oligonucleotide
attccgcgggcctccgggcaaaaccagcacatacca

SEQ ID NO: 14690 - DNA, 35 bp, Artificial Sequence
  Synthetic oligonucleotide
tcgcacccaatcataaatgtactatccatttgcct

SEQ ID NO: 14691 - DNA, 35 bp, Artificial Sequence
  Synthetic oligonucleotide
gtgccgtctgcctttcgtaccgaaccgtctactct

SEQ ID NO: 14692 - DNA, 37 bp, Artificial Sequence
  Synthetic oligonucleotide
aaacgacgaaaacaacatgggcggggagaatagggga

SEQ ID NO: 14693 - DNA, 35 bp, Artificial Sequence
  Synthetic oligonucleotide
tcacgacagtctcgtagtcattctgccctcccata

SEQ ID NO: 14694 - DNA, 35 bp, Artificial Sequence
  Synthetic oligonucleotide
ggatcaacactcattcgggccttagtgaacgctat

SEQ ID NO: 14695 - DNA, 36 bp, Artificial Sequence
  Synthetic oligonucleotide
gtctagctgcagacgttactcaccaactcttcacca

SEQ ID NO: 14696 - DNA, 36 bp, Artificial Sequence
  Synthetic oligonucleotide
tcatgtggccctgtccgcaaccgctccttttacgca

SEQ ID NO: 14697 - DNA, 37 bp, Artificial Sequence
  Synthetic oligonucleotide
aaacagggccgggaaaactgagggaaggcgtacagga

SEQ ID NO: 14698 - DNA, 38 bp, Artificial Sequence
  Synthetic oligonucleotide
agccctccctcaactcctgcactacgaaactgtactga

SEQ ID NO: 14699 - DNA, 35 bp, Artificial Sequence
  Synthetic oligonucleotide
tgattctatcaccgtgccgcccatgtcacactccc

SEQ ID NO: 14700 - DNA, 35 bp, Artificial Sequence
  Synthetic oligonucleotide
gactgcactgcctggagtcttcagcaacccacgcc

SEQ ID NO: 14701 - DNA, 35 bp, Artificial Sequence
  Synthetic oligonucleotide
accgtccaggccaattactactacacttgatgctc

SEQ ID NO: 14702 - DNA, 35 bp, Artificial Sequence
  Synthetic oligonucleotide
tcaccgcgcatccaggcctcccactaacgcgtatg

SEQ ID NO: 14703 - DNA, 34 bp, Artificial Sequence
  Synthetic oligonucleotide
tgtcctccaagctcgcctctcaatcttggtatcc

SEQ ID NO: 14704 - DNA, 35 bp, Artificial Sequence
  Synthetic oligonucleotide
gcaaggaaaggactgcaggggaaaggggagcgtag

SEQ ID NO: 14705 - DNA, 35 bp, Artificial Sequence
  Synthetic oligonucleotide
tgagcaccgcgagacacctctttctcctcttctcg

SEQ ID NO: 14706 - DNA, 35 bp, Artificial Sequence
  Synthetic oligonucleotide
tgtactccatgccaccgctactgtcgtaaactcat

SEQ ID NO: 14707 - DNA, 38 bp, Artificial Sequence
  Synthetic oligonucleotide
tctggccagacgtcccgccttctcgcccgttttgctga

SEQ ID NO: 14708 - DNA, 35 bp, Artificial Sequence
  Synthetic oligonucleotide
gtggggccaccacctgtctctccaacaccccttac

SEQ ID NO: 14709 - DNA, 35 bp, Artificial Sequence
  Synthetic oligonucleotide
ttgcactcctgtttatcttgtttcctggtcacgcc

SEQ ID NO: 14710 - DNA, 36 bp, Artificial Sequence
  Synthetic oligonucleotide
gagcacgccgcccattcaaccgtctatcccacccgg

SEQ ID NO: 14711 - DNA, 37 bp, Artificial Sequence
  Synthetic oligonucleotide
ggaacagtcactcagccctctacaaccaccacccgga

SEQ ID NO: 14712 - DNA, 38 bp, Artificial Sequence
  Synthetic oligonucleotide
gccagtaaccaccatgttctatcgctgcctccctgtga

SEQ ID NO: 14713 - DNA, 35 bp, Artificial Sequence
  Synthetic oligonucleotide
atcccgcccgtcaactgcacctggggcatttccat

SEQ ID NO: 14714 - DNA, 35 bp, Artificial Sequence
  Synthetic oligonucleotide
accaaccgtctcgggcgctctatcgaacctgctgt

SEQ ID NO: 14715 - DNA, 37 bp, Artificial Sequence
  Synthetic oligonucleotide
gcaaaaggggaggacgatactacggaggatacgggga

SEQ ID NO: 14716 - DNA, 38 bp, Artificial Sequence
  Synthetic oligonucleotide
ttgggggggcaaggcgtggggcgggtgggaatgaatga

SEQ ID NO: 14717 - DNA, 37 bp, Artificial Sequence
  Synthetic oligonucleotide
gacacaccatcgccaatcgtaccctcccagaacttga

SEQ ID NO: 14718 - DNA, 35 bp, Artificial Sequence
  Synthetic oligonucleotide
tacccaaacgcctaccgggtgcggtaaccactctc

SEQ ID NO: 14719 - DNA, 35 bp, Artificial Sequence
  Synthetic oligonucleotide
tctcaatgccactctctatgcggcgcatacttgtc

SEQ ID NO: 14720 - DNA, 35 bp, Artificial Sequence
  Synthetic oligonucleotide
accactgcccacgcccggtcgacgcccgctaccaa

SEQ ID NO: 14721 - DNA, 36 bp, Artificial Sequence
  Synthetic oligonucleotide
tctacctacatccccgtttccgagcaggacatttca

SEQ ID NO: 14722 - DNA, 36 bp, Artificial Sequence
  Synthetic oligonucleotide
gcacttccggaagggcgacccacacctgctttttca

SEQ ID NO: 14723 - DNA, 35 bp, Artificial Sequence
  Synthetic oligonucleotide
agacacgaggatggggaggtgaaaggtgtccgtcg

SEQ ID NO: 14724 - DNA, 35 bp, Artificial Sequence
  Synthetic oligonucleotide
agccatgcatgtccttctcttttggccctgtattg

SEQ ID NO: 14725 - DNA, 35 bp, Artificial Sequence
  Synthetic oligonucleotide
tgaccccgctatgtatagctgcccgagcacttccc

SEQ ID NO: 14726 - DNA, 35 bp, Artificial Sequence
  Synthetic oligonucleotide
gttcacccacgctcgccatcgcaaactatcgcccg

SEQ ID NO: 14727 - DNA, 36 bp, Artificial Sequence
  Synthetic oligonucleotide
ttcacacctggtgccgctttttcttcgttacgtaaa

SEQ ID NO: 14728 - DNA, 35 bp, Artificial Sequence
  Synthetic oligonucleotide
gtctgtcctccccattctccacggtcgacgtttca

SEQ ID NO: 14729 - DNA, 35 bp, Artificial Sequence
  Synthetic oligonucleotide
aacatcacgggttcagcatcggcctgaagttcgcc

SEQ ID NO: 14730 - DNA, 35 bp, Artificial Sequence
  Synthetic oligonucleotide
acatcccgcaatttggttcccagacactgaacgct

SEQ ID NO: 14731 - DNA, 35 bp, Artificial Sequence
  Synthetic oligonucleotide
actcactagccagatcgcctccccgcttcttgttg

SEQ ID NO: 14732 - DNA, 36 bp, Artificial Sequence
  Synthetic oligonucleotide
aacgtgcctgctgatctccaatttgcttgttacaca

SEQ ID NO: 14733 - DNA, 35 bp, Artificial Sequence
  Synthetic oligonucleotide
gccctcccacaccttctagtgacatacgtttctca

SEQ ID NO: 14734 - DNA, 36 bp, Artificial Sequence
  Synthetic oligonucleotide
gcccacgtccaactgacatcgcaatccaccaattta

SEQ ID NO: 14735 - DNA, 33 bp, Artificial Sequence
  Synthetic oligonucleotide
tatcgtacctgccgcgcgttcctgctcctagtc

SEQ ID NO: 14736 - DNA, 35 bp, Artificial Sequence
  Synthetic oligonucleotide
gtctagcgccaccatttttggctgtcaccacctca

SEQ ID NO: 14737 - DNA, 37 bp, Artificial Sequence
  Synthetic oligonucleotide
tgacctcacgaactgccctacccttccttcctgaaga

SEQ ID NO: 14738 - DNA, 37 bp, Artificial Sequence
  Synthetic oligonucleotide
ttaccgcccgtttgcgtactcttgcctcgactccgga

SEQ ID NO: 14739 - DNA, 38 bp, Artificial Sequence
  Synthetic oligonucleotide
gcccaccggaccgcatgcctataaccactctcgactga

SEQ ID NO: 14740 - DNA, 35 bp, Artificial Sequence
  Synthetic oligonucleotide
atcatggcagtgaaaggagggcggtggaggaaggt

SEQ ID NO: 14741 - DNA, 38 bp, Artificial Sequence
  Synthetic oligonucleotide
gccaccgacgaccctgttaggtcctactacttccgtga

SEQ ID NO: 14742 - DNA, 36 bp, Artificial Sequence
  Synthetic oligonucleotide
tcaccccgtttctatgccacgacgcacctagtgcca

SEQ ID NO: 14743 - DNA, 38 bp, Artificial Sequence
  Synthetic oligonucleotide
atcgtcccgcacccacgttcaaaccgccttcaatctga

SEQ ID NO: 14744 - DNA, 36 bp, Artificial Sequence
  Synthetic oligonucleotide
gcccccacgaccggtccgcgcttttaggctcatctt

SEQ ID NO: 14745 - DNA, 36 bp, Artificial Sequence
  Synthetic oligonucleotide
gatgctaccacgctgggcttacgttttctcgttcta

SEQ ID NO: 14746 - DNA, 35 bp, Artificial Sequence
  Synthetic oligonucleotide
ttgcaccccccgctcgggatgggaaagggtgggta

SEQ ID NO: 14747 - DNA, 35 bp, Artificial Sequence
  Synthetic oligonucleotide
tgagccggccagccccctttagtttctcgtcaccc

SEQ ID NO: 14748 - DNA, 35 bp, Artificial Sequence
  Synthetic oligonucleotide
gcctacctctgcattttcgcttatgaacgccactg

SEQ ID NO: 14749 - DNA, 35 bp, Artificial Sequence
  Synthetic oligonucleotide
gccgaaggtacgcacacaatgaaggcaaaccccct

SEQ ID NO: 14750 - DNA, 33 bp, Artificial Sequence
  Synthetic oligonucleotide
acgctgcactcaaatactccggtctctgctgca

SEQ ID NO: 14751 - DNA, 36 bp, Artificial Sequence
  Synthetic oligonucleotide
aacacactccgaaggaatatgcgctacttctctgca

SEQ ID NO: 14752 - DNA, 36 bp, Artificial Sequence
  Synthetic oligonucleotide
gacctcgctactgacctggcgccctcttactttgga

SEQ ID NO: 14753 - DNA, 37 bp, Artificial Sequence
  Synthetic oligonucleotide
tccgccactctgatctttcattgcctgttgaccctga

SEQ ID NO: 14754 - DNA, 38 bp, Artificial Sequence
  Synthetic oligonucleotide
gaggggcaccaggggtggggccggccaagatggggtga

SEQ ID NO: 14755 - DNA, 35 bp, Artificial Sequence
  Synthetic oligonucleotide
gtacgtcgtcgttgtcctttctggtcctttccctc

SEQ ID NO: 14756 - DNA, 35 bp, Artificial Sequence
  Synthetic oligonucleotide
gacctattccacccgactgtatgtaatacgcttct

SEQ ID NO: 14757 - DNA, 35 bp, Artificial Sequence
  Synthetic oligonucleotide
actttcgacccccagcgcgacccctcctcggctca

SEQ ID NO: 14758 - DNA, 36 bp, Artificial Sequence
  Synthetic oligonucleotide
gactcgcaggaacccactacacgcacctctacagga

SEQ ID NO: 14759 - DNA, 35 bp, Artificial Sequence
  Synthetic oligonucleotide
accgccccccggcagtacaaatctaacattgcaat

SEQ ID NO: 14760 - DNA, 37 bp, Artificial Sequence
  Synthetic oligonucleotide
ggactgtccatcaactgcgctttgtaccttccctgga

SEQ ID NO: 14761 - DNA, 36 bp, Artificial Sequence
  Synthetic oligonucleotide
ttgaccctctacatggtcctattttgcctcattcta

SEQ ID NO: 14762 - DNA, 35 bp, Artificial Sequence
  Synthetic oligonucleotide
tgtcacaaccgcattggtttcccgtccctatcctt

SEQ ID NO: 14763 - DNA, 35 bp, Artificial Sequence
  Synthetic oligonucleotide
tcctatcacccgcgcccactctaggcacttccgtt

SEQ ID NO: 14764 - DNA, 35 bp, Artificial Sequence
  Synthetic oligonucleotide
accaccgggccctactcgcgttttttttcacgcgc

SEQ ID NO: 14765 - DNA, 35 bp, Artificial Sequence
  Synthetic oligonucleotide
tacatcatcattccgtccaaccgtggtcgcgtggc

SEQ ID NO: 14766 - DNA, 35 bp, Artificial Sequence
  Synthetic oligonucleotide
gtgtgcgccactcgtccctctcagtacctttccgt

SEQ ID NO: 14767 - DNA, 35 bp, Artificial Sequence
  Synthetic oligonucleotide
gcccgcctaacttggcttttgttcacctcgcttac

SEQ ID NO: 14768 - DNA, 35 bp, Artificial Sequence
  Synthetic oligonucleotide
gaggacaagcgcacttccacgttgcatcaccacta

SEQ ID NO: 14769 - DNA, 35 bp, Artificial Sequence
  Synthetic oligonucleotide
gccaatcaaaatgcactctcagctggccctcgccc

SEQ ID NO: 14770 - DNA, 35 bp, Artificial Sequence
  Synthetic oligonucleotide
tttagccgtacgcatctagtaccttccgtgagttc

SEQ ID NO: 14771 - DNA, 35 bp, Artificial Sequence
  Synthetic oligonucleotide
ttgctgctcctggcgttagctaccaactgctcatt

SEQ ID NO: 14772 - DNA, 35 bp, Artificial Sequence
  Synthetic oligonucleotide
tctacatgacccgccggacgccatagccatataca

SEQ ID NO: 14773 - DNA, 36 bp, Artificial Sequence
  Synthetic oligonucleotide
tacacctctccttcgttactcccacgtggccatgca

SEQ ID NO: 14774 - DNA, 38 bp, Artificial Sequence
  Synthetic oligonucleotide
ttcgcactccatccatgtacgttcgcccctttagttga

SEQ ID NO: 14775 - DNA, 36 bp, Artificial Sequence
  Synthetic oligonucleotide
gcctgccctctcgatccctttgattttatgttggca

SEQ ID NO: 14776 - DNA, 35 bp, Artificial Sequence
  Synthetic oligonucleotide
agtgcgcatccaccttcgcgagtcgcccgtttcta

SEQ ID NO: 14777 - DNA, 35 bp, Artificial Sequence
  Synthetic oligonucleotide
tgcaccgtacctgaaaggtccccaccctgtcttac

SEQ ID NO: 14778 - DNA, 35 bp, Artificial Sequence
  Synthetic oligonucleotide
gtcgcaatacacccgatccacctgcctgactgcgc

SEQ ID NO: 14779 - DNA, 35 bp, Artificial Sequence
  Synthetic oligonucleotide
acgccccgttaagctcccggcgatctacccacgct

SEQ ID NO: 14780 - DNA, 36 bp, Artificial Sequence
  Synthetic oligonucleotide
tttgctcgccttctcactgccaggactcgcccatca

SEQ ID NO: 14781 - DNA, 37 bp, Artificial Sequence
  Synthetic oligonucleotide
gattgacaggaggtgggtaatgggtgtggggtcaaga

SEQ ID NO: 14782 - DNA, 35 bp, Artificial Sequence
  Synthetic oligonucleotide
aaaccacctatagacctgccttacacagcctccac

SEQ ID NO: 14783 - DNA, 35 bp, Artificial Sequence
  Synthetic oligonucleotide
aacaccggggtgaggagggtgggcgaaaggttagt

SEQ ID NO: 14784 - DNA, 35 bp, Artificial Sequence
  Synthetic oligonucleotide
gtcccgcgaatgccgcatgactttactaccaactt

SEQ ID NO: 14785 - DNA, 36 bp, Artificial Sequence
  Synthetic oligonucleotide
tgtgccatccctctgctcccgcccatgacagccaaa

SEQ ID NO: 14786 - DNA, 35 bp, Artificial Sequence
  Synthetic oligonucleotide
aacctcacagccgagaatcactgaccgctaccgca

SEQ ID NO: 14787 - DNA, 35 bp, Artificial Sequence
  Synthetic oligonucleotide
gaacgcacgatcgtgttcgtctttgcatttaggtc

SEQ ID NO: 14788 - DNA, 37 bp, Artificial Sequence
  Synthetic oligonucleotide
ttcaaggggaggaaggcggatatacgggactgtcaga

SEQ ID NO: 14789 - DNA, 37 bp, Artificial Sequence
  Synthetic oligonucleotide
gagcctaatcgggggaaggggggaagggaactggaga

SEQ ID NO: 14790 - DNA, 37 bp, Artificial Sequence
  Synthetic oligonucleotide
gcagacccaacctggcctaatacttcacggaatccga

SEQ ID NO: 14791 - DNA, 35 bp, Artificial Sequence
  Synthetic oligonucleotide
aaccgcaacgcgtacgagtgccctttcccccacta

SEQ ID NO: 14792 - DNA, 34 bp, Artificial Sequence
  Synthetic oligonucleotide
tacagagcagggctggctcctacaccgtttcttt

SEQ ID NO: 14793 - DNA, 36 bp, Artificial Sequence
  Synthetic oligonucleotide
aatgtcgcgcctcgcttttaccgtaacctgccctaa

SEQ ID NO: 14794 - DNA, 36 bp, Artificial Sequence
  Synthetic oligonucleotide
tgccatcctccgctccatgcctatcccctataagga

SEQ ID NO: 14795 - DNA, 35 bp, Artificial Sequence
  Synthetic oligonucleotide
acaccctcacaccgtaacattaacgtcccgctttt

SEQ ID NO: 14796 - DNA, 38 bp, Artificial Sequence
  Synthetic oligonucleotide
aaacacgataaagggggaaaggggctgttacatagtga

SEQ ID NO: 14797 - DNA, 35 bp, Artificial Sequence
  Synthetic oligonucleotide
gtgccccatcgcccatcgccacagctatcctgcag

SEQ ID NO: 14798 - DNA, 36 bp, Artificial Sequence
  Synthetic oligonucleotide
ggacacgactgatccggaaacctctctgcttctcca

SEQ ID NO: 14799 - DNA, 35 bp, Artificial Sequence
  Synthetic oligonucleotide
ttggtcgccccctatgtcattacccaccatttaac

SEQ ID NO: 14800 - DNA, 35 bp, Artificial Sequence
  Synthetic oligonucleotide
acacatgtccgccctgttacaaccgcctatatttt

SEQ ID NO: 14801 - DNA, 35 bp, Artificial Sequence
  Synthetic oligonucleotide
gccgtgagcgccccctctcttcttcaatggcgttc

SEQ ID NO: 14802 - DNA, 36 bp, Artificial Sequence
  Synthetic oligonucleotide
tctcacgattgctcgccgactcacgccttccctaga

SEQ ID NO: 14803 - DNA, 35 bp, Artificial Sequence
  Synthetic oligonucleotide
ttcccaggatcggcgcccatcttgccttgtcctac

SEQ ID NO: 14804 - DNA, 35 bp, Artificial Sequence
  Synthetic oligonucleotide
gatggggaggaaatcaagttggggggtgagggaat

SEQ ID NO: 14805 - DNA, 35 bp, Artificial Sequence
  Synthetic oligonucleotide
gtacccagctgctgccccttgccatgaatatccga

SEQ ID NO: 14806 - DNA, 37 bp, Artificial Sequence
  Synthetic oligonucleotide
ggaaccacactcctcgccagccgacccaaccccatga

SEQ ID NO: 14807 - DNA, 35 bp, Artificial Sequence
  Synthetic oligonucleotide
gcccctccagccctggcttatccatcttccatgcg

SEQ ID NO: 14808 - DNA, 36 bp, Artificial Sequence
  Synthetic oligonucleotide
aacacccccacgagctcattgatattcgtgccttga

SEQ ID NO: 14809 - DNA, 35 bp, Artificial Sequence
  Synthetic oligonucleotide
gtgtgaaagcgccccggccgagccttccctgtccc

SEQ ID NO: 14810 - DNA, 37 bp, Artificial Sequence
  Synthetic oligonucleotide
agcgcccctcgttgtttttgttacgtatccccgctga

SEQ ID NO: 14811 - DNA, 38 bp, Artificial Sequence
  Synthetic oligonucleotide
gaactggaaagcatatggggggggttgaatcggtgtga

SEQ ID NO: 14812 - DNA, 35 bp, Artificial Sequence
  Synthetic oligonucleotide
gaaggcaccccgcctagcccttagatcttggatcc

SEQ ID NO: 14813 - DNA, 35 bp, Artificial Sequence
  Synthetic oligonucleotide
aagacgcatacctatgttagcaacgttgtaccttc

SEQ ID NO: 14814 - DNA, 35 bp, Artificial Sequence
  Synthetic oligonucleotide
gcacccgccggtcgttcagccacatcgatcacatt

SEQ ID NO: 14815 - DNA, 35 bp, Artificial Sequence
  Synthetic oligonucleotide
tcaaccacatgctgagcagtcaccatgtccaactc

SEQ ID NO: 14816 - DNA, 35 bp, Artificial Sequence
  Synthetic oligonucleotide
ttgacgccccacgctctatcacacccatgggctgt

SEQ ID NO: 14817 - DNA, 36 bp, Artificial Sequence
  Synthetic oligonucleotide
gcctccccgcccacacgcttatgacggaccggtcaa

SEQ ID NO: 14818 - DNA, 36 bp, Artificial Sequence
  Synthetic oligonucleotide
tacgtgtacctgtcttcttatcgagctcttccccca

SEQ ID NO: 14819 - DNA, 36 bp, Artificial Sequence
  Synthetic oligonucleotide
acgaaacgccccattttttgacctctcgagctccga

SEQ ID NO: 14820 - DNA, 37 bp, Artificial Sequence
  Synthetic oligonucleotide
accatccaccctcttgcgctgtcgattcggagttcga

SEQ ID NO: 14821 - DNA, 37 bp, Artificial Sequence
  Synthetic oligonucleotide
gagctccgcctatgccccattgctgccactgctttga

SEQ ID NO: 14822 - DNA, 35 bp, Artificial Sequence
  Synthetic oligonucleotide
tgacttcctgcccgaactacatcccgccgtggacc

SEQ ID NO: 14823 - DNA, 35 bp, Artificial Sequence
  Synthetic oligonucleotide
agatcaaccagtacttgccaccatcggccctatcc

SEQ ID NO: 14824 - DNA, 35 bp, Artificial Sequence
  Synthetic oligonucleotide
actacgctacactcccccttttatctggtccacgc

SEQ ID NO: 14825 - DNA, 36 bp, Artificial Sequence
  Synthetic oligonucleotide
ggtccaagcaggggggagccgtaatgggggaaggaa

SEQ ID NO: 14826 - DNA, 38 bp, Artificial Sequence
  Synthetic oligonucleotide
ttcctgcccaaacactgcctttgtgactctcgccgtga

SEQ ID NO: 14827 - DNA, 35 bp, Artificial Sequence
  Synthetic oligonucleotide
gatcccgtggaacctgtccgagtcttattcccacc

SEQ ID NO: 14828 - DNA, 35 bp, Artificial Sequence
  Synthetic oligonucleotide
acactccgtcgccaaacgcactgccctaacggacc

SEQ ID NO: 14829 - DNA, 36 bp, Artificial Sequence
  Synthetic oligonucleotide
acatgggggtatgggggaaaaaaggtgaagtcagaa

SEQ ID NO: 14830 - DNA, 36 bp, Artificial Sequence
  Synthetic oligonucleotide
gcaacgtgccgtgggtacgatgggagggaacgggaa

SEQ ID NO: 14831 - DNA, 36 bp, Artificial Sequence
  Synthetic oligonucleotide
gaccacaccacttgccgtagagtacgtcctcagaca

SEQ ID NO: 14832 - DNA, 37 bp, Artificial Sequence
  Synthetic oligonucleotide
tcacgcccgaccgctacgttttggattcaactcccga

SEQ ID NO: 14833 - DNA, 38 bp, Artificial Sequence
  Synthetic oligonucleotide
tacgtcacaacgatccgccaagcccacccttcgcatga

SEQ ID NO: 14834 - DNA, 35 bp, Artificial Sequence
  Synthetic oligonucleotide
tcacagtccccaggctcattatataccatgctcta

SEQ ID NO: 14835 - DNA, 35 bp, Artificial Sequence
  Synthetic oligonucleotide
tgactcccgggaggccgcaaaccccatccgccact

SEQ ID NO: 14836 - DNA, 36 bp, Artificial Sequence
  Synthetic oligonucleotide
tcatacgtgcgctctccccggcgatcttaccaccaa

SEQ ID NO: 14837 - DNA, 37 bp, Artificial Sequence
  Synthetic oligonucleotide
gcgcacggtaggaggcggacggagttgagttggggga

SEQ ID NO: 14838 - DNA, 38 bp, Artificial Sequence
  Synthetic oligonucleotide
gacgccatgacaacactcccccagactgtccgacctga

SEQ ID NO: 14839 - DNA, 38 bp, Artificial Sequence
  Synthetic oligonucleotide
ttgccctcgatccctgtctctgcgctttcactccctga

SEQ ID NO: 14840 - DNA, 35 bp, Artificial Sequence
  Synthetic oligonucleotide
atagttagcgcgcttccactgtcgttcctgcccta

SEQ ID NO: 14841 - DNA, 35 bp, Artificial Sequence
  Synthetic oligonucleotide
aatgagaaccatccgcccgcgaatagcgcactaac

SEQ ID NO: 14842 - DNA, 35 bp, Artificial Sequence
  Synthetic oligonucleotide
accgagaggttcgtgcgctcggcctcctcatttac

SEQ ID NO: 14843 - DNA, 37 bp, Artificial Sequence
  Synthetic oligonucleotide
tgttcccttccactgccctagctgacggtattctaca

SEQ ID NO: 14844 - DNA, 37 bp, Artificial Sequence
  Synthetic oligonucleotide
gtgaaaggggtagggggtagacaaagcggataataga

SEQ ID NO: 14845 - DNA, 36 bp, Artificial Sequence
  Synthetic oligonucleotide
tctgaggatccgccccatgcctgtctatcttcccta

SEQ ID NO: 14846 - DNA, 35 bp, Artificial Sequence
  Synthetic oligonucleotide
tcaccgccaaatccagcttacacgctgtttgttcc

SEQ ID NO: 14847 - DNA, 35 bp, Artificial Sequence
  Synthetic oligonucleotide
tgcctaggcaccgcccccacctggaccatcttctc

SEQ ID NO: 14848 - DNA, 35 bp, Artificial Sequence
  Synthetic oligonucleotide
gacaggggtggaggacgagttcgacggtagagcag

SEQ ID NO: 14849 - DNA, 35 bp, Artificial Sequence
  Synthetic oligonucleotide
atgccatcccttccggaccctgcctggcttttcat

SEQ ID NO: 14850 - DNA, 37 bp, Artificial Sequence
  Synthetic oligonucleotide
ttgcccacccccgtgagctgcattaaccgctacctga

SEQ ID NO: 14851 - DNA, 37 bp, Artificial Sequence
  Synthetic oligonucleotide
tactagcacacatgtccaccttcatacacttgcctga

SEQ ID NO: 14852 - DNA, 38 bp, Artificial Sequence
  Synthetic oligonucleotide
gtactgcgcctgtgcaccccatagccacttgctcttga

SEQ ID NO: 14853 - DNA, 38 bp, Artificial Sequence
  Synthetic oligonucleotide
gtacgcacccatccgctatgtcgcccctagagctttga

SEQ ID NO: 14854 - DNA, 35 bp, Artificial Sequence
  Synthetic oligonucleotide
gaactcacgccgaaccatcctaagcttgctagtcc

SEQ ID NO: 14855 - DNA, 35 bp, Artificial Sequence
  Synthetic oligonucleotide
tgccacactgcactagtactgatctgggtgctctc

SEQ ID NO: 14856 - DNA, 38 bp, Artificial Sequence
  Synthetic oligonucleotide
gacgcggccgtcggcgtactcccatgctcccctattga

SEQ ID NO: 14857 - DNA, 35 bp, Artificial Sequence
  Synthetic oligonucleotide
ttcaccggccccgtcctacttgcgcgctatcaacc

SEQ ID NO: 14858 - DNA, 35 bp, Artificial Sequence
  Synthetic oligonucleotide
gacacccgcaatttgcttgatagccccatatgttc

SEQ ID NO: 14859 - DNA, 38 bp, Artificial Sequence
  Synthetic oligonucleotide
gggggggaaggggtgggatggtgggtattcgcctttga

SEQ ID NO: 14860 - DNA, 35 bp, Artificial Sequence
  Synthetic oligonucleotide
ttactccatgcactgattctgttcgattccttctc

SEQ ID NO: 14861 - DNA, 35 bp, Artificial Sequence
  Synthetic oligonucleotide
ttacttgccgtcccgctctcatccaccgcctacag

SEQ ID NO: 14862 - DNA, 36 bp, Artificial Sequence
  Synthetic oligonucleotide
tccacgccgaactgacaacaaaacaccacactgtca

SEQ ID NO: 14863 - DNA, 36 bp, Artificial Sequence
  Synthetic oligonucleotide
tcaccacttaatgtgcgctatcaggtccacccccga

SEQ ID NO: 14864 - DNA, 38 bp, Artificial Sequence
  Synthetic oligonucleotide
gagcccccggctgcaactacccgtccgcaccaccatga

SEQ ID NO: 14865 - DNA, 36 bp, Artificial Sequence
  Synthetic oligonucleotide
gagactgacccattgccgcttggatgcctcctcata

SEQ ID NO: 14866 - DNA, 35 bp, Artificial Sequence
  Synthetic oligonucleotide
tatgcctgcaggggcacttgacatccttgcacttc

SEQ ID NO: 14867 - DNA, 33 bp, Artificial Sequence
  Synthetic oligonucleotide
aactccatcaaccgcacttgtcctgaacatagt

SEQ ID NO: 14868 - DNA, 36 bp, Artificial Sequence
  Synthetic oligonucleotide
gagcccgccctcttccggtttgtcgctgtcattcca

SEQ ID NO: 14869 - DNA, 36 bp, Artificial Sequence
  Synthetic oligonucleotide
agaccacctcacgccgcactctcctttgtaaacgga

SEQ ID NO: 14870 - DNA, 34 bp, Artificial Sequence
  Synthetic oligonucleotide
gacatgccggctggctctttgaactatctactga

SEQ ID NO: 14871 - DNA, 35 bp, Artificial Sequence
  Synthetic oligonucleotide
gcccgcagcacagtctctgttttaccgcccgccac

SEQ ID NO: 14872 - DNA, 35 bp, Artificial Sequence
  Synthetic oligonucleotide
ttgtgcaggcgccaagctttattcgttcctgtccg

SEQ ID NO: 14873 - DNA, 35 bp, Artificial Sequence
  Synthetic oligonucleotide
gctcaccgaaggtcttcatgacgtcccactaccca

SEQ ID NO: 14874 - DNA, 37 bp, Artificial Sequence
  Synthetic oligonucleotide
tgtacaaccatgtccacaaccacgccttcctcgcgga

SEQ ID NO: 14875 - DNA, 35 bp, Artificial Sequence
  Synthetic oligonucleotide
gaccactgttcatttgcgatttccttctgggtgac

SEQ ID NO: 14876 - DNA, 35 bp, Artificial Sequence
  Synthetic oligonucleotide
aatccgtcgcaccctgcgcgacccgccctctctgc

SEQ ID NO: 14877 - DNA, 34 bp, Artificial Sequence
  Synthetic oligonucleotide
acatacaccctcaactcgcctgacacacccactg

SEQ ID NO: 14878 - DNA, 33 bp, Artificial Sequence
  Synthetic oligonucleotide
tcagtgggtggtggggggaagatgggcctgtct

SEQ ID NO: 14879 - DNA, 35 bp, Artificial Sequence
  Synthetic oligonucleotide
tcacgccgcattcctgctgtcctctatccacttcc

SEQ ID NO: 14880 - DNA, 35 bp, Artificial Sequence
  Synthetic oligonucleotide
acaataccacccgcgattcctttccccactgtggc

SEQ ID NO: 14881 - DNA, 35 bp, Artificial Sequence
  Synthetic oligonucleotide
tccgctggccatgtctctctgtttcttctggcatc

SEQ ID NO: 14882 - DNA, 35 bp, Artificial Sequence
  Synthetic oligonucleotide
actgtcgagagagagagggaggaatgcagccgcgg

SEQ ID NO: 14883 - DNA, 35 bp, Artificial Sequence
  Synthetic oligonucleotide
gcattcgtaggcctctgctatctcacgttatttct

SEQ ID NO: 14884 - DNA, 35 bp, Artificial Sequence
  Synthetic oligonucleotide
tcgaagtcccgcgcccacttgtctaaccatctcaa

SEQ ID NO: 14885 - DNA, 35 bp, Artificial Sequence
  Synthetic oligonucleotide
tgcgcacctctaggccatatacccgctacctcaca

SEQ ID NO: 14886 - DNA, 36 bp, Artificial Sequence
  Synthetic oligonucleotide
tcaacgtacacaagcgctattttctcgtacctcata

SEQ ID NO: 14887 - DNA, 35 bp, Artificial Sequence
  Synthetic oligonucleotide
atgcgcgctctcatcatcccggaccgttcccactc

SEQ ID NO: 14888 - DNA, 35 bp, Artificial Sequence
  Synthetic oligonucleotide
ggtggggaggtgtggggctcaaaatgagctggggg

SEQ ID NO: 14889 - DNA, 35 bp, Artificial Sequence
  Synthetic oligonucleotide
gaccaccgaatgccacctctgctcgctacgctact

SEQ ID NO: 14890 - DNA, 35 bp, Artificial Sequence
  Synthetic oligonucleotide
gtaccgcaatctcacaccccatgactcaacagctt

SEQ ID NO: 14891 - DNA, 35 bp, Artificial Sequence
  Synthetic oligonucleotide
gtacactgtaacacttgggtttgggcccctcccca

SEQ ID NO: 14892 - DNA, 36 bp, Artificial Sequence
  Synthetic oligonucleotide
gatacgcctattcgaatacagaactctctctaccga

SEQ ID NO: 14893 - DNA, 36 bp, Artificial Sequence
  Synthetic oligonucleotide
tcaaccaccgacatagtaaccatggcctcgtttcta

SEQ ID NO: 14894 - DNA, 35 bp, Artificial Sequence
  Synthetic oligonucleotide
gtgcactccacgttcacctttaagcataaccgccc

SEQ ID NO: 14895 - DNA, 35 bp, Artificial Sequence
  Synthetic oligonucleotide
tcaccctgcagccctcccattacattatacgattc

SEQ ID NO: 14896 - DNA, 35 bp, Artificial Sequence
  Synthetic oligonucleotide
ccagacgtcacactatgtccacctgctaccttttc

SEQ ID NO: 14897 - DNA, 35 bp, Artificial Sequence
  Synthetic oligonucleotide
tgcagtgcatgaccttctccacgcgctttttcctg

SEQ ID NO: 14898 - DNA, 35 bp, Artificial Sequence
  Synthetic oligonucleotide
gcaaacagccatcaacctgttttcgaccctgcact

SEQ ID NO: 14899 - DNA, 35 bp, Artificial Sequence
  Synthetic oligonucleotide
gtgaagcacatccccgactcgtttagactctgccc

SEQ ID NO: 14900 - DNA, 35 bp, Artificial Sequence
  Synthetic oligonucleotide
tacgcaccgtcgcgctccaccttcccccgacgaag

SEQ ID NO: 14901 - DNA, 35 bp, Artificial Sequence
  Synthetic oligonucleotide
ttagtgacccaccaggccctgcccatgtacttgct

SEQ ID NO: 14902 - DNA, 35 bp, Artificial Sequence
  Synthetic oligonucleotide
gcccggcccccggtcctgccctccgttatcgtcca

SEQ ID NO: 14903 - DNA, 35 bp, Artificial Sequence
  Synthetic oligonucleotide
actcgcccacctgtttagctatacgcctaacacct

SEQ ID NO: 14904 - DNA, 35 bp, Artificial Sequence
  Synthetic oligonucleotide
agctcctcaccgcgccttcattgccaaaattgagt

SEQ ID NO: 14905 - DNA, 36 bp, Artificial Sequence
  Synthetic oligonucleotide
atgtcgccgactgtccgttcccccctttagcggcca

SEQ ID NO: 14906 - DNA, 37 bp, Artificial Sequence
  Synthetic oligonucleotide
tcccgcctccacccggttccgatctccgaaagttcga

SEQ ID NO: 14907 - DNA, 37 bp, Artificial Sequence
  Synthetic oligonucleotide
gaagaacgacgcagtggtaggagggaaagggggggga

SEQ ID NO: 14908 - DNA, 37 bp, Artificial Sequence
  Synthetic oligonucleotide
actgaactgtgcgtgccttcatccttccttttcagga

SEQ ID NO: 14909 - DNA, 35 bp, Artificial Sequence
  Synthetic oligonucleotide
gcacccactgagtatgtatactcgttacaccttac

SEQ ID NO: 14910 - DNA, 35 bp, Artificial Sequence
  Synthetic oligonucleotide
gccccgtgtcccggcctattccttgagctatagcg

SEQ ID NO: 14911 - DNA, 35 bp, Artificial Sequence
  Synthetic oligonucleotide
gtgctcccctgccacgacacgtagccatccctttg

SEQ ID NO: 14912 - DNA, 35 bp, Artificial Sequence
  Synthetic oligonucleotide
tcacctgccaccacgccgtatctgccacttacttt

SEQ ID NO: 14913 - DNA, 37 bp, Artificial Sequence
  Synthetic oligonucleotide
tacgcagcctcatcccagatccctacacccctgctga

SEQ ID NO: 14914 - DNA, 35 bp, Artificial Sequence
  Synthetic oligonucleotide
gccactgctgccgctcggacaccccttaacgcctc

SEQ ID NO: 14915 - DNA, 35 bp, Artificial Sequence
  Synthetic oligonucleotide
acagagatgtcgtccatgttaccttccctcccctg

SEQ ID NO: 14916 - DNA, 36 bp, Artificial Sequence
  Synthetic oligonucleotide
acccattggtagccccatcgcctcccgtcgcccaca

SEQ ID NO: 14917 - DNA, 35 bp, Artificial Sequence
  Synthetic oligonucleotide
tacgcaagccctgaggactatcctgacccacccca

SEQ ID NO: 14918 - DNA, 37 bp, Artificial Sequence
  Synthetic oligonucleotide
gaatgcatccccgataggcttatggcacaccacccga

SEQ ID NO: 14919 - DNA, 36 bp, Artificial Sequence
  Synthetic oligonucleotide
atctgacacccgacacacggtcttggccctgttcta

SEQ ID NO: 14920 - DNA, 37 bp, Artificial Sequence
  Synthetic oligonucleotide
ggtggaacaacgggaaggggggcgagcagtgagccga

SEQ ID NO: 14921 - DNA, 35 bp, Artificial Sequence
  Synthetic oligonucleotide
accccaatcccccgcctctgttcaggtcctgtgcc

SEQ ID NO: 14922 - DNA, 35 bp, Artificial Sequence
  Synthetic oligonucleotide
ttggtcctcattccgacgctcgcgccactgctatc

SEQ ID NO: 14923 - DNA, 35 bp, Artificial Sequence
  Synthetic oligonucleotide
gagccctgtagggggggtgggcgtggactttccct

SEQ ID NO: 14924 - DNA, 35 bp, Artificial Sequence
  Synthetic oligonucleotide
tacacccgcaaatggttctacggttatgttatcct

SEQ ID NO: 14925 - DNA, 35 bp, Artificial Sequence
  Synthetic oligonucleotide
agtggggaagggctagggggggattactcgataaa

SEQ ID NO: 14926 - DNA, 35 bp, Artificial Sequence
  Synthetic oligonucleotide
ttcgtcccccgggctatgcctcattggtctgttca

SEQ ID NO: 14927 - DNA, 37 bp, Artificial Sequence
  Synthetic oligonucleotide
tcccccgtatcgtgacacgcccttcacttcccactga

SEQ ID NO: 14928 - DNA, 35 bp, Artificial Sequence
  Synthetic oligonucleotide
ttgccctcaagcatgcgaattggtcctacctaccc

SEQ ID NO: 14929 - DNA, 35 bp, Artificial Sequence
  Synthetic oligonucleotide
tgtgtacttcctactccctgcccccctctagagtg

SEQ ID NO: 14930 - DNA, 35 bp, Artificial Sequence
  Synthetic oligonucleotide
gttgcaacctgtcttcgagcgtctccactgccgtg

SEQ ID NO: 14931 - DNA, 35 bp, Artificial Sequence
  Synthetic oligonucleotide
tgccgcaacgcgtagctcgcaccccgtccaccact

SEQ ID NO: 14932 - DNA, 35 bp, Artificial Sequence
  Synthetic oligonucleotide
gcctggtcgaagctgtctccccgcgtccgctacct

SEQ ID NO: 14933 - DNA, 35 bp, Artificial Sequence
  Synthetic oligonucleotide
tagcgatcaacgccatctggagctggtcttctttt

SEQ ID NO: 14934 - DNA, 35 bp, Artificial Sequence
  Synthetic oligonucleotide
atgctcgtccgcctcctttccatgcccagatcaca

SEQ ID NO: 14935 - DNA, 36 bp, Artificial Sequence
  Synthetic oligonucleotide
aaacggggaggggaggaattacgtatgtgtcgcgca

SEQ ID NO: 14936 - DNA, 36 bp, Artificial Sequence
  Synthetic oligonucleotide
aactcctcacgcctcgcccccatgacgtccccgtga

SEQ ID NO: 14937 - DNA, 37 bp, Artificial Sequence
  Synthetic oligonucleotide
gaaacaggagaaagggacggaaaggggcgtgttaaga

SEQ ID NO: 14938 - DNA, 35 bp, Artificial Sequence
  Synthetic oligonucleotide
tcgaccccgacttctttgcattgtctatccactca

SEQ ID NO: 14939 - DNA, 37 bp, Artificial Sequence
  Synthetic oligonucleotide
ttcacctgcaatcattgccctatccacctcccaggga

SEQ ID NO: 14940 - DNA, 35 bp, Artificial Sequence
  Synthetic oligonucleotide
tgagtcgtccgactcgttttccgcctaacacatgc

SEQ ID NO: 14941 - DNA, 35 bp, Artificial Sequence
  Synthetic oligonucleotide
atgccgccacaggcacgtagctaattttacaacat

SEQ ID NO: 14942 - DNA, 35 bp, Artificial Sequence
  Synthetic oligonucleotide
acgccacatccgggggggagggggaggcgggagaa

SEQ ID NO: 14943 - DNA, 38 bp, Artificial Sequence
  Synthetic oligonucleotide
ggacgctgaccggaagggggctgggtacggttgggtga

SEQ ID NO: 14944 - DNA, 36 bp, Artificial Sequence
  Synthetic oligonucleotide
tcacatccctgccttcattgcgctagcgggttttta

SEQ ID NO: 14945 - DNA, 35 bp, Artificial Sequence
  Synthetic oligonucleotide
ataggagcacgcaacagcccgtccattcgtcccac

SEQ ID NO: 14946 - DNA, 35 bp, Artificial Sequence
  Synthetic oligonucleotide
ttaatgccgccctgtatgctggtacgtccccatcc

SEQ ID NO: 14947 - DNA, 35 bp, Artificial Sequence
  Synthetic oligonucleotide
gcggagccctggttcatcacgcccatacaacgatt

SEQ ID NO: 14948 - DNA, 35 bp, Artificial Sequence
  Synthetic oligonucleotide
gatccccccggtcgatctcctgattactacggttc

SEQ ID NO: 14949 - DNA, 37 bp, Artificial Sequence
  Synthetic oligonucleotide
aatgacagggtggtgcaggtaggggaaatgctgaaga

SEQ ID NO: 14950 - DNA, 36 bp, Artificial Sequence
  Synthetic oligonucleotide
acagacatggatagaagggggagaatgggtagtgga

SEQ ID NO: 14951 - DNA, 35 bp, Artificial Sequence
  Synthetic oligonucleotide
tgcaccgccctaggtagccattacgcgccctcctc

SEQ ID NO: 14952 - DNA, 35 bp, Artificial Sequence
  Synthetic oligonucleotide
agttgcacgaacgggtgggtgggctaggggctcat

SEQ ID NO: 14953 - DNA, 35 bp, Artificial Sequence
  Synthetic oligonucleotide
tgccgcctcatgcaacacccctgcacttttgaaca

SEQ ID NO: 14954 - DNA, 38 bp, Artificial Sequence
  Synthetic oligonucleotide
agcaaccactcctgacaactgcgacctgaacaacctga

SEQ ID NO: 14955 - DNA, 35 bp, Artificial Sequence
  Synthetic oligonucleotide
tcatgtccccgccacccttctcccgtgcgcccgta

SEQ ID NO: 14956 - DNA, 35 bp, Artificial Sequence
  Synthetic oligonucleotide
tgcacgcctccctgataacactccggcttggttac

SEQ ID NO: 14957 - DNA, 35 bp, Artificial Sequence
  Synthetic oligonucleotide
atgtgcgcgaggtccgaaacgtacccatccacccc

SEQ ID NO: 14958 - DNA, 35 bp, Artificial Sequence
  Synthetic oligonucleotide
tgctccgtgccagcctatctatcttctccagtccc

SEQ ID NO: 14959 - DNA, 35 bp, Artificial Sequence
  Synthetic oligonucleotide
gatcacaggcaacagaacattccaggcactcactt

SEQ ID NO: 14960 - DNA, 36 bp, Artificial Sequence
  Synthetic oligonucleotide
tcccaaaaccccccgccgtacacaatcgactgtgga

SEQ ID NO: 14961 - DNA, 37 bp, Artificial Sequence
  Synthetic oligonucleotide
tacgcacggggggaggaagtatccggggattgagtga

SEQ ID NO: 14962 - DNA, 35 bp, Artificial Sequence
  Synthetic oligonucleotide
gcatccatccttgcgcgactgttcgaaccctgcta

SEQ ID NO: 14963 - DNA, 34 bp, Artificial Sequence
  Synthetic oligonucleotide
taatggagccggccccgctgatcatctcccccac

SEQ ID NO: 14964 - DNA, 35 bp, Artificial Sequence
  Synthetic oligonucleotide
tccacgcctctactgacaacgaacctcccccccat

SEQ ID NO: 14965 - DNA, 36 bp, Artificial Sequence
  Synthetic oligonucleotide
gcaccaccgcctctcgtattggaacacacccgccaa

SEQ ID NO: 14966 - DNA, 37 bp, Artificial Sequence
  Synthetic oligonucleotide
acgtacaagcccacctgctccatgacattctttccga

SEQ ID NO: 14967 - DNA, 36 bp, Artificial Sequence
  Synthetic oligonucleotide
tctatcgctgcccgcactgcgtacgcctttatacta

SEQ ID NO: 14968 - DNA, 35 bp, Artificial Sequence
  Synthetic oligonucleotide
gatgatgggaatggttggtatgggaaaggatgggg

SEQ ID NO: 14969 - DNA, 37 bp, Artificial Sequence
  Synthetic oligonucleotide
gcggaggtctattgtctctgccctcgtacttgcccga

SEQ ID NO: 14970 - DNA, 38 bp, Artificial Sequence
  Synthetic oligonucleotide
agacgcaaccgtgcctccctggtcattacatcccctga

SEQ ID NO: 14971 - DNA, 36 bp, Artificial Sequence
  Synthetic oligonucleotide
ttgccacgccctggtaccaattaatgttcatcccta

SEQ ID NO: 14972 - DNA, 35 bp, Artificial Sequence
  Synthetic oligonucleotide
accaccactgaacaccctgcaactcgaataccgcg

SEQ ID NO: 14973 - DNA, 37 bp, Artificial Sequence
  Synthetic oligonucleotide
aaacagggcgaatctgggaggaatgagtggtggtgga

SEQ ID NO: 14974 - DNA, 38 bp, Artificial Sequence
  Synthetic oligonucleotide
taccccacaccgccaaatcatgttcggtttcatactga

SEQ ID NO: 14975 - DNA, 38 bp, Artificial Sequence
  Synthetic oligonucleotide
gtagacgggagtagaggtagaacgggatgggaaattga

SEQ ID NO: 14976 - DNA, 35 bp, Artificial Sequence
  Synthetic oligonucleotide
gatgggggggctaaggacgggaagagtaacgtcag

SEQ ID NO: 14977 - DNA, 35 bp, Artificial Sequence
  Synthetic oligonucleotide
tcgcgaatatcgcacagccctctactctccactgt

SEQ ID NO: 14978 - DNA, 35 bp, Artificial Sequence
  Synthetic oligonucleotide
tatagccccaccattaacacaggcgatttgaccca

SEQ ID NO: 14979 - DNA, 36 bp, Artificial Sequence
  Synthetic oligonucleotide
accccacgcccctgcctgagatcgtttgcaaaccga

SEQ ID NO: 14980 - DNA, 37 bp, Artificial Sequence
  Synthetic oligonucleotide
tacatccgtcccccgctgtccctgccgccgtaattga

SEQ ID NO: 14981 - DNA, 35 bp, Artificial Sequence
  Synthetic oligonucleotide
ttgtcctgcctcccctgtccgtaaatgcagcagac

SEQ ID NO: 14982 - DNA, 35 bp, Artificial Sequence
  Synthetic oligonucleotide
gttgcgctgtatccttcctccctacggccgcaccc

SEQ ID NO: 14983 - DNA, 35 bp, Artificial Sequence
  Synthetic oligonucleotide
gaagggtatgagggggaacaagggtaaactcaggg

SEQ ID NO: 14984 - DNA, 34 bp, Artificial Sequence
  Synthetic oligonucleotide
tagagatgaggcaaaggggcagaaaggaagaggg

SEQ ID NO: 14985 - DNA, 37 bp, Artificial Sequence
  Synthetic oligonucleotide
tagacggtgaaggaagtgcggaaagggcgggatcaga

SEQ ID NO: 14986 - DNA, 37 bp, Artificial Sequence
  Synthetic oligonucleotide
tccctgccctatgtcccttttcaagcccacatatcga

SEQ ID NO: 14987 - DNA, 35 bp, Artificial Sequence
  Synthetic oligonucleotide
atcgcctccacctgtatcgattgggatttaatgcg

SEQ ID NO: 14988 - DNA, 35 bp, Artificial Sequence
  Synthetic oligonucleotide
tgcacctgctaccttatttacctagccatacttgt

SEQ ID NO: 14989 - DNA, 37 bp, Artificial Sequence
  Synthetic oligonucleotide
agccacggaccgtaccctcgacacccctccgtaccga

SEQ ID NO: 14990 - DNA, 35 bp, Artificial Sequence
  Synthetic oligonucleotide
gatcgtaacatgcccctgcgatttatgcccaccct

SEQ ID NO: 14991 - DNA, 35 bp, Artificial Sequence
  Synthetic oligonucleotide
gtcggaccctagcgccactcacctgttcctcacta

SEQ ID NO: 14992 - DNA, 35 bp, Artificial Sequence
  Synthetic oligonucleotide
tgactccacgggactcgatacgctacttcctttgc

SEQ ID NO: 14993 - DNA, 35 bp, Artificial Sequence
  Synthetic oligonucleotide
agcatactccccatcatctgtcgacgttcgcttat

SEQ ID NO: 14994 - DNA, 35 bp, Artificial Sequence
  Synthetic oligonucleotide
tcttgctccgttatagctctctacgccgactacct

SEQ ID NO: 14995 - DNA, 35 bp, Artificial Sequence
  Synthetic oligonucleotide
gccgagcacaatgctctctccaaacacatatcctt

SEQ ID NO: 14996 - DNA, 37 bp, Artificial Sequence
  Synthetic oligonucleotide
ggagcccgcccgttgcccaccctgtcctatgttgcga

SEQ ID NO: 14997 - DNA, 35 bp, Artificial Sequence
  Synthetic oligonucleotide
gtccaccgccatcagacctcgactcacttcctact

SEQ ID NO: 14998 - DNA, 36 bp, Artificial Sequence
  Synthetic oligonucleotide
tgacacccatctggcaacattacatttgcgtaccca

SEQ ID NO: 14999 - DNA, 37 bp, Artificial Sequence
  Synthetic oligonucleotide
ttcagccaccgacaatacctaccaccgtttctatcga

SEQ ID NO: 15000 - DNA, 38 bp, Artificial Sequence
  Synthetic oligonucleotide
gatggactaaacaaaggtgggagaaaggggtgacatga

SEQ ID NO: 15001 - DNA, 38 bp, Artificial Sequence
  Synthetic oligonucleotide
tgcacccccgcctcacgaagcccacgccttcaatatga

SEQ ID NO: 15002 - DNA, 35 bp, Artificial Sequence
  Synthetic oligonucleotide
tcacgcatacgtacccctaaccatcgcctcaaagg

SEQ ID NO: 15003 - DNA, 35 bp, Artificial Sequence
  Synthetic oligonucleotide
tgcgatccaatgttggtctctacgcttcacttctt

SEQ ID NO: 15004 - DNA, 35 bp, Artificial Sequence
  Synthetic oligonucleotide
gtgcccgcggaattactgcccctgaccaaatcgtt

SEQ ID NO: 15005 - DNA, 36 bp, Artificial Sequence
  Synthetic oligonucleotide
ggtcaatcgctcccaccctcgtcttagcctcacaca

SEQ ID NO: 15006 - DNA, 36 bp, Artificial Sequence
  Synthetic oligonucleotide
acccctcctgcaatgtatctcttctgaactgtccca

SEQ ID NO: 15007 - DNA, 37 bp, Artificial Sequence
  Synthetic oligonucleotide
accgagcaacgttcgaccctctctttgctccttatga

SEQ ID NO: 15008 - DNA, 35 bp, Artificial Sequence
  Synthetic oligonucleotide
gttgaacaacatgacctgcctgcttgcttccccta

SEQ ID NO: 15009 - DNA, 35 bp, Artificial Sequence
  Synthetic oligonucleotide
acctcccctggtccataacagtcacaagcgtgacc

SEQ ID NO: 15010 - DNA, 35 bp, Artificial Sequence
  Synthetic oligonucleotide
tgcaaaccctgctccccactcccataacttacgcc

SEQ ID NO: 15011 - DNA, 35 bp, Artificial Sequence
  Synthetic oligonucleotide
tctacgttcggccgccctcgacttgctcgctttcc

SEQ ID NO: 15012 - DNA, 38 bp, Artificial Sequence
  Synthetic oligonucleotide
gacatgtttattgtagcgcgaacacttccaccctctga

SEQ ID NO: 15013 - DNA, 36 bp, Artificial Sequence
  Synthetic oligonucleotide
gtcgttccatcagttggcacagctctgcattctcta

SEQ ID NO: 15014 - DNA, 35 bp, Artificial Sequence
  Synthetic oligonucleotide
actcctggctccctcgtcctacctcccggtcttgc

SEQ ID NO: 15015 - DNA, 35 bp, Artificial Sequence
  Synthetic oligonucleotide
ggggagggtaggggggggctttgttaatggctgga

SEQ ID NO: 15016 - DNA, 37 bp, Artificial Sequence
  Synthetic oligonucleotide
tgtacacgtcgagaactaccggccatgcactccctga

SEQ ID NO: 15017 - DNA, 38 bp, Artificial Sequence
  Synthetic oligonucleotide
ggtacggcgagaggtataggggggcggtggagtgctga

SEQ ID NO: 15018 - DNA, 35 bp, Artificial Sequence
  Synthetic oligonucleotide
tacgtagcccattttagcgttacacaatccaccat

SEQ ID NO: 15019 - DNA, 35 bp, Artificial Sequence
  Synthetic oligonucleotide
atgacctgagccaacttcatgagccgaccatgact

SEQ ID NO: 15020 - DNA, 35 bp, Artificial Sequence
  Synthetic oligonucleotide
tacatacaccccctcgcgtccacacaggttgactc

SEQ ID NO: 15021 - DNA, 35 bp, Artificial Sequence
  Synthetic oligonucleotide
ggggctgtcccgcccactgtcctgagcctcctccg

SEQ ID NO: 15022 - DNA, 35 bp, Artificial Sequence
  Synthetic oligonucleotide
acgtgccacccacgcctatcacatcttttgggcct

SEQ ID NO: 15023 - DNA, 35 bp, Artificial Sequence
  Synthetic oligonucleotide
acttagtgccgcctctgtcctgacccccacgcatt

SEQ ID NO: 15024 - DNA, 36 bp, Artificial Sequence
  Synthetic oligonucleotide
atgccgtcaactcactagcggccctttactttgtta

SEQ ID NO: 15025 - DNA, 35 bp, Artificial Sequence
  Synthetic oligonucleotide
tacaacagtggctccccgttattttgcgccactcc

SEQ ID NO: 15026 - DNA, 35 bp, Artificial Sequence
  Synthetic oligonucleotide
tccaaccccactcaatcttgagtctacgcctgctc

SEQ ID NO: 15027 - DNA, 35 bp, Artificial Sequence
  Synthetic oligonucleotide
caacacatcgcatgctcgtaagttccaccgcctct

SEQ ID NO: 15028 - DNA, 35 bp, Artificial Sequence
  Synthetic oligonucleotide
tccatcgcacttttgatcaagtctcccggtttgca

SEQ ID NO: 15029 - DNA, 35 bp, Artificial Sequence
  Synthetic oligonucleotide
atgatgcccaggccccgccccagattgttcctccg

SEQ ID NO: 15030 - DNA, 36 bp, Artificial Sequence
  Synthetic oligonucleotide
gagggcgactgcgttcgatgggcgggagggacacaa

SEQ ID NO: 15031 - DNA, 37 bp, Artificial Sequence
  Synthetic oligonucleotide
accgattagtgcctcgcttctagagttccatacccga

SEQ ID NO: 15032 - DNA, 38 bp, Artificial Sequence
  Synthetic oligonucleotide
ggagggtagcaaaggggtaggggggctaatgtttgtga

SEQ ID NO: 15033 - DNA, 35 bp, Artificial Sequence
  Synthetic oligonucleotide
tccacctatccgttgctccttttcgacgatcctgc

SEQ ID NO: 15034 - DNA, 35 bp, Artificial Sequence
  Synthetic oligonucleotide
gctagtgggtgaggtacgtaggttatgggtagggg

SEQ ID NO: 15035 - DNA, 35 bp, Artificial Sequence
  Synthetic oligonucleotide
gagaacgtcgccccctcatgtcatttacttagttg

SEQ ID NO: 15036 - DNA, 37 bp, Artificial Sequence
  Synthetic oligonucleotide
gacaccaaacagcacctgccttgcacacagtttatga

SEQ ID NO: 15037 - DNA, 37 bp, Artificial Sequence
  Synthetic oligonucleotide
gtgagggcgggcctgggtgggagagtgattgcattga

SEQ ID NO: 15038 - DNA, 35 bp, Artificial Sequence
  Synthetic oligonucleotide
ataggggatggtggggggtcggtaagtgcaagtag

SEQ ID NO: 15039 - DNA, 38 bp, Artificial Sequence
  Synthetic oligonucleotide
gagacgaagcaggacgagggcgaaggggtagtctatga

SEQ ID NO: 15040 - DNA, 38 bp, Artificial Sequence
  Synthetic oligonucleotide
tccactgtccgtccctgggatccaactgcctctattga

SEQ ID NO: 15041 - DNA, 35 bp, Artificial Sequence
  Synthetic oligonucleotide
gtcaattcgcattagcacccggcgctcctgccctc

SEQ ID NO: 15042 - DNA, 35 bp, Artificial Sequence
  Synthetic oligonucleotide
tcaacctgcattacgaatgtcgcatttttgtggtc

SEQ ID NO: 15043 - DNA, 35 bp, Artificial Sequence
  Synthetic oligonucleotide
tcagggacgacaaaggaatggatggttgaacacgg

SEQ ID NO: 15044 - DNA, 35 bp, Artificial Sequence
  Synthetic oligonucleotide
atcaaccgacactttatgttacacgcattgcctct

SEQ ID NO: 15045 - DNA, 34 bp, Artificial Sequence
  Synthetic oligonucleotide
tatctcccccgaacactggattgaacgattttca

SEQ ID NO: 15046 - DNA, 38 bp, Artificial Sequence
  Synthetic oligonucleotide
gaagcgttacccgtttcgttccttgttgcctgttatga

SEQ ID NO: 15047 - DNA, 35 bp, Artificial Sequence
  Synthetic oligonucleotide
accccccctgtcgcctgttccctttttatcccggc

SEQ ID NO: 15048 - DNA, 37 bp, Artificial Sequence
  Synthetic oligonucleotide
acagtaggccgacacggttcacactatttccccagga

SEQ ID NO: 15049 - DNA, 37 bp, Artificial Sequence
  Synthetic oligonucleotide
attgcctcattgtggcgcgcactcccgaccctgctga

SEQ ID NO: 15050 - DNA, 35 bp, Artificial Sequence
  Synthetic oligonucleotide
gagaccacacccatgtaatctgattacaccgcgcc

SEQ ID NO: 15051 - DNA, 36 bp, Artificial Sequence
  Synthetic oligonucleotide
gaatggtcgcagccctcactgttatcgcccacatga

SEQ ID NO: 15052 - DNA, 35 bp, Artificial Sequence
  Synthetic oligonucleotide
tcagcccgacgacactgtatcctttctgtcctaag

SEQ ID NO: 15053 - DNA, 36 bp, Artificial Sequence
  Synthetic oligonucleotide
aaccaaggtcggaggatggaggtcgggggtccgggt

SEQ ID NO: 15054 - DNA, 35 bp, Artificial Sequence
  Synthetic oligonucleotide
accgtggggcaaagaaggaacaggaggggtggtgt

SEQ ID NO: 15055 - DNA, 36 bp, Artificial Sequence
  Synthetic oligonucleotide
gccactctccgagccaattgtgagctgcccttgaca

SEQ ID NO: 15056 - DNA, 35 bp, Artificial Sequence
  Synthetic oligonucleotide
gtgatccaaagaatgaggggagtgggacgggtgga

SEQ ID NO: 15057 - DNA, 35 bp, Artificial Sequence
  Synthetic oligonucleotide
tccgaattaaacggacccccacccgcccatggcta

SEQ ID NO: 15058 - DNA, 35 bp, Artificial Sequence
  Synthetic oligonucleotide
gagccacacgccattatcttctcaagtgaccactc

SEQ ID NO: 15059 - DNA, 38 bp, Artificial Sequence
  Synthetic oligonucleotide
acatgccgtatctcattgcatcaagcccacccctatga

SEQ ID NO: 15060 - DNA, 35 bp, Artificial Sequence
  Synthetic oligonucleotide
tagcatgctcgcaaaacgccgtctcgcttccctga

SEQ ID NO: 15061 - DNA, 36 bp, Artificial Sequence
  Synthetic oligonucleotide
tccacttggccccttatgattatttggctacttctc

SEQ ID NO: 15062 - DNA, 35 bp, Artificial Sequence
  Synthetic oligonucleotide
gtggggttcgaccgtggggggaggtggtctgaggg

SEQ ID NO: 15063 - DNA, 35 bp, Artificial Sequence
  Synthetic oligonucleotide
tgctccatcggcggcttcgtcttagcgcttcccat

SEQ ID NO: 15064 - DNA, 35 bp, Artificial Sequence
  Synthetic oligonucleotide
atcgaccaggcatcgatctctggctccctgaacct

SEQ ID NO: 15065 - DNA, 36 bp, Artificial Sequence
  Synthetic oligonucleotide
tcccccttcctgccgcttgatcactcttcatcgtga

SEQ ID NO: 15066 - DNA, 35 bp, Artificial Sequence
  Synthetic oligonucleotide
ttctcaccccggagcggatcacccgccttcccata

SEQ ID NO: 15067 - DNA, 35 bp, Artificial Sequence
  Synthetic oligonucleotide
tactcccccccgcctacgtataaagggcactatgg

SEQ ID NO: 15068 - DNA, 35 bp, Artificial Sequence
  Synthetic oligonucleotide
taccatctgggtgaatgtccttatctttgctgtct

SEQ ID NO: 15069 - DNA, 35 bp, Artificial Sequence
  Synthetic oligonucleotide
gcaaaccggcccattcaatcacgaagccttccgtt

SEQ ID NO: 15070 - DNA, 38 bp, Artificial Sequence
  Synthetic oligonucleotide
tcacccatcacactggttttagctcgcccctgagctga

SEQ ID NO: 15071 - DNA, 36 bp, Artificial Sequence
  Synthetic oligonucleotide
tgtgtgccccccccgttcctgcttgtaggtcaagca

SEQ ID NO: 15072 - DNA, 38 bp, Artificial Sequence
  Synthetic oligonucleotide
atgtccgcctagctgttcgcccccgttgatttccgtga

SEQ ID NO: 15073 - DNA, 35 bp, Artificial Sequence
  Synthetic oligonucleotide
actcccgccccccaatctacttttgtcgcctgtta

SEQ ID NO: 15074 - DNA, 35 bp, Artificial Sequence
  Synthetic oligonucleotide
ttgtccgcaaccattacgcgccgaagctttcatcc

SEQ ID NO: 15075 - DNA, 35 bp, Artificial Sequence
  Synthetic oligonucleotide
atcccccccgctagttggcgacaagtagtagcccc

SEQ ID NO: 15076 - DNA, 35 bp, Artificial Sequence
  Synthetic oligonucleotide
tgcatcacatcacctattgccgtacaaaagctccg

SEQ ID NO: 15077 - DNA, 35 bp, Artificial Sequence
  Synthetic oligonucleotide
aagtcgcaccattatctggctgtagtagtcgccct

SEQ ID NO: 15078 - DNA, 35 bp, Artificial Sequence
  Synthetic oligonucleotide
acagaacgggagactgaatagagcggggaggataa

SEQ ID NO: 15079 - DNA, 36 bp, Artificial Sequence
  Synthetic oligonucleotide
tagctccacctccgtatctgtctgaatattgccaca

SEQ ID NO: 15080 - DNA, 37 bp, Artificial Sequence
  Synthetic oligonucleotide
gactgggaagggagcaattggaagtgacggaggtgga

SEQ ID NO: 15081 - DNA, 37 bp, Artificial Sequence
  Synthetic oligonucleotide
gtccacccgtacatattttcgcataacctgcacgtga

SEQ ID NO: 15082 - DNA, 36 bp, Artificial Sequence
  Synthetic oligonucleotide
tagccgtccgcgaaccatcgtactcccattgtccta

SEQ ID NO: 15083 - DNA, 36 bp, Artificial Sequence
  Synthetic oligonucleotide
tcccgcaactccctgtagctctctttcgtcaccata

SEQ ID NO: 15084 - DNA, 35 bp, Artificial Sequence
  Synthetic oligonucleotide
gcatccacacaattccacctcttttgacagagtaa

SEQ ID NO: 15085 - DNA, 36 bp, Artificial Sequence
  Synthetic oligonucleotide
tgtaggtccatgtcctatttctccccctacgttcca

SEQ ID NO: 15086 - DNA, 36 bp, Artificial Sequence
  Synthetic oligonucleotide
tgagctggtcgggggcaagtacggggggattgagca

SEQ ID NO: 15087 - DNA, 36 bp, Artificial Sequence
  Synthetic oligonucleotide
tgccaaggctgtggtatccttgcccacccctttgta

SEQ ID NO: 15088 - DNA, 35 bp, Artificial Sequence
  Synthetic oligonucleotide
acctggttctgcctccatccaatctgcacacatcg

SEQ ID NO: 15089 - DNA, 35 bp, Artificial Sequence
  Synthetic oligonucleotide
tagtcccccgatcccgagtctggtccagtaccttg

SEQ ID NO: 15090 - DNA, 37 bp, Artificial Sequence
  Synthetic oligonucleotide
gccatcccccactgcgggctctagtagccaacctcga

SEQ ID NO: 15091 - DNA, 36 bp, Artificial Sequence
  Synthetic oligonucleotide
accccacgtcgccctctcttactcttgtttagtcga

SEQ ID NO: 15092 - DNA, 38 bp, Artificial Sequence
  Synthetic oligonucleotide
tcaacacgacacggaaggaccaccacacctccacctga

SEQ ID NO: 15093 - DNA, 37 bp, Artificial Sequence
  Synthetic oligonucleotide
tcccaccaccaggtacctatccagacagtttggttga

SEQ ID NO: 15094 - DNA, 34 bp, Artificial Sequence
  Synthetic oligonucleotide
actcatgcccctgagggatgagtactctcccctt

SEQ ID NO: 15095 - DNA, 35 bp, Artificial Sequence
  Synthetic oligonucleotide
taccgaaacgttgtgtccgccgccctgccctctac

SEQ ID NO: 15096 - DNA, 38 bp, Artificial Sequence
  Synthetic oligonucleotide
acactcgccgtttactggttttggacgccctttactga

SEQ ID NO: 15097 - DNA, 36 bp, Artificial Sequence
  Synthetic oligonucleotide
gctgagaggggaaaggggacggaggtgtggaaggta

SEQ ID NO: 15098 - DNA, 35 bp, Artificial Sequence
  Synthetic oligonucleotide
actgcccgatcgtcctctcgctgcctctagcactg

SEQ ID NO: 15099 - DNA, 36 bp, Artificial Sequence
  Synthetic oligonucleotide
tggagtgacaccggtccatttgcgcttccctcggca

SEQ ID NO: 15100 - DNA, 35 bp, Artificial Sequence
  Synthetic oligonucleotide
tgttccacccttatgtctcatatgttaggcccacc

SEQ ID NO: 15101 - DNA, 35 bp, Artificial Sequence
  Synthetic oligonucleotide
gtgtcgcgccgggcactctcacccttccgaacact

SEQ ID NO: 15102 - DNA, 36 bp, Artificial Sequence
  Synthetic oligonucleotide
tgctacgacgccctgaatcgacctaatctgcacaca

SEQ ID NO: 15103 - DNA, 36 bp, Artificial Sequence
  Synthetic oligonucleotide
tgacccgagccatccccgttacagctgctttgtcga

SEQ ID NO: 15104 - DNA, 38 bp, Artificial Sequence
  Synthetic oligonucleotide
accacatctgtctgcgtgcaccgctccctcacccatga

SEQ ID NO: 15105 - DNA, 36 bp, Artificial Sequence
  Synthetic oligonucleotide
tcgacggctcgttccccgctggtgttgcctccctga

SEQ ID NO: 15106 - DNA, 36 bp, Artificial Sequence
  Synthetic oligonucleotide
gttaagggagaggtggggtggggagttcgtaaggta

SEQ ID NO: 15107 - DNA, 35 bp, Artificial Sequence
  Synthetic oligonucleotide
gccaatccctcccatcgcatcggacgcagtacggc

SEQ ID NO: 15108 - DNA, 35 bp, Artificial Sequence
  Synthetic oligonucleotide
gttgcgcaccatagtgaacatttcagccactcctc

SEQ ID NO: 15109 - DNA, 35 bp, Artificial Sequence
  Synthetic oligonucleotide
aacactgcctctgaagtactactcttcaccttcaa

SEQ ID NO: 15110 - DNA, 36 bp, Artificial Sequence
  Synthetic oligonucleotide
gtgcgctgttgcgactaattctccttgctccgtgca

SEQ ID NO: 15111 - DNA, 37 bp, Artificial Sequence
  Synthetic oligonucleotide
gatgctgcctggtcgtgggagggcttgggtggtatga

SEQ ID NO: 15112 - DNA, 38 bp, Artificial Sequence
  Synthetic oligonucleotide
atacacacccgaccccagaggccttaggctttacctga

SEQ ID NO: 15113 - DNA, 33 bp, Artificial Sequence
  Synthetic oligonucleotide
ttccaccacttggtacccgaggtgagttatcac

SEQ ID NO: 15114 - DNA, 35 bp, Artificial Sequence
  Synthetic oligonucleotide
tttgcctcgcccgctgcccctccctgttttaggac

SEQ ID NO: 15115 - DNA, 35 bp, Artificial Sequence
  Synthetic oligonucleotide
gtggcccacacgttgaccgcctctccttcaccacc

SEQ ID NO: 15116 - DNA, 35 bp, Artificial Sequence
  Synthetic oligonucleotide
atacccccgcgggaaactgagtcaccgcttcgccc

SEQ ID NO: 15117 - DNA, 35 bp, Artificial Sequence
  Synthetic oligonucleotide
tatccgtcctatcgcaccaccgtccattacctttg

SEQ ID NO: 15118 - DNA, 35 bp, Artificial Sequence
  Synthetic oligonucleotide
tcccaagtcgcatgggcgtttcctaccactcctct

SEQ ID NO: 15119 - DNA, 36 bp, Artificial Sequence
  Synthetic oligonucleotide
tacatccagaaggggaactgggaaaggaagggggaa

SEQ ID NO: 15120 - DNA, 38 bp, Artificial Sequence
  Synthetic oligonucleotide
gtcacgtgttggaggggggaaggggccgcgtggtatga

SEQ ID NO: 15121 - DNA, 38 bp, Artificial Sequence
  Synthetic oligonucleotide
tacatgcctgccgcatccgtttactttgcattccttga

SEQ ID NO: 15122 - DNA, 35 bp, Artificial Sequence
  Synthetic oligonucleotide
aaacactgcccgctcaaatacgttctgttgtccac

SEQ ID NO: 15123 - DNA, 35 bp, Artificial Sequence
  Synthetic oligonucleotide
gcgatgcctacgcatgccgtgtccggttcgatccc

SEQ ID NO: 15124 - DNA, 38 bp, Artificial Sequence
  Synthetic oligonucleotide
tccctccctcagccttgcatttctaacatccttgttga

SEQ ID NO: 15125 - DNA, 35 bp, Artificial Sequence
  Synthetic oligonucleotide
ggagaacggcctgtctctccactccactttgcacc

SEQ ID NO: 15126 - DNA, 35 bp, Artificial Sequence
  Synthetic oligonucleotide
gacactccgcacggcctctactgtccacttactct

SEQ ID NO: 15127 - DNA, 38 bp, Artificial Sequence
  Synthetic oligonucleotide
tctcaccggaagctagttcatatcgccaaccaccctga

SEQ ID NO: 15128 - DNA, 38 bp, Artificial Sequence
  Synthetic oligonucleotide
ttgggcgccccgctgattcatggccaccttacttctga

SEQ ID NO: 15129 - DNA, 35 bp, Artificial Sequence
  Synthetic oligonucleotide
accaccgcagtggacggtctctttcatgctttcta

SEQ ID NO: 15130 - DNA, 35 bp, Artificial Sequence
  Synthetic oligonucleotide
gacccctccccgttgccgtaagtcattgttttcac

SEQ ID NO: 15131 - DNA, 35 bp, Artificial Sequence
  Synthetic oligonucleotide
tggtgttccaacgcactcaccacccatcgcatgcc

SEQ ID NO: 15132 - DNA, 35 bp, Artificial Sequence
  Synthetic oligonucleotide
tcccacacctgcaaggtgttctttgccctctttcc

SEQ ID NO: 15133 - DNA, 35 bp, Artificial Sequence
  Synthetic oligonucleotide
tatgggagcggggtaggggaaaaggccgaagggag

SEQ ID NO: 15134 - DNA, 35 bp, Artificial Sequence
  Synthetic oligonucleotide
cacgaacgacgggagaaattaagggatgggatggg

SEQ ID NO: 15135 - DNA, 35 bp, Artificial Sequence
  Synthetic oligonucleotide
atcacactgcacttggcctacatactttaggttat

SEQ ID NO: 15136 - DNA, 35 bp, Artificial Sequence
  Synthetic oligonucleotide
gtcgatcgtgccgtgtaatctccgtccgtttttgt

SEQ ID NO: 15137 - DNA, 36 bp, Artificial Sequence
  Synthetic oligonucleotide
gaccaatgcccgggcctcacacgcgttcccacacaa

SEQ ID NO: 15138 - DNA, 35 bp, Artificial Sequence
  Synthetic oligonucleotide
atccgctcttcgcccgacgcctactctaaaagcca

SEQ ID NO: 15139 - DNA, 38 bp, Artificial Sequence
  Synthetic oligonucleotide
acctgtcccgttgtcgcacgctgctctccactgcttga

SEQ ID NO: 15140 - DNA, 35 bp, Artificial Sequence
  Synthetic oligonucleotide
tatgcctgagccccatctcttccagcccgctgtcc

SEQ ID NO: 15141 - DNA, 35 bp, Artificial Sequence
  Synthetic oligonucleotide
gttgccggcgacactggaaaaccatcctgtctcac

SEQ ID NO: 15142 - DNA, 35 bp, Artificial Sequence
  Synthetic oligonucleotide
acatcccgatccgttagtgcctcactgctggctcc

SEQ ID NO: 15143 - DNA, 37 bp, Artificial Sequence
  Synthetic oligonucleotide
gccaacgcacttcttcagcacgattcctgcttcccga

SEQ ID NO: 15144 - DNA, 37 bp, Artificial Sequence
  Synthetic oligonucleotide
tcactacctgccccgtgggtctacactcccttgcgga

SEQ ID NO: 15145 - DNA, 37 bp, Artificial Sequence
  Synthetic oligonucleotide
attcccatcgctttcgtgctggtttacacattttgga

SEQ ID NO: 15146 - DNA, 37 bp, Artificial Sequence
  Synthetic oligonucleotide
gtaccacagctgccgtatcgcttcaatccaacactga

SEQ ID NO: 15147 - DNA, 38 bp, Artificial Sequence
  Synthetic oligonucleotide
agacggagatgtggcaacgggaggggtcgggagggtga

SEQ ID NO: 15148 - DNA, 35 bp, Artificial Sequence
  Synthetic oligonucleotide
ggaacccgccctccacccgtccgtcactatacgta

SEQ ID NO: 15149 - DNA, 35 bp, Artificial Sequence
  Synthetic oligonucleotide
actgcacctgtgtctttcctaccgttctcctactc

SEQ ID NO: 15150 - DNA, 35 bp, Artificial Sequence
  Synthetic oligonucleotide
gtgatgctgcggtcggggaaggagggtttggacag

SEQ ID NO: 15151 - DNA, 35 bp, Artificial Sequence
  Synthetic oligonucleotide
gtcaccccattgcatccatacacaggggcacctgt

SEQ ID NO: 15152 - DNA, 35 bp, Artificial Sequence
  Synthetic oligonucleotide
aagacacaccgtctcattggcctccgtttcgacca

SEQ ID NO: 15153 - DNA, 36 bp, Artificial Sequence
  Synthetic oligonucleotide
agccccctgcaacagccgtccctatctgcacgctca

SEQ ID NO: 15154 - DNA, 37 bp, Artificial Sequence
  Synthetic oligonucleotide
aagtgtgacgcgggggggacggagccgcgctggggga

SEQ ID NO: 15155 - DNA, 35 bp, Artificial Sequence
  Synthetic oligonucleotide
taactacaccgcattatgcatctcctttcggtcct

SEQ ID NO: 15156 - DNA, 35 bp, Artificial Sequence
  Synthetic oligonucleotide
ggaccgcctgttgcagcacacctcccccttaattt

SEQ ID NO: 15157 - DNA, 36 bp, Artificial Sequence
  Synthetic oligonucleotide
tgcacactccccctgtcgccatccattcactgtgca

SEQ ID NO: 15158 - DNA, 36 bp, Artificial Sequence
  Synthetic oligonucleotide
tccgaacctcaaacttatgcgttctgttatcctcga

SEQ ID NO: 15159 - DNA, 37 bp, Artificial Sequence
  Synthetic oligonucleotide
gggagggctgggtgggtgttatttcgaggtgagtgga

SEQ ID NO: 15160 - DNA, 35 bp, Artificial Sequence
  Synthetic oligonucleotide
gcccgccaccagccccacgagaattacacattgac

SEQ ID NO: 15161 - DNA, 35 bp, Artificial Sequence
  Synthetic oligonucleotide
agagacacacatcgtgccagaacccaatgccttcc

SEQ ID NO: 15162 - DNA, 35 bp, Artificial Sequence
  Synthetic oligonucleotide
agacactatctgcacctgattccgtctctgcctat

SEQ ID NO: 15163 - DNA, 36 bp, Artificial Sequence
  Synthetic oligonucleotide
gagaagggtcgagggaggcgaagagtctcgagagca

SEQ ID NO: 15164 - DNA, 36 bp, Artificial Sequence
  Synthetic oligonucleotide
tctacccggcctgataaactgaatcactcccgctca

SEQ ID NO: 15165 - DNA, 37 bp, Artificial Sequence
  Synthetic oligonucleotide
tagccccgcgcgcgctatcctcaccgttaggtcacga

SEQ ID NO: 15166 - DNA, 37 bp, Artificial Sequence
  Synthetic oligonucleotide
gtgcccgtaccagctcccgaacggcactccccctgga

SEQ ID NO: 15167 - DNA, 37 bp, Artificial Sequence
  Synthetic oligonucleotide
tgtgcctcccttcgcgcctcacatttgtcacattgga

SEQ ID NO: 15168 - DNA, 36 bp, Artificial Sequence
  Synthetic oligonucleotide
tccgatccatctatccgccgagattaaacagttcta

SEQ ID NO: 15169 - DNA, 35 bp, Artificial Sequence
  Synthetic oligonucleotide
tcactggcgtagtcgtaccagctttcttatcgcac

SEQ ID NO: 15170 - DNA, 37 bp, Artificial Sequence
  Synthetic oligonucleotide
gtcaggagggcggggtagggttggaacattgtacgga

SEQ ID NO: 15171 - DNA, 35 bp, Artificial Sequence
  Synthetic oligonucleotide
gacccctacagcccgcaccccaccgctattatgag

SEQ ID NO: 15172 - DNA, 35 bp, Artificial Sequence
  Synthetic oligonucleotide
acttcacgcagggtatccatctctccgacctggct

SEQ ID NO: 15173 - DNA, 35 bp, Artificial Sequence
  Synthetic oligonucleotide
gtccgcataagcccaagtccgcccccctgcttttt

SEQ ID NO: 15174 - DNA, 33 bp, Artificial Sequence
  Synthetic oligonucleotide
tctgtgtgccgcccaaacaatgcctcgaactaa

SEQ ID NO: 15175 - DNA, 36 bp, Artificial Sequence
  Synthetic oligonucleotide
acccgtcgcaggctggttacttttgctgttcaacta

SEQ ID NO: 15176 - DNA, 35 bp, Artificial Sequence
  Synthetic oligonucleotide
gccccctccgctcgagcatgcctatcctagggctt

SEQ ID NO: 15177 - DNA, 37 bp, Artificial Sequence
  Synthetic oligonucleotide
gaggacggagggccgaaataaggaatgatcgggagga

SEQ ID NO: 15178 - DNA, 35 bp, Artificial Sequence
  Synthetic oligonucleotide
aatgccgaacaggtgtcttcgtgtcatcccggtcc

SEQ ID NO: 15179 - DNA, 35 bp, Artificial Sequence
  Synthetic oligonucleotide
gagatcaactgcacgctccggttacgctccaccat

SEQ ID NO: 15180 - DNA, 35 bp, Artificial Sequence
  Synthetic oligonucleotide
ttccccatcgccaaggcggtgttctctcgcactat

SEQ ID NO: 15181 - DNA, 36 bp, Artificial Sequence
  Synthetic oligonucleotide
acactcagtcccagccgatggaggcccacactctca

SEQ ID NO: 15182 - DNA, 36 bp, Artificial Sequence
  Synthetic oligonucleotide
tagtcactcacatcccatcctggccctctctagtca

SEQ ID NO: 15183 - DNA, 36 bp, Artificial Sequence
  Synthetic oligonucleotide
atgaatgggtagagctggggcaaaggatatggagga

SEQ ID NO: 15184 - DNA, 36 bp, Artificial Sequence
  Synthetic oligonucleotide
ttccatgcgtttcacatccgtccatatgtcgccgta

SEQ ID NO: 15185 - DNA, 35 bp, Artificial Sequence
  Synthetic oligonucleotide
gcactacccgggccgtctaccgttttgtgctttac

SEQ ID NO: 15186 - DNA, 35 bp, Artificial Sequence
  Synthetic oligonucleotide
gcccaatgcactaaggcattcatgttcacccccgc

SEQ ID NO: 15187 - DNA, 35 bp, Artificial Sequence
  Synthetic oligonucleotide
tctcgactatgcgtacatcttcggtcgttccctgt

SEQ ID NO: 15188 - DNA, 35 bp, Artificial Sequence
  Synthetic oligonucleotide
gagctcacccgcatctgcaatcgtatggccacttt

SEQ ID NO: 15189 - DNA, 35 bp, Artificial Sequence
  Synthetic oligonucleotide
gtgcccctgtccattggcctttacaatcctaacat

SEQ ID NO: 15190 - DNA, 37 bp, Artificial Sequence
  Synthetic oligonucleotide
tagtgctgcctcgatgtacgcccacttgcccacccga

SEQ ID NO: 15191 - DNA, 38 bp, Artificial Sequence
  Synthetic oligonucleotide
tgacacctctcacccgagcctgcttcaccttccgatga

SEQ ID NO: 15192 - DNA, 38 bp, Artificial Sequence
  Synthetic oligonucleotide
tgtgtagacgggaaagaaagggaattggtgagcgatga

SEQ ID NO: 15193 - DNA, 36 bp, Artificial Sequence
  Synthetic oligonucleotide
accactcgcacaccgccggtcctcctcgagcattga

SEQ ID NO: 15194 - DNA, 37 bp, Artificial Sequence
  Synthetic oligonucleotide
ggggacacgggacaggggatggaaggtaggggattga

SEQ ID NO: 15195 - DNA, 36 bp, Artificial Sequence
  Synthetic oligonucleotide
gacaccccagggattctgcccgtgatgcccacttta

SEQ ID NO: 15196 - DNA, 35 bp, Artificial Sequence
  Synthetic oligonucleotide
aaccgcgcgcgctgagccgccatccactgctcctc

SEQ ID NO: 15197 - DNA, 36 bp, Artificial Sequence
  Synthetic oligonucleotide
gcacgctgccatcagccatctacgcgcactttacaa

SEQ ID NO: 15198 - DNA, 38 bp, Artificial Sequence
  Synthetic oligonucleotide
gcccagctcgcactgcacgcccaagacccacgaaatga

SEQ ID NO: 15199 - DNA, 38 bp, Artificial Sequence
  Synthetic oligonucleotide
ttcgagcgcgaataactctgtccccttactgcacctga

SEQ ID NO: 15200 - DNA, 35 bp, Artificial Sequence
  Synthetic oligonucleotide
gtgggccgtccagccctgtggctccctcacgcctc

SEQ ID NO: 15201 - DNA, 35 bp, Artificial Sequence
  Synthetic oligonucleotide
gccaaagttctgctccactaggtgaaacatctctt

SEQ ID NO: 15202 - DNA, 35 bp, Artificial Sequence
  Synthetic oligonucleotide
aatgtgcgcgttcaggattttccatccgctgtcct

SEQ ID NO: 15203 - DNA, 34 bp, Artificial Sequence
  Synthetic oligonucleotide
atcacctctgtacatatagatccacatactgctt

SEQ ID NO: 15204 - DNA, 36 bp, Artificial Sequence
  Synthetic oligonucleotide
gtggtgtcgcgcctcactgccttcacgtacacatca

SEQ ID NO: 15205 - DNA, 37 bp, Artificial Sequence
  Synthetic oligonucleotide
gccccattaaccgtgcatccgtggccccatacttcga

SEQ ID NO: 15206 - DNA, 35 bp, Artificial Sequence
  Synthetic oligonucleotide
tcaacggcgcacttctctccgaccttgccttctac

SEQ ID NO: 15207 - DNA, 35 bp, Artificial Sequence
  Synthetic oligonucleotide
acactcacctatctacaccgtcgccgtgggcggcc

SEQ ID NO: 15208 - DNA, 35 bp, Artificial Sequence
  Synthetic oligonucleotide
gcccgcactccgcctgtagactgaacgctggttcc

SEQ ID NO: 15209 - DNA, 35 bp, Artificial Sequence
  Synthetic oligonucleotide
aacagtgaagggaagggaagcaaaaccgggccccg

SEQ ID NO: 15210 - DNA, 35 bp, Artificial Sequence
  Synthetic oligonucleotide
gagggacacagaactgggagggtcatgggtgtggg

SEQ ID NO: 15211 - DNA, 37 bp, Artificial Sequence
  Synthetic oligonucleotide
atcacgagcgcgggaaagggcgggtttgaggtaggga

SEQ ID NO: 15212 - DNA, 37 bp, Artificial Sequence
  Synthetic oligonucleotide
gaagccccacttgccaatacgtgaacaccccatatga

SEQ ID NO: 15213 - DNA, 35 bp, Artificial Sequence
  Synthetic oligonucleotide
tcaccttgaagctctcagcctgcttttacccttga

SEQ ID NO: 15214 - DNA, 35 bp, Artificial Sequence
  Synthetic oligonucleotide
ttcacatcccgccggacgttactctgataccatag

SEQ ID NO: 15215 - DNA, 35 bp, Artificial Sequence
  Synthetic oligonucleotide
gcacgccctcatgaacgagaactcgcaacttactt

SEQ ID NO: 15216 - DNA, 36 bp, Artificial Sequence
  Synthetic oligonucleotide
acgactccaccatgaatctgtttcccccatgactaa

SEQ ID NO: 15217 - DNA, 35 bp, Artificial Sequence
  Synthetic oligonucleotide
aggacgccctgggttaactgcatcctttccctcca

SEQ ID NO: 15218 - DNA, 35 bp, Artificial Sequence
  Synthetic oligonucleotide
gctttccacgaccaactgaccacccgtcccacgca

SEQ ID NO: 15219 - DNA, 35 bp, Artificial Sequence
  Synthetic oligonucleotide
tgtgcacacgctactagtactgggctcactaactc

SEQ ID NO: 15220 - DNA, 34 bp, Artificial Sequence
  Synthetic oligonucleotide
tgtggggggtcgcctcctgtctcttgaatccgtg

SEQ ID NO: 15221 - DNA, 35 bp, Artificial Sequence
  Synthetic oligonucleotide
attgtgcacgttcgtagtcgtctaccctttcctct

SEQ ID NO: 15222 - DNA, 35 bp, Artificial Sequence
  Synthetic oligonucleotide
aaccccgtacgtacacgcaggccttctatcaattt

SEQ ID NO: 15223 - DNA, 34 bp, Artificial Sequence
  Synthetic oligonucleotide
gcatgagtagtggggttgtagggtcaagggggaa

SEQ ID NO: 15224 - DNA, 36 bp, Artificial Sequence
  Synthetic oligonucleotide
ttacgcccgggtcactcttctgcgtattttgtccca

SEQ ID NO: 15225 - DNA, 36 bp, Artificial Sequence
  Synthetic oligonucleotide
gtgtcacgtcacgtgtgctgttcctcacgcccctca

SEQ ID NO: 15226 - DNA, 37 bp, Artificial Sequence
  Synthetic oligonucleotide
tgcccactctgcctgcccccccctacccatgggaaga

SEQ ID NO: 15227 - DNA, 37 bp, Artificial Sequence
  Synthetic oligonucleotide
gccggggaaggaaacatatacgcagggacggggacga

SEQ ID NO: 15228 - DNA, 36 bp, Artificial Sequence
  Synthetic oligonucleotide
gaacgagaatgcgctatcgaccaccacaccttctga

SEQ ID NO: 15229 - DNA, 36 bp, Artificial Sequence
  Synthetic oligonucleotide
gaggagcgaactgcacgccgccaccttttgactaaa

SEQ ID NO: 15230 - DNA, 35 bp, Artificial Sequence
  Synthetic oligonucleotide
gaagagccgcctgtccacttatttgaccccgtctt

SEQ ID NO: 15231 - DNA, 37 bp, Artificial Sequence
  Synthetic oligonucleotide
atcaccgttcggtacatgcaaaaatctcgccatccga

SEQ ID NO: 15232 - DNA, 35 bp, Artificial Sequence
  Synthetic oligonucleotide
gcacgcccaccaccacacctcgtacattcggtata

SEQ ID NO: 15233 - DNA, 35 bp, Artificial Sequence
  Synthetic oligonucleotide
attgccccacaaacacgagttcaacgactccaggt

SEQ ID NO: 15234 - DNA, 38 bp, Artificial Sequence
  Synthetic oligonucleotide
acccactcctccctagtgcagacttatctgcatcctga

SEQ ID NO: 15235 - DNA, 35 bp, Artificial Sequence
  Synthetic oligonucleotide
acaagccctcgagcgtcgtttgttgcgctccctcc

SEQ ID NO: 15236 - DNA, 33 bp, Artificial Sequence
  Synthetic oligonucleotide
tcatgcttaatcacctctctgtgcgcagtctcc

SEQ ID NO: 15237 - DNA, 36 bp, Artificial Sequence
  Synthetic oligonucleotide
gaacaagaatggggggtggagtcacgcatgaatgga

SEQ ID NO: 15238 - DNA, 36 bp, Artificial Sequence
  Synthetic oligonucleotide
tcgctcacacgcactttttttagcgcaatttcgcta

SEQ ID NO: 15239 - DNA, 35 bp, Artificial Sequence
  Synthetic oligonucleotide
acccagggcctcttttttttgagcctggccaatct

SEQ ID NO: 15240 - DNA, 36 bp, Artificial Sequence
  Synthetic oligonucleotide
aacgacgaccccaagttgtcccacgttataacgtaa

SEQ ID NO: 15241 - DNA, 36 bp, Artificial Sequence
  Synthetic oligonucleotide
gtacatgccgctcccgttacattcttcactcatgca

SEQ ID NO: 15242 - DNA, 35 bp, Artificial Sequence
  Synthetic oligonucleotide
atgtccctctttcacatgtcactccaccgttctta

SEQ ID NO: 15243 - DNA, 35 bp, Artificial Sequence
  Synthetic oligonucleotide
tcaccaccgccacgaatgatctggagtgcccttcc

SEQ ID NO: 15244 - DNA, 35 bp, Artificial Sequence
  Synthetic oligonucleotide
tccctactccagaccgtttacgattaccaacgctt

SEQ ID NO: 15245 - DNA, 36 bp, Artificial Sequence
  Synthetic oligonucleotide
ttgctcattgccccactggaaagtcacatgtctgga

SEQ ID NO: 15246 - DNA, 35 bp, Artificial Sequence
  Synthetic oligonucleotide
actctccatacccagctcaacgcacccagttccac

SEQ ID NO: 15247 - DNA, 35 bp, Artificial Sequence
  Synthetic oligonucleotide
tgaccgtcacgcccgactgcccgtgaagcccgtac

SEQ ID NO: 15248 - DNA, 35 bp, Artificial Sequence
  Synthetic oligonucleotide
ggtccaccgcaccctccatcaaagatcacctcttg

SEQ ID NO: 15249 - DNA, 35 bp, Artificial Sequence
  Synthetic oligonucleotide
gaatcaaggtgggaaggggaaccgaaaacatacga

SEQ ID NO: 15250 - DNA, 37 bp, Artificial Sequence
  Synthetic oligonucleotide
ccaatcccgctgcatagtaactgcccctcaccctcga

SEQ ID NO: 15251 - DNA, 38 bp, Artificial Sequence
  Synthetic oligonucleotide
gcctccccactcaacctgtcacatcacttccgagttga

SEQ ID NO: 15252 - DNA, 35 bp, Artificial Sequence
  Synthetic oligonucleotide
gtgcacaaccacatgtcgcgcaacacaattgttcc

SEQ ID NO: 15253 - DNA, 38 bp, Artificial Sequence
  Synthetic oligonucleotide
gactcgtacctgctacatttgttcccccgataccatga

SEQ ID NO: 15254 - DNA, 38 bp, Artificial Sequence
  Synthetic oligonucleotide
gccaaggtcaagtcgggaaggagcggcgagggacttga

SEQ ID NO: 15255 - DNA, 37 bp, Artificial Sequence
  Synthetic oligonucleotide
agacacctgccgagaactgatctgctacctcatttga

SEQ ID NO: 15256 - DNA, 35 bp, Artificial Sequence
  Synthetic oligonucleotide
gtgcacgcgcccctatggtcccattccatcgcccc

SEQ ID NO: 15257 - DNA, 35 bp, Artificial Sequence
  Synthetic oligonucleotide
aatgggcaatgagggataactcggttatgggggag

SEQ ID NO: 15258 - DNA, 35 bp, Artificial Sequence
  Synthetic oligonucleotide
tgttgccccgcaagtcgaccacgccacctcccgcg

SEQ ID NO: 15259 - DNA, 36 bp, Artificial Sequence
  Synthetic oligonucleotide
gacactccgatcgcccgtatccgcccttttcaggta

SEQ ID NO: 15260 - DNA, 35 bp, Artificial Sequence
  Synthetic oligonucleotide
gtcatacatcactgccgggggggagaggcgggatc

SEQ ID NO: 15261 - DNA, 37 bp, Artificial Sequence
  Synthetic oligonucleotide
gctcattccgagctccctctgcacctccagtccctga

SEQ ID NO: 15262 - DNA, 35 bp, Artificial Sequence
  Synthetic oligonucleotide
gagccgcctataccacctcgcagcacctccgtgcg

SEQ ID NO: 15263 - DNA, 35 bp, Artificial Sequence
  Synthetic oligonucleotide
acgcccgggtgtcccatcttggctcttgtctactt

SEQ ID NO: 15264 - DNA, 38 bp, Artificial Sequence
  Synthetic oligonucleotide
tcgcaccgcatttcgtttcgtgcctaacacttagctga

SEQ ID NO: 15265 - DNA, 35 bp, Artificial Sequence
  Synthetic oligonucleotide
agtatagcctcgaccccgtacgccccacccccgtt

SEQ ID NO: 15266 - DNA, 37 bp, Artificial Sequence
  Synthetic oligonucleotide
gatcgtgaaggaggggggaggcacggtgagtaggaga

SEQ ID NO: 15267 - DNA, 38 bp, Artificial Sequence
  Synthetic oligonucleotide
gatcgcgcctgtgcactcccgcccaattttcgtactga

SEQ ID NO: 15268 - DNA, 36 bp, Artificial Sequence
  Synthetic oligonucleotide
gacgcccaccccatgacgcgttcaacttgtaaccta

SEQ ID NO: 15269 - DNA, 35 bp, Artificial Sequence
  Synthetic oligonucleotide
gccaatcatctgcctcattcggcgcgacccccgcc

SEQ ID NO: 15270 - DNA, 38 bp, Artificial Sequence
  Synthetic oligonucleotide
gatcgggaggggtgggtaagttggcataggggtgatga

SEQ ID NO: 15271 - DNA, 35 bp, Artificial Sequence
  Synthetic oligonucleotide
gagagactcacacctattttgacaccaccagccta

SEQ ID NO: 15272 - DNA, 36 bp, Artificial Sequence
  Synthetic oligonucleotide
aagggggtgaggaacggaggttaaacatgggaggta

SEQ ID NO: 15273 - DNA, 36 bp, Artificial Sequence
  Synthetic oligonucleotide
tcgcaagacatatcattcgcctcgtccctgctgtta

SEQ ID NO: 15274 - DNA, 35 bp, Artificial Sequence
  Synthetic oligonucleotide
ttgatccacgggccacagtccgcgttcccaatacc

SEQ ID NO: 15275 - DNA, 35 bp, Artificial Sequence
  Synthetic oligonucleotide
tgccgctgcccccagcacgcctcagacctctacct

SEQ ID NO: 15276 - DNA, 36 bp, Artificial Sequence
  Synthetic oligonucleotide
gactcattcgcccagtaagtacccgttccatgctga

SEQ ID NO: 15277 - DNA, 36 bp, Artificial Sequence
  Synthetic oligonucleotide
aagtctgcccttcccacgtgtccctcgctgtatcta

SEQ ID NO: 15278 - DNA, 35 bp, Artificial Sequence
  Synthetic oligonucleotide
agtgataggggagtgggggagggaaggtttgggag

SEQ ID NO: 15279 - DNA, 35 bp, Artificial Sequence
  Synthetic oligonucleotide
tcagagccgccgtggctcccctctacctgcaaact

SEQ ID NO: 15280 - DNA, 36 bp, Artificial Sequence
  Synthetic oligonucleotide
gccgtgccaccatgccatcgatcgcttcggatccca

SEQ ID NO: 15281 - DNA, 37 bp, Artificial Sequence
  Synthetic oligonucleotide
gcctgcacaatgagcgccaactgcatcaattccccga

SEQ ID NO: 15282 - DNA, 37 bp, Artificial Sequence
  Synthetic oligonucleotide
ttattaatctggtgcagaggcggggtggtggatggga

SEQ ID NO: 15283 - DNA, 38 bp, Artificial Sequence
  Synthetic oligonucleotide
gagggggaagggaggtgactacgggcgtggcataatga

SEQ ID NO: 15284 - DNA, 37 bp, Artificial Sequence
  Synthetic oligonucleotide
tccaacccagaaccctcgtgcccgtatctacccgtga

SEQ ID NO: 15285 - DNA, 38 bp, Artificial Sequence
  Synthetic oligonucleotide
aagggacgtgagtaggaggggcgatagtgggggggtga

SEQ ID NO: 15286 - DNA, 35 bp, Artificial Sequence
  Synthetic oligonucleotide
actccccccgtcccgccctagaacattgcacatta

SEQ ID NO: 15287 - DNA, 35 bp, Artificial Sequence
  Synthetic oligonucleotide
tacagaggcactcctgttagcgttgtctctccgcc

SEQ ID NO: 15288 - DNA, 35 bp, Artificial Sequence
  Synthetic oligonucleotide
attcccccgagctacgtttagcacttccattttgc

SEQ ID NO: 15289 - DNA, 35 bp, Artificial Sequence
  Synthetic oligonucleotide
gccgccccattgcctatttcagcgcttgttaattc

SEQ ID NO: 15290 - DNA, 36 bp, Artificial Sequence
  Synthetic oligonucleotide
gctcgtcctccgcctcaccaccccggctatcacgta

SEQ ID NO: 15291 - DNA, 35 bp, Artificial Sequence
  Synthetic oligonucleotide
gccagccctcaacagccgtctcatctacaagtctc

SEQ ID NO: 15292 - DNA, 35 bp, Artificial Sequence
  Synthetic oligonucleotide
tagtttgaccgtcccttatttgcacataccacctg

SEQ ID NO: 15293 - DNA, 37 bp, Artificial Sequence
  Synthetic oligonucleotide
gatccaccccggttctatcatgcctgttgtctggcga

SEQ ID NO: 15294 - DNA, 37 bp, Artificial Sequence
  Synthetic oligonucleotide
gtacaaccctctcacattcgcttatgtacagtatcga

SEQ ID NO: 15295 - DNA, 37 bp, Artificial Sequence
  Synthetic oligonucleotide
aatgaggggggggtgggaaggcatcgaacagggtcga

SEQ ID NO: 15296 - DNA, 35 bp, Artificial Sequence
  Synthetic oligonucleotide
gcaacccgcccgaacgacctgcctccagcaatgac

SEQ ID NO: 15297 - DNA, 35 bp, Artificial Sequence
  Synthetic oligonucleotide
gcaggcccactcttttcgctgtgcgacccccggtc

SEQ ID NO: 15298 - DNA, 35 bp, Artificial Sequence
  Synthetic oligonucleotide
tcacacctgtccttaggtaccagttcctcaatttt

SEQ ID NO: 15299 - DNA, 37 bp, Artificial Sequence
  Synthetic oligonucleotide
gacgacggtctgcttgagcttatttcactccatttga

SEQ ID NO: 15300 - DNA, 36 bp, Artificial Sequence
  Synthetic oligonucleotide
tgcgccccccttttttgctaaaccatggctgtgata

SEQ ID NO: 15301 - DNA, 35 bp, Artificial Sequence
  Synthetic oligonucleotide
gttgcgttcatccttcttgcagtagctgcctaccc

SEQ ID NO: 15302 - DNA, 35 bp, Artificial Sequence
  Synthetic oligonucleotide
acgctcagccccctttcctcgtcctgctacgcttc

SEQ ID NO: 15303 - DNA, 35 bp, Artificial Sequence
  Synthetic oligonucleotide
gcaaccacaggcacacattgctattcatatttttg

SEQ ID NO: 15304 - DNA, 35 bp, Artificial Sequence
  Synthetic oligonucleotide
caccacattccgacgcccggacacgccctccgcct

SEQ ID NO: 15305 - DNA, 35 bp, Artificial Sequence
  Synthetic oligonucleotide
gttgtgcccatccgcaagggatcttacatccatct

SEQ ID NO: 15306 - DNA, 37 bp, Artificial Sequence
  Synthetic oligonucleotide
gtccgctacgcctgctttagcaccgttatctccttga

SEQ ID NO: 15307 - DNA, 36 bp, Artificial Sequence
  Synthetic oligonucleotide
acgctccccgattggtatcactgcctctcatcacta

SEQ ID NO: 15308 - DNA, 35 bp, Artificial Sequence
  Synthetic oligonucleotide
aggtcgtgatccgttgctgcattttttccggttcc

SEQ ID NO: 15309 - DNA, 35 bp, Artificial Sequence
  Synthetic oligonucleotide
ttgacattcccatatcctcccgtgctctgctgatc

SEQ ID NO: 15310 - DNA, 35 bp, Artificial Sequence
  Synthetic oligonucleotide
tcattctcagccagactctatcgtactaccttctg

SEQ ID NO: 15311 - DNA, 35 bp, Artificial Sequence
  Synthetic oligonucleotide
tcaatatcatccgttgtcatgggcacaccatcttt

SEQ ID NO: 15312 - DNA, 35 bp, Artificial Sequence
  Synthetic oligonucleotide
actcattgcggatgaagcacgctatcactcccttt

SEQ ID NO: 15313 - DNA, 37 bp, Artificial Sequence
  Synthetic oligonucleotide
gatagggtggggcgaatgcggagggatgacctgggga

SEQ ID NO: 15314 - DNA, 35 bp, Artificial Sequence
  Synthetic oligonucleotide
accaccctaccggacggcctctgggaccgccaaac

SEQ ID NO: 15315 - DNA, 35 bp, Artificial Sequence
  Synthetic oligonucleotide
agcagtccctcaggccacccacgattatcgccacc

SEQ ID NO: 15316 - DNA, 35 bp, Artificial Sequence
  Synthetic oligonucleotide
actgatcctggcatcttggttcgctattagccccc

SEQ ID NO: 15317 - DNA, 36 bp, Artificial Sequence
  Synthetic oligonucleotide
atagactcggatcagacgcgctacctggccacccca

SEQ ID NO: 15318 - DNA, 36 bp, Artificial Sequence
  Synthetic oligonucleotide
taaccaccgccttgacccaattaaacacgactcgga

SEQ ID NO: 15319 - DNA, 35 bp, Artificial Sequence
  Synthetic oligonucleotide
gacgcccgatacgactaccgcgccacttcgtttac

SEQ ID NO: 15320 - DNA, 35 bp, Artificial Sequence
  Synthetic oligonucleotide
tcacacctagacttgtttacggcttttcattttat

SEQ ID NO: 15321 - DNA, 38 bp, Artificial Sequence
  Synthetic oligonucleotide
atggggatcggaaagaggcaagggaaagcggcatctga

SEQ ID NO: 15322 - DNA, 38 bp, Artificial Sequence
  Synthetic oligonucleotide
accgcccccgcatccgcctgacactccttgatctctga

SEQ ID NO: 15323 - DNA, 38 bp, Artificial Sequence
  Synthetic oligonucleotide
tcgcatgcccatcccggtacttttttgaacgcccttga

SEQ ID NO: 15324 - DNA, 36 bp, Artificial Sequence
  Synthetic oligonucleotide
acgatccacactggtactctgtcaaaacaagcttga

SEQ ID NO: 15325 - DNA, 35 bp, Artificial Sequence
  Synthetic oligonucleotide
atgttccaccaccacccagccataggggacgccta

SEQ ID NO: 15326 - DNA, 35 bp, Artificial Sequence
  Synthetic oligonucleotide
actattgcgcctcgacctgtaccacctggcttatc

SEQ ID NO: 15327 - DNA, 35 bp, Artificial Sequence
  Synthetic oligonucleotide
gaggcacacgccatacttctccgtttttgttcctc

SEQ ID NO: 15328 - DNA, 35 bp, Artificial Sequence
  Synthetic oligonucleotide
gccgctgacgtctgctttttattggtcgtgcccct

SEQ ID NO: 15329 - DNA, 35 bp, Artificial Sequence
  Synthetic oligonucleotide
tgacagctcgctgcaccccaccgcaacttgacgct

SEQ ID NO: 15330 - DNA, 35 bp, Artificial Sequence
  Synthetic oligonucleotide
tccccaggcatccctcgttgcacgtctcccccgca

SEQ ID NO: 15331 - DNA, 36 bp, Artificial Sequence
  Synthetic oligonucleotide
gtcacccctctatacgccgacgtctcttgcttcgca

SEQ ID NO: 15332 - DNA, 36 bp, Artificial Sequence
  Synthetic oligonucleotide
ggaaagggctgaagcagttggggagggaataatgca

SEQ ID NO: 15333 - DNA, 37 bp, Artificial Sequence
  Synthetic oligonucleotide
gattgccccttcccggttatagttcgccttcttccga

SEQ ID NO: 15334 - DNA, 36 bp, Artificial Sequence
  Synthetic oligonucleotide
tgagaccatctttgggtacaattgcactcgccctca

SEQ ID NO: 15335 - DNA, 37 bp, Artificial Sequence
  Synthetic oligonucleotide
gaccacgccccagaccaatcacagctcacgttcacga

SEQ ID NO: 15336 - DNA, 37 bp, Artificial Sequence
  Synthetic oligonucleotide
acccatgctcacagtacctcatcgttcctcctactga

SEQ ID NO: 15337 - DNA, 38 bp, Artificial Sequence
  Synthetic oligonucleotide
agcgacaacgtagctcggcatgcttaacctccccctga

SEQ ID NO: 15338 - DNA, 34 bp, Artificial Sequence
  Synthetic oligonucleotide
tccgaccgccgactaaccctcccatagcggctta

SEQ ID NO: 15339 - DNA, 35 bp, Artificial Sequence
  Synthetic oligonucleotide
accaccatcaatgtcttctgttttcttggccagcc

SEQ ID NO: 15340 - DNA, 35 bp, Artificial Sequence
  Synthetic oligonucleotide
tacccgacttcttgccctgttgtacctatgcgcat

SEQ ID NO: 15341 - DNA, 35 bp, Artificial Sequence
  Synthetic oligonucleotide
gaaccccgatatccctgtttgaccgttgttggact

SEQ ID NO: 15342 - DNA, 37 bp, Artificial Sequence
  Synthetic oligonucleotide
gccgggtcgggtgggctcggaggaggttgaggatgga

SEQ ID NO: 15343 - DNA, 36 bp, Artificial Sequence
  Synthetic oligonucleotide
gaccactgtcacgccggcctgaccgtaccctcgcta

SEQ ID NO: 15344 - DNA, 31 bp, Artificial Sequence
  Synthetic oligonucleotide
ttcccgcccctgtccgccggttctcatccca

SEQ ID NO: 15345 - DNA, 35 bp, Artificial Sequence
  Synthetic oligonucleotide
gtgccccttgcatggagaatacgacctttaaaacc

SEQ ID NO: 15346 - DNA, 35 bp, Artificial Sequence
  Synthetic oligonucleotide
gccaacttaccaaactgcctaggagcaccttttgc

SEQ ID NO: 15347 - DNA, 37 bp, Artificial Sequence
  Synthetic oligonucleotide
ttcaccatcttaggagtcctatcctctgccccacaga

SEQ ID NO: 15348 - DNA, 37 bp, Artificial Sequence
  Synthetic oligonucleotide
tttctgcgcacacctttccggcacatctctcgcgcga

SEQ ID NO: 15349 - DNA, 35 bp, Artificial Sequence
  Synthetic oligonucleotide
gtgtaccccatacccgcctattgcatggttctacc

SEQ ID NO: 15350 - DNA, 35 bp, Artificial Sequence
  Synthetic oligonucleotide
tttgcacaagccaccaggacgtacaggtcccaagc

SEQ ID NO: 15351 - DNA, 35 bp, Artificial Sequence
  Synthetic oligonucleotide
acgtcgcaaccggcccccactcttttgccaccgtg

SEQ ID NO: 15352 - DNA, 35 bp, Artificial Sequence
  Synthetic oligonucleotide
gattccatcctgttttgcttttgtgatacatcacc

SEQ ID NO: 15353 - DNA, 35 bp, Artificial Sequence
  Synthetic oligonucleotide
tgcctacccgatcatcacagcgtcgcggtcccgcc

SEQ ID NO: 15354 - DNA, 35 bp, Artificial Sequence
  Synthetic oligonucleotide
gccacgttggaaaacccgcagctgcccctcaccgc

SEQ ID NO: 15355 - DNA, 36 bp, Artificial Sequence
  Synthetic oligonucleotide
gcaaacgcacgtttctctcctgcccattgtagtcaa

SEQ ID NO: 15356 - DNA, 36 bp, Artificial Sequence
  Synthetic oligonucleotide
gccacgctttcatgaacactgcccatcccgatcaca

SEQ ID NO: 15357 - DNA, 38 bp, Artificial Sequence
  Synthetic oligonucleotide
gtccactacgtcgatccttgaaccacctccacacctga

SEQ ID NO: 15358 - DNA, 38 bp, Artificial Sequence
  Synthetic oligonucleotide
tccacccgatatctccactgacgctgcacaggccttga

SEQ ID NO: 15359 - DNA, 35 bp, Artificial Sequence
  Synthetic oligonucleotide
gattcgccggccagcaacctccttttaatcgtgcc

SEQ ID NO: 15360 - DNA, 34 bp, Artificial Sequence
  Synthetic oligonucleotide
gaacaagcccgttccggtttcataacttcactca

SEQ ID NO: 15361 - DNA, 35 bp, Artificial Sequence
  Synthetic oligonucleotide
agtatccacacaccgcaccagacagcaacgtgcgt

SEQ ID NO: 15362 - DNA, 36 bp, Artificial Sequence
  Synthetic oligonucleotide
atgttaggtggaggaggaaaccgggggacagttcaa

SEQ ID NO: 15363 - DNA, 35 bp, Artificial Sequence
  Synthetic oligonucleotide
tagcggccccatcgtcacagtttgcccacgccacc

SEQ ID NO: 15364 - DNA, 35 bp, Artificial Sequence
  Synthetic oligonucleotide
tctgtccgtgcccgtccctttgcacatcccgtgcc

SEQ ID NO: 15365 - DNA, 36 bp, Artificial Sequence
  Synthetic oligonucleotide
ggattggcgggaaggggaagggggaaacggttggga

SEQ ID NO: 15366 - DNA, 35 bp, Artificial Sequence
  Synthetic oligonucleotide
taaggcgctacgcccctgtgcaatccacgccccac

SEQ ID NO: 15367 - DNA, 35 bp, Artificial Sequence
  Synthetic oligonucleotide
ttcaaagccgttaccgttctctctttgtctgcctg

SEQ ID NO: 15368 - DNA, 35 bp, Artificial Sequence
  Synthetic oligonucleotide
aaccgacagcacacgcacacctgctccttctttac

SEQ ID NO: 15369 - DNA, 35 bp, Artificial Sequence
  Synthetic oligonucleotide
tccccgctccgttcacaatggccattctgaaattc

SEQ ID NO: 15370 - DNA, 36 bp, Artificial Sequence
  Synthetic oligonucleotide
atggggggtagatggagggtcggggtaaggggacag

SEQ ID NO: 15371 - DNA, 35 bp, Artificial Sequence
  Synthetic oligonucleotide
gtagaccgtccaatcgaaagctaccattataccat

SEQ ID NO: 15372 - DNA, 36 bp, Artificial Sequence
  Synthetic oligonucleotide
gccgtcccctgccaatgatcccgtcgcctagcctaa

SEQ ID NO: 15373 - DNA, 37 bp, Artificial Sequence
  Synthetic oligonucleotide
tgagacccaccactctggagctccagtccaccaggga

SEQ ID NO: 15374 - DNA, 37 bp, Artificial Sequence
  Synthetic oligonucleotide
tccattcaccctctgtctctgcgaggctctcacatga

SEQ ID NO: 15375 - DNA, 38 bp, Artificial Sequence
  Synthetic oligonucleotide
tccattacactggtgtcgtaccgccctcaattacttga

SEQ ID NO: 15376 - DNA, 38 bp, Artificial Sequence
  Synthetic oligonucleotide
acgtttggccgccgcactacctgtccactattccttga

SEQ ID NO: 15377 - DNA, 35 bp, Artificial Sequence
  Synthetic oligonucleotide
agtccgccccaatgaacggtcacttactgcattcc

SEQ ID NO: 15378 - DNA, 33 bp, Artificial Sequence
  Synthetic oligonucleotide
gcgagccgcacgccacccaaactacatcccttg

SEQ ID NO: 15379 - DNA, 38 bp, Artificial Sequence
  Synthetic oligonucleotide
tgaggacggggaggtgctaaatggggagggatcgttga

SEQ ID NO: 15380 - DNA, 35 bp, Artificial Sequence
  Synthetic oligonucleotide
aaagactgccgcctccatccttgtcatttatggct

SEQ ID NO: 15381 - DNA, 35 bp, Artificial Sequence
  Synthetic oligonucleotide
gctatcatcgcgcccctccggtaatacacttttca

SEQ ID NO: 15382 - DNA, 38 bp, Artificial Sequence
  Synthetic oligonucleotide
tccgccccgagtcggaatcctgtaccgcttcaccttga

SEQ ID NO: 15383 - DNA, 35 bp, Artificial Sequence
  Synthetic oligonucleotide
gttgcggaagacgctcatctcaaacatcctgctac

SEQ ID NO: 15384 - DNA, 35 bp, Artificial Sequence
  Synthetic oligonucleotide
atcacctgtcagcccttgctgcgaacgcttctctt

SEQ ID NO: 15385 - DNA, 35 bp, Artificial Sequence
  Synthetic oligonucleotide
gttgacgcccacccacgcattatcaatgcaatttg

SEQ ID NO: 15386 - DNA, 35 bp, Artificial Sequence
  Synthetic oligonucleotide
gcttcactaccgcagccacaccttcgcctggatct

SEQ ID NO: 15387 - DNA, 35 bp, Artificial Sequence
  Synthetic oligonucleotide
tagtgagtgtacatccgcgtatgcttggtccctct

SEQ ID NO: 15388 - DNA, 35 bp, Artificial Sequence
  Synthetic oligonucleotide
tcacaaccttcccacatgttctggaatacgttaaa

SEQ ID NO: 15389 - DNA, 35 bp, Artificial Sequence
  Synthetic oligonucleotide
gcactgcacaatcgcttccccccgcccgtggccga

SEQ ID NO: 15390 - DNA, 38 bp, Artificial Sequence
  Synthetic oligonucleotide
tagcaacgacggcccctcttaattggacccttccctga

SEQ ID NO: 15391 - DNA, 37 bp, Artificial Sequence
  Synthetic oligonucleotide
gtgtaccgcgctgtctgtcatttccgtaccatcctga

SEQ ID NO: 15392 - DNA, 36 bp, Artificial Sequence
  Synthetic oligonucleotide
ggatcacgccctgacgtccaactgttttcacggcta

SEQ ID NO: 15393 - DNA, 35 bp, Artificial Sequence
  Synthetic oligonucleotide
tctgacctcctccaaatcgcgtgcaggggatctcc

SEQ ID NO: 15394 - DNA, 35 bp, Artificial Sequence
  Synthetic oligonucleotide
tccacccatgggtccttcaggattttctcattctt

SEQ ID NO: 15395 - DNA, 35 bp, Artificial Sequence
  Synthetic oligonucleotide
aacacggcccagccgatctccaagccgtaccttct

SEQ ID NO: 15396 - DNA, 38 bp, Artificial Sequence
  Synthetic oligonucleotide
tatcaccctgccgcacccctgctccacaacacagctga

SEQ ID NO: 15397 - DNA, 35 bp, Artificial Sequence
  Synthetic oligonucleotide
ttcatcgcctgtcacgcccatcccagtcagacgcc

SEQ ID NO: 15398 - DNA, 35 bp, Artificial Sequence
  Synthetic oligonucleotide
acctgtccagagggcgctcgtgcattttcattttc

SEQ ID NO: 15399 - DNA, 37 bp, Artificial Sequence
  Synthetic oligonucleotide
gatacgcctcatcttcttcctcgaccctgcccgggga

SEQ ID NO: 15400 - DNA, 35 bp, Artificial Sequence
  Synthetic oligonucleotide
ggatcacctcgctttcgtatcgccacacggaccta

SEQ ID NO: 15401 - DNA, 36 bp, Artificial Sequence
  Synthetic oligonucleotide
ttgcaacatacacatcacacccgttacaggcgagta

SEQ ID NO: 15402 - DNA, 35 bp, Artificial Sequence
  Synthetic oligonucleotide
aataggggcaaaggaggcgcaaagcaagggggtac

SEQ ID NO: 15403 - DNA, 35 bp, Artificial Sequence
  Synthetic oligonucleotide
acatcgcctatttcctcggtgtcgccgttacgacc

SEQ ID NO: 15404 - DNA, 35 bp, Artificial Sequence
  Synthetic oligonucleotide
gatatctccccgccatatagacctgcatgttctcg

SEQ ID NO: 15405 - DNA, 35 bp, Artificial Sequence
  Synthetic oligonucleotide
gttcgactaccgcccagcattattttacatcccca

SEQ ID NO: 15406 - DNA, 35 bp, Artificial Sequence
  Synthetic oligonucleotide
taaccatccgcggttatgcgcctggtctctatcca

SEQ ID NO: 15407 - DNA, 35 bp, Artificial Sequence
  Synthetic oligonucleotide
gacccgggtcccaggtttttcatggtccaatcccc

SEQ ID NO: 15408 - DNA, 35 bp, Artificial Sequence
  Synthetic oligonucleotide
tacgatgcagccatatatagtgatttctactgcct

SEQ ID NO: 15409 - DNA, 35 bp, Artificial Sequence
  Synthetic oligonucleotide
tgaggctgtacttgctggttcttgtccctccctct

SEQ ID NO: 15410 - DNA, 37 bp, Artificial Sequence
  Synthetic oligonucleotide
actcgacagaccactctgtttttacttccattatcga

SEQ ID NO: 15411 - DNA, 36 bp, Artificial Sequence
  Synthetic oligonucleotide
gtgaagttggagagcagggggggtagggcaggggga

SEQ ID NO: 15412 - DNA, 37 bp, Artificial Sequence
  Synthetic oligonucleotide
gcccaccgagactcctgtacgacctgttttatcctga

SEQ ID NO: 15413 - DNA, 36 bp, Artificial Sequence
  Synthetic oligonucleotide
actacccgccccagaccttggcccttatctgtatca

SEQ ID NO: 15414 - DNA, 38 bp, Artificial Sequence
  Synthetic oligonucleotide
aacagggaggccaagagtgggtgcagcgatgggagtga

SEQ ID NO: 15415 - DNA, 35 bp, Artificial Sequence
  Synthetic oligonucleotide
gatgcgaaagtagggaagggacgggtgcgacggtg

SEQ ID NO: 15416 - DNA, 35 bp, Artificial Sequence
  Synthetic oligonucleotide
gtcgactcgctcccatgttcttatctcgcggttct

SEQ ID NO: 15417 - DNA, 38 bp, Artificial Sequence
  Synthetic oligonucleotide
tagccaccacatacgtgcaatgttcatcacgtccctga

SEQ ID NO: 15418 - DNA, 38 bp, Artificial Sequence
  Synthetic oligonucleotide
atggtgctggttgttctttgcttcgttcgcttctctga

SEQ ID NO: 15419 - DNA, 36 bp, Artificial Sequence
  Synthetic oligonucleotide
ttgccacctccactattggatctaactacttttgca

SEQ ID NO: 15420 - DNA, 36 bp, Artificial Sequence
  Synthetic oligonucleotide
tgtgccccgcaaacacacgtatctcaggaaaccgaa

SEQ ID NO: 15421 - DNA, 36 bp, Artificial Sequence
  Synthetic oligonucleotide
atcccagtcggctccttgtccaatgcctccaaccca

SEQ ID NO: 15422 - DNA, 35 bp, Artificial Sequence
  Synthetic oligonucleotide
tgcctcacatatctgtcctcaaactcctgaacacg

SEQ ID NO: 15423 - DNA, 35 bp, Artificial Sequence
  Synthetic oligonucleotide
gtccctcgcaacagttgcaccgttccactagttct

SEQ ID NO: 15424 - DNA, 37 bp, Artificial Sequence
  Synthetic oligonucleotide
tatttgcaccagccccgcttcgatcctgccttcctga

SEQ ID NO: 15425 - DNA, 35 bp, Artificial Sequence
  Synthetic oligonucleotide
acaacccggtcccttagcctatctagacctgtttc

SEQ ID NO: 15426 - DNA, 37 bp, Artificial Sequence
  Synthetic oligonucleotide
gatgtagccccaatctctaggccgacacttatcccga

SEQ ID NO: 15427 - DNA, 36 bp, Artificial Sequence
  Synthetic oligonucleotide
cagtactgctgggacacaccggcatcttatatcata

SEQ ID NO: 15428 - DNA, 35 bp, Artificial Sequence
  Synthetic oligonucleotide
gacgaggaaagaaggaaagaagggggaagggatgg

SEQ ID NO: 15429 - DNA, 36 bp, Artificial Sequence
  Synthetic oligonucleotide
gacccaggcacgatgatccgttgttctcgcttgtcc

SEQ ID NO: 15430 - DNA, 35 bp, Artificial Sequence
  Synthetic oligonucleotide
accccgactccctcctgttatctcaggggacaatc

SEQ ID NO: 15431 - DNA, 36 bp, Artificial Sequence
  Synthetic oligonucleotide
tacacacacgacctttaggaaaactgcacttgggaa

SEQ ID NO: 15432 - DNA, 38 bp, Artificial Sequence
  Synthetic oligonucleotide
gctcgaacgtggagaggatggagtaggaaggatggtga

SEQ ID NO: 15433 - DNA, 38 bp, Artificial Sequence
  Synthetic oligonucleotide
actgcccactctgcatactctagctgactctcttgtga

SEQ ID NO: 15434 - DNA, 35 bp, Artificial Sequence
  Synthetic oligonucleotide
gactgacggtcgcgggtcttttcactccccaccca

SEQ ID NO: 15435 - DNA, 37 bp, Artificial Sequence
  Synthetic oligonucleotide
actcaccaaccgccacgtcccacagcgatgtttggga

SEQ ID NO: 15436 - DNA, 37 bp, Artificial Sequence
  Synthetic oligonucleotide
gcaacctgctcccgtttgacagcctctccttcgttga

SEQ ID NO: 15437 - DNA, 35 bp, Artificial Sequence
  Synthetic oligonucleotide
ggataccaccgccgatgatccggctgaaccacccc

SEQ ID NO: 15438 - DNA, 35 bp, Artificial Sequence
  Synthetic oligonucleotide
gcatcacctgtcttgttcccgcgcgcattcctccg

SEQ ID NO: 15439 - DNA, 35 bp, Artificial Sequence
  Synthetic oligonucleotide
gccccgcacttcagcgcttcatccctgggttctgt

SEQ ID NO: 15440 - DNA, 38 bp, Artificial Sequence
  Synthetic oligonucleotide
agagggagggcgggtttatcagggagaagtcagtctga

SEQ ID NO: 15441 - DNA, 35 bp, Artificial Sequence
  Synthetic oligonucleotide
tttcacgcatcaatcctcttgcaccagaccgccta

SEQ ID NO: 15442 - DNA, 35 bp, Artificial Sequence
  Synthetic oligonucleotide
gactcgcgaactttgccaggattaaaacgctctcc

SEQ ID NO: 15443 - DNA, 35 bp, Artificial Sequence
  Synthetic oligonucleotide
gatgactaggccacgatccagcttatccacccact

SEQ ID NO: 15444 - DNA, 35 bp, Artificial Sequence
  Synthetic oligonucleotide
atactcggcaatgaacactcgcccccacaattcct

SEQ ID NO: 15445 - DNA, 36 bp, Artificial Sequence
  Synthetic oligonucleotide
tgacgagctcacatacgacgcccgcacttctcccta

SEQ ID NO: 15446 - DNA, 36 bp, Artificial Sequence
  Synthetic oligonucleotide
tgagctcagtccagtgttcgctccatcgcattttta

SEQ ID NO: 15447 - DNA, 35 bp, Artificial Sequence
  Synthetic oligonucleotide
atgtggtcgcccctcaccgtaaaggtcactttttc

SEQ ID NO: 15448 - DNA, 35 bp, Artificial Sequence
  Synthetic oligonucleotide
actgccccccctgggtgcctacccttttcctctcg

SEQ ID NO: 15449 - DNA, 37 bp, Artificial Sequence
  Synthetic oligonucleotide
tatacgcggccaggtgccaccccccaccctatcccga

SEQ ID NO: 15450 - DNA, 37 bp, Artificial Sequence
  Synthetic oligonucleotide
tcatgcgcgcccaccgtcaagcccctctactctccga

SEQ ID NO: 15451 - DNA, 38 bp, Artificial Sequence
  Synthetic oligonucleotide
gccacctttcgtactgccgctcatcctccttggcctga

SEQ ID NO: 15452 - DNA, 38 bp, Artificial Sequence
  Synthetic oligonucleotide
gcgtaacgtgcgctcgttcccccccgtccgttctctga

SEQ ID NO: 15453 - DNA, 35 bp, Artificial Sequence
  Synthetic oligonucleotide
ggtcacgcgcacctcaccacattgttgccatttta

SEQ ID NO: 15454 - DNA, 35 bp, Artificial Sequence
  Synthetic oligonucleotide
tgatcgcagggcaccgttgaaaggcctcccacact

SEQ ID NO: 15455 - DNA, 36 bp, Artificial Sequence
  Synthetic oligonucleotide
tacttccgcccttgacataatttgtgacgcccttca

SEQ ID NO: 15456 - DNA, 35 bp, Artificial Sequence
  Synthetic oligonucleotide
accccccccatgattcatagcccacggttcccttc

SEQ ID NO: 15457 - DNA, 35 bp, Artificial Sequence
  Synthetic oligonucleotide
tccgggttgggtaatagggggggtgggaagtagac

SEQ ID NO: 15458 - DNA, 35 bp, Artificial Sequence
  Synthetic oligonucleotide
tacccctcatcgtgctcagacccagttctcgccag

SEQ ID NO: 15459 - DNA, 36 bp, Artificial Sequence
  Synthetic oligonucleotide
ccgactcgcctttaggcaccgtccatttctgctcta

SEQ ID NO: 15460 - DNA, 35 bp, Artificial Sequence
  Synthetic oligonucleotide
accccccccatgatgcatatcccacggttcccttc

SEQ ID NO: 15461 - DNA, 38 bp, Artificial Sequence
  Synthetic oligonucleotide
agacacggggagattggggcaggttggcgagggggtga

SEQ ID NO: 15462 - DNA, 35 bp, Artificial Sequence
  Synthetic oligonucleotide
tcacctcaggagtgggccgcgttttgctattccac

SEQ ID NO: 15463 - DNA, 35 bp, Artificial Sequence
  Synthetic oligonucleotide
accacacaggctgttcatcccccctgattacgtac

SEQ ID NO: 15464 - DNA, 35 bp, Artificial Sequence
  Synthetic oligonucleotide
agactagcctcaaacgcgcgttctccctgtatctc

SEQ ID NO: 15465 - DNA, 35 bp, Artificial Sequence
  Synthetic oligonucleotide
gctcccgaaggggaattaccaccaactgctacttc

SEQ ID NO: 15466 - DNA, 35 bp, Artificial Sequence
  Synthetic oligonucleotide
tcaactaccgtgcaccgttacgacggcttttccat

SEQ ID NO: 15467 - DNA, 36 bp, Artificial Sequence
  Synthetic oligonucleotide
tacccagcgcgccacattaattcaatactgcacaca

SEQ ID NO: 15468 - DNA, 35 bp, Artificial Sequence
  Synthetic oligonucleotide
gactgccatacatggtctcctacattggacccctc

SEQ ID NO: 15469 - DNA, 35 bp, Artificial Sequence
  Synthetic oligonucleotide
agtgaggcgttcgtcgtagccaacacacacacact

SEQ ID NO: 15470 - DNA, 34 bp, Artificial Sequence
  Synthetic oligonucleotide
gtgttaagccgcagttgcctgactctcgctccct

SEQ ID NO: 15471 - DNA, 35 bp, Artificial Sequence
  Synthetic oligonucleotide
ttcaacatccacacgcctcataagatctcactggt

SEQ ID NO: 15472 - DNA, 35 bp, Artificial Sequence
  Synthetic oligonucleotide
gatctacccctgtacacttaggaccttgctttgac

SEQ ID NO: 15473 - DNA, 35 bp, Artificial Sequence
  Synthetic oligonucleotide
gtttcactccccgcctcaccgccttcgacgggact

SEQ ID NO: 15474 - DNA, 35 bp, Artificial Sequence
  Synthetic oligonucleotide
tgcgaccccaacgcacttccgcatggccccgcctt

SEQ ID NO: 15475 - DNA, 36 bp, Artificial Sequence
  Synthetic oligonucleotide
accccactcaggcagtgcgacgtcccctggctcaca

SEQ ID NO: 15476 - DNA, 38 bp, Artificial Sequence
  Synthetic oligonucleotide
acctactcccgccgatatgcctccgaggttctctctga

SEQ ID NO: 15477 - DNA, 35 bp, Artificial Sequence
  Synthetic oligonucleotide
gactggggaggaggtaggggaaactgtgcagaaac

SEQ ID NO: 15478 - DNA, 35 bp, Artificial Sequence
  Synthetic oligonucleotide
tgccggtaggagcgaacctgccccccccttattac

SEQ ID NO: 15479 - DNA, 35 bp, Artificial Sequence
  Synthetic oligonucleotide
gcattagccgcaaacgccgaggttccgcactttcc

SEQ ID NO: 15480 - DNA, 35 bp, Artificial Sequence
  Synthetic oligonucleotide
acgcgcacgtcctttctcgtcggactccttcattt

SEQ ID NO: 15481 - DNA, 37 bp, Artificial Sequence
  Synthetic oligonucleotide
gtgaccccatctgacgcacgccactactcttgatcga

SEQ ID NO: 15482 - DNA, 35 bp, Artificial Sequence
  Synthetic oligonucleotide
gacgcccaattggattttttttgccactttccgtt

SEQ ID NO: 15483 - DNA, 36 bp, Artificial Sequence
  Synthetic oligonucleotide
aaccgccatacgaagtcatggaccaccttatttgaa

SEQ ID NO: 15484 - DNA, 36 bp, Artificial Sequence
  Synthetic oligonucleotide
gtcacaccaacttgagcttccccgtacagatctaca

SEQ ID NO: 15485 - DNA, 37 bp, Artificial Sequence
  Synthetic oligonucleotide
gggggtggggcgttctcagttggggacgacgagggga

SEQ ID NO: 15486 - DNA, 36 bp, Artificial Sequence
  Synthetic oligonucleotide
ttggttctgcctcgcctagcacgaccgcccctagta

SEQ ID NO: 15487 - DNA, 35 bp, Artificial Sequence
  Synthetic oligonucleotide
gacatcctctccacctttcggcacgtagttacctc

SEQ ID NO: 15488 - DNA, 36 bp, Artificial Sequence
  Synthetic oligonucleotide
gcaaccatcgctccactgtctttcgctagcccaaaa

SEQ ID NO: 15489 - DNA, 36 bp, Artificial Sequence
  Synthetic oligonucleotide
accgccccacagcatatcatccaaaatggcacacca

SEQ ID NO: 15490 - DNA, 37 bp, Artificial Sequence
  Synthetic oligonucleotide
tatgacggccctgacttgttactccttctcactatga

SEQ ID NO: 15491 - DNA, 35 bp, Artificial Sequence
  Synthetic oligonucleotide
tccccacttgccctgcgtttcgcgttacacctgac

SEQ ID NO: 15492 - DNA, 37 bp, Artificial Sequence
  Synthetic oligonucleotide
gacgccgccccctcgaccatatcgggcccgggtttac

SEQ ID NO: 15493 - DNA, 35 bp, Artificial Sequence
  Synthetic oligonucleotide
catccaccccaggactcacgacaacgagtgggtct

SEQ ID NO: 15494 - DNA, 35 bp, Artificial Sequence
  Synthetic oligonucleotide
tgtgtgtgtcaccgttcccctcacccaatgcgaaa

SEQ ID NO: 15495 - DNA, 37 bp, Artificial Sequence
  Synthetic oligonucleotide
tgtcagtcggtcggcctctacctcgcctgcccttgga

SEQ ID NO: 15496 - DNA, 35 bp, Artificial Sequence
  Synthetic oligonucleotide
gacaacgaccgcgccctcaaccactgaagcctcac

SEQ ID NO: 15497 - DNA, 35 bp, Artificial Sequence
  Synthetic oligonucleotide
accgctgagcgcctacccacaactttcctcctctc

SEQ ID NO: 15498 - DNA, 35 bp, Artificial Sequence
  Synthetic oligonucleotide
ttcacagacagaagaagggtagagggatgggagag

SEQ ID NO: 15499 - DNA, 35 bp, Artificial Sequence
  Synthetic oligonucleotide
tcccgcaccccactttgaactacagtacccgcctg

SEQ ID NO: 15500 - DNA, 36 bp, Artificial Sequence
  Synthetic oligonucleotide
gcccatgtttgctggttctcgggtctcgatctcttt

SEQ ID NO: 15501 - DNA, 36 bp, Artificial Sequence
  Synthetic oligonucleotide
ttgcggtcctcccagctgctattcccattcaattca

SEQ ID NO: 15502 - DNA, 38 bp, Artificial Sequence
  Synthetic oligonucleotide
tccctgtgccaccgccttttcgttagtcctctagagga

SEQ ID NO: 15503 - DNA, 36 bp, Artificial Sequence
  Synthetic oligonucleotide
gtgtgaccgcaggtatttttccaacgcccgccctta

SEQ ID NO: 15504 - DNA, 35 bp, Artificial Sequence
  Synthetic oligonucleotide
gactgccctaaatttgtctcacatctccaccgttg

SEQ ID NO: 15505 - DNA, 35 bp, Artificial Sequence
  Synthetic oligonucleotide
gcgaggggtcgtggggacggggggttcaaggtatt

SEQ ID NO: 15506 - DNA, 38 bp, Artificial Sequence
  Synthetic oligonucleotide
tacgcgcccatgggcacgccacaacataccacctttga

SEQ ID NO: 15507 - DNA, 36 bp, Artificial Sequence
  Synthetic oligonucleotide
acctcccgtacaccccatccgatccagccctgtgta

SEQ ID NO: 15508 - DNA, 36 bp, Artificial Sequence
  Synthetic oligonucleotide
tgccaccaacagcaaccagcctatatggtcttctca

SEQ ID NO: 15509 - DNA, 38 bp, Artificial Sequence
  Synthetic oligonucleotide
ttatccaccccccatatgttgcattctaggctgtatga

SEQ ID NO: 15510 - DNA, 38 bp, Artificial Sequence
  Synthetic oligonucleotide
acactcctctgactgcgcttcgtgccttagtttactga

SEQ ID NO: 15511 - DNA, 35 bp, Artificial Sequence
  Synthetic oligonucleotide
ttcgctccctcaaagtcctttcacgccccctgctc

SEQ ID NO: 15512 - DNA, 35 bp, Artificial Sequence
  Synthetic oligonucleotide
tagtaccatccccgttcagttcccgtaggattcta

SEQ ID NO: 15513 - DNA, 35 bp, Artificial Sequence
  Synthetic oligonucleotide
tccgatcccgcatttgacccccgatgaggcgcaac

SEQ ID NO: 15514 - DNA, 35 bp, Artificial Sequence
  Synthetic oligonucleotide
acccaaggagaagtaggaatggggggtagatgaac

SEQ ID NO: 15515 - DNA, 35 bp, Artificial Sequence
  Synthetic oligonucleotide
ttgtggcccatgctgcctcttagtgtccaccctac

SEQ ID NO: 15516 - DNA, 35 bp, Artificial Sequence
  Synthetic oligonucleotide
gcacactggagcgtagtttacctcgttatcctcgc

SEQ ID NO: 15517 - DNA, 35 bp, Artificial Sequence
  Synthetic oligonucleotide
tcagcgtgtcgccgttttccggatctcgccttatc

SEQ ID NO: 15518 - DNA, 35 bp, Artificial Sequence
  Synthetic oligonucleotide
cacttgtcgcctgcattgttaattcaccgtactaa

SEQ ID NO: 15519 - DNA, 35 bp, Artificial Sequence
  Synthetic oligonucleotide
gcctgacacccactccatgttgcatttatctcatg

SEQ ID NO: 15520 - DNA, 36 bp, Artificial Sequence
  Synthetic oligonucleotide
tcctgccacgggaggagaagggcaaacaagggaaga

SEQ ID NO: 15521 - DNA, 38 bp, Artificial Sequence
  Synthetic oligonucleotide
accgacacccacccggctttaaaaaccaccatctttga

SEQ ID NO: 15522 - DNA, 36 bp, Artificial Sequence
  Synthetic oligonucleotide
tgcgacccacccatgtgttgccccgatcgcttggta

SEQ ID NO: 15523 - DNA, 35 bp, Artificial Sequence
  Synthetic oligonucleotide
acccccatatatgcctgccgtgcttagcacaatac

SEQ ID NO: 15524 - DNA, 35 bp, Artificial Sequence
  Synthetic oligonucleotide
ggtccactcgggtccgctagcaccgcctcccactc

SEQ ID NO: 15525 - DNA, 35 bp, Artificial Sequence
  Synthetic oligonucleotide
tcttccggtcacctcactacgccacctctatcgtg

SEQ ID NO: 15526 - DNA, 35 bp, Artificial Sequence
  Synthetic oligonucleotide
gccatgaccaatttgggtgatagttgcccttccct

SEQ ID NO: 15527 - DNA, 36 bp, Artificial Sequence
  Synthetic oligonucleotide
ggtgggaggaatacggataggggagagtgtgcgaaa

SEQ ID NO: 15528 - DNA, 37 bp, Artificial Sequence
  Synthetic oligonucleotide
gcgcgtagcccgaccaccttcttgccccgttcctaga

SEQ ID NO: 15529 - DNA, 38 bp, Artificial Sequence
  Synthetic oligonucleotide
attccacacccaatccctatatgtcgcggtccacgtga

SEQ ID NO: 15530 - DNA, 35 bp, Artificial Sequence
  Synthetic oligonucleotide
gcccatcgcgaagtttcggcctaccttatttctca

SEQ ID NO: 15531 - DNA, 37 bp, Artificial Sequence
  Synthetic oligonucleotide
agccaccatcagcgtacacaaccttccaatgcgccga

SEQ ID NO: 15532 - DNA, 38 bp, Artificial Sequence
  Synthetic oligonucleotide
tgttcctccgactatgctcgacgcctcctaccctccga

SEQ ID NO: 15533 - DNA, 35 bp, Artificial Sequence
  Synthetic oligonucleotide
tcagatggcctctcgtaccttgatgctggctacct

SEQ ID NO: 15534 - DNA, 36 bp, Artificial Sequence
  Synthetic oligonucleotide
acgcacgacccactatgacctcttggctgagcccga

SEQ ID NO: 15535 - DNA, 38 bp, Artificial Sequence
  Synthetic oligonucleotide
tagcccgcccgcaacttctttggctgcaacttccttga

SEQ ID NO: 15536 - DNA, 35 bp, Artificial Sequence
  Synthetic oligonucleotide
attccacccgacggcgcataaacgaaactccctgg

SEQ ID NO: 15537 - DNA, 35 bp, Artificial Sequence
  Synthetic oligonucleotide
aacacctccgccgactctggtgaccccactatggt

SEQ ID NO: 15538 - DNA, 36 bp, Artificial Sequence
  Synthetic oligonucleotide
ttccacacttacctctgggcttcatagtacttcgaa

SEQ ID NO: 15539 - DNA, 35 bp, Artificial Sequence
  Synthetic oligonucleotide
tgaccctcatcatcgagaaactgcaaatcccccgc

SEQ ID NO: 15540 - DNA, 34 bp, Artificial Sequence
  Synthetic oligonucleotide
tatccccacgacgaatagcctctatccggtacct

SEQ ID NO: 15541 - DNA, 35 bp, Artificial Sequence
  Synthetic oligonucleotide
gtcggacgacggagcttggtcgccctctcttttgt

SEQ ID NO: 15542 - DNA, 38 bp, Artificial Sequence
  Synthetic oligonucleotide
ttgggagcctcctcaatgcctttgtaccaccgccatga

SEQ ID NO: 15543 - DNA, 36 bp, Artificial Sequence
  Synthetic oligonucleotide
gcgcactcctgctgcttttttcctgaatttacacta

SEQ ID NO: 15544 - DNA, 35 bp, Artificial Sequence
  Synthetic oligonucleotide
acttcccatcccccattccaccgcgcgactaggcc

SEQ ID NO: 15545 - DNA, 35 bp, Artificial Sequence
  Synthetic oligonucleotide
atggaacaagggggaagaggcgcacgcgaaatggt

SEQ ID NO: 15546 - DNA, 36 bp, Artificial Sequence
  Synthetic oligonucleotide
ggtggggagtggtgggagttgaggggaattttcgga

SEQ ID NO: 15547 - DNA, 36 bp, Artificial Sequence
  Synthetic oligonucleotide
atccctcctcccccgtgtgtccatagccggaaaata

SEQ ID NO: 15548 - DNA, 35 bp, Artificial Sequence
  Synthetic oligonucleotide
tagggcgtagcatgtgctcgtgtcacatccccctt

SEQ ID NO: 15549 - DNA, 37 bp, Artificial Sequence
  Synthetic oligonucleotide
aaggaggacttaggggggtggggtgggaagggcagga

SEQ ID NO: 15550 - DNA, 37 bp, Artificial Sequence
  Synthetic oligonucleotide
ttcaaggcccaagtggagtggagctaaagggtgggga

SEQ ID NO: 15551 - DNA, 38 bp, Artificial Sequence
  Synthetic oligonucleotide
acatgacatacgtcgtacttctctctttcctgccgtga

SEQ ID NO: 15552 - DNA, 32 bp, Artificial Sequence
  Synthetic oligonucleotide
ggtacacctgccctgttttgtcctggtcacta

SEQ ID NO: 15553 - DNA, 35 bp, Artificial Sequence
  Synthetic oligonucleotide
ttgggaacggggcaggtacggtagttcaggggtag

SEQ ID NO: 15554 - DNA, 35 bp, Artificial Sequence
  Synthetic oligonucleotide
gatgccgatcgcgcacgcccatccctcgattttcg

SEQ ID NO: 15555 - DNA, 35 bp, Artificial Sequence
  Synthetic oligonucleotide
tcatgtcgcatgactcccctgcaacctacgttcct

SEQ ID NO: 15556 - DNA, 37 bp, Artificial Sequence
  Synthetic oligonucleotide
gatatcctcagtgccgtttcttcacccgtccgcgtga

SEQ ID NO: 15557 - DNA, 35 bp, Artificial Sequence
  Synthetic oligonucleotide
gcgaccccacgtagcgagcactcgagcggtcccac

SEQ ID NO: 15558 - DNA, 36 bp, Artificial Sequence
  Synthetic oligonucleotide
tcctcatgttcgttgcgtgttccctcggtcctgtcg

SEQ ID NO: 15559 - DNA, 35 bp, Artificial Sequence
  Synthetic oligonucleotide
gctgcatggggggggaggcaactcgggtgggtggt

SEQ ID NO: 15560 - DNA, 35 bp, Artificial Sequence
  Synthetic oligonucleotide
tgtgtgacgttctacatatgtcattctttccccca

SEQ ID NO: 15561 - DNA, 35 bp, Artificial Sequence
  Synthetic oligonucleotide
atgcccccactcgctctgctggagattccgactca

SEQ ID NO: 15562 - DNA, 36 bp, Artificial Sequence
  Synthetic oligonucleotide
taccccttttgcgtcacgactgctacaccttcccga

SEQ ID NO: 15563 - DNA, 37 bp, Artificial Sequence
  Synthetic oligonucleotide
aatcaccctcgatatgttaccttctgccttctgttga

SEQ ID NO: 15564 - DNA, 35 bp, Artificial Sequence
  Synthetic oligonucleotide
gtccacaccgttaccgccatggattcattggcctc

SEQ ID NO: 15565 - DNA, 35 bp, Artificial Sequence
  Synthetic oligonucleotide
ggtcacgctcccacactgcccctttgcaatcgccg

SEQ ID NO: 15566 - DNA, 35 bp, Artificial Sequence
  Synthetic oligonucleotide
tagtcgccgacgaccatatctcttcccctgctact

SEQ ID NO: 15567 - DNA, 35 bp, Artificial Sequence
  Synthetic oligonucleotide
gtatgtgcacgccgcccggtcttactacctccgtt

SEQ ID NO: 15568 - DNA, 38 bp, Artificial Sequence
  Synthetic oligonucleotide
acgagaagtgaggtggtgtggggcaggtaggctaatga

SEQ ID NO: 15569 - DNA, 36 bp, Artificial Sequence
  Synthetic oligonucleotide
tgtaccctgcttgagtaatccgggccttatctttca

SEQ ID NO: 15570 - DNA, 35 bp, Artificial Sequence
  Synthetic oligonucleotide
gaccacccgctcgcattattctgtttctggccgga

SEQ ID NO: 15571 - DNA, 35 bp, Artificial Sequence
  Synthetic oligonucleotide
gttccaccttatcgttgcccccccatgatgacgta

SEQ ID NO: 15572 - DNA, 35 bp, Artificial Sequence
  Synthetic oligonucleotide
acatagtggcgcaacctattcgttcaacctggccc

SEQ ID NO: 15573 - DNA, 35 bp, Artificial Sequence
  Synthetic oligonucleotide
tccccttgcattgttattccgcctgtcccatattg

SEQ ID NO: 15574 - DNA, 35 bp, Artificial Sequence
  Synthetic oligonucleotide
tccccccgccgcacagatctgcgatccacgttact

SEQ ID NO: 15575 - DNA, 37 bp, Artificial Sequence
  Synthetic oligonucleotide
ggttagggaaggtgggataacaatgggtagaaaagga

SEQ ID NO: 15576 - DNA, 35 bp, Artificial Sequence
  Synthetic oligonucleotide
tgaggaaatcgggagggagggaggggggcaagaag

SEQ ID NO: 15577 - DNA, 36 bp, Artificial Sequence
  Synthetic oligonucleotide
gtcaccctctgccctaagccggccccgtaccgagaa

SEQ ID NO: 15578 - DNA, 36 bp, Artificial Sequence
  Synthetic oligonucleotide
accagcccggaagcgtgcttctattacaccttctaa

SEQ ID NO: 15579 - DNA, 36 bp, Artificial Sequence
  Synthetic oligonucleotide
tgatgccgttccaccgtaccgaaagtcgccttgtca

SEQ ID NO: 15580 - DNA, 35 bp, Artificial Sequence
  Synthetic oligonucleotide
gatcattacccgacgagtcataagccctgacctcc

SEQ ID NO: 15581 - DNA, 35 bp, Artificial Sequence
  Synthetic oligonucleotide
tcacctcccgtactgcaggtcgttccctatcgcat

SEQ ID NO: 15582 - DNA, 35 bp, Artificial Sequence
  Synthetic oligonucleotide
agcccccgcacacgcttatggtacacaacgttttt

SEQ ID NO: 15583 - DNA, 37 bp, Artificial Sequence
  Synthetic oligonucleotide
acatctccgctccaactttcaaaacggtctgccagga

SEQ ID NO: 15584 - DNA, 38 bp, Artificial Sequence
  Synthetic oligonucleotide
acttgcgcccattgcacctccgctgttcctcacgttga

SEQ ID NO: 15585 - DNA, 38 bp, Artificial Sequence
  Synthetic oligonucleotide
acaccgccccgcccactgttttctgaattattggttga

SEQ ID NO: 15586 - DNA, 35 bp, Artificial Sequence
  Synthetic oligonucleotide
accatcactggacgccacgtacctacagtccgccc

SEQ ID NO: 15587 - DNA, 36 bp, Artificial Sequence
  Synthetic oligonucleotide
tattcccccgcccgacatgaccctatagtttacaca

SEQ ID NO: 15588 - DNA, 36 bp, Artificial Sequence
  Synthetic oligonucleotide
tccatgccccttccccttactaagcaggttcctcga

SEQ ID NO: 15589 - DNA, 37 bp, Artificial Sequence
  Synthetic oligonucleotide
ttgctacccagtgtcataatccttgccctttcactga

SEQ ID NO: 15590 - DNA, 38 bp, Artificial Sequence
  Synthetic oligonucleotide
ttggcccctcccacctgcgtcgtacgcagcactgttga

SEQ ID NO: 15591 - DNA, 35 bp, Artificial Sequence
  Synthetic oligonucleotide
cactcccatcatggtgccccttaatcggttttatc

SEQ ID NO: 15592 - DNA, 35 bp, Artificial Sequence
  Synthetic oligonucleotide
gtgcacgaccttccgcaagtacttattgtcctcgt

SEQ ID NO: 15593 - DNA, 37 bp, Artificial Sequence
  Synthetic oligonucleotide
tccaccgtgaagcgtactaccattcatcgcccctcga

SEQ ID NO: 15594 - DNA, 37 bp, Artificial Sequence
  Synthetic oligonucleotide
gaggtcggagaaggaggaagaatgccgaccgcaagga

SEQ ID NO: 15595 - DNA, 36 bp, Artificial Sequence
  Synthetic oligonucleotide
aacgattcccctatgtctctgcactgtgttaccgca

SEQ ID NO: 15596 - DNA, 37 bp, Artificial Sequence
  Synthetic oligonucleotide
actaaccatccatccatgtcctaagtgccatcgcgga

SEQ ID NO: 15597 - DNA, 36 bp, Artificial Sequence
  Synthetic oligonucleotide
tcagatgtgtctgtttcatccctgtgccacccgcta

SEQ ID NO: 15598 - DNA, 35 bp, Artificial Sequence
  Synthetic oligonucleotide
aagaccgtccacgcttggctgttcaccgctcttat

SEQ ID NO: 15599 - DNA, 36 bp, Artificial Sequence
  Synthetic oligonucleotide
acctaagcctcacgggaagccaccgccgatctacca

SEQ ID NO: 15600 - DNA, 37 bp, Artificial Sequence
  Synthetic oligonucleotide
gtaggcgggggccggggaagggcggaatcgagagcga

SEQ ID NO: 15601 - DNA, 38 bp, Artificial Sequence
  Synthetic oligonucleotide
gtatggtcgggggagggggaatactcgtgggtgggtga

SEQ ID NO: 15602 - DNA, 35 bp, Artificial Sequence
  Synthetic oligonucleotide
tacacacaccgatgcatgtccctgcaaccgacacc

SEQ ID NO: 15603 - DNA, 35 bp, Artificial Sequence
  Synthetic oligonucleotide
gtgacacctatctcttgcgttctgtcctcctcttc

SEQ ID NO: 15604 - DNA, 35 bp, Artificial Sequence
  Synthetic oligonucleotide
gctacgcccgtgagtcactagtcttttggctctct

SEQ ID NO: 15605 - DNA, 35 bp, Artificial Sequence
  Synthetic oligonucleotide
atacgacaggcattttcacctcctgctatgctaac

SEQ ID NO: 15606 - DNA, 35 bp, Artificial Sequence
  Synthetic oligonucleotide
tcgccctcacgcctccaatcgcggacctaaaaccc

SEQ ID NO: 15607 - DNA, 35 bp, Artificial Sequence
  Synthetic oligonucleotide
gagtgccaatttgggcccatatgcttctcgtaccc

SEQ ID NO: 15608 - DNA, 35 bp, Artificial Sequence
  Synthetic oligonucleotide
atgctagcagaggggatggtgtcttcgtgtgtgtg

SEQ ID NO: 15609 - DNA, 35 bp, Artificial Sequence
  Synthetic oligonucleotide
tgctacacagcgctgctattccgttagttttttat

SEQ ID NO: 15610 - DNA, 35 bp, Artificial Sequence
  Synthetic oligonucleotide
taccgtacctcccaccgatcttgacacaatgttca

SEQ ID NO: 15611 - DNA, 35 bp, Artificial Sequence
  Synthetic oligonucleotide
agaccgttcctcctgtccacacccctgctgcctac

SEQ ID NO: 15612 - DNA, 34 bp, Artificial Sequence
  Synthetic oligonucleotide
gcaatcagagcccatacgccctggataccctacc

SEQ ID NO: 15613 - DNA, 35 bp, Artificial Sequence
  Synthetic oligonucleotide
gcccgcaatctttacatccaccccttcgacaaggc

SEQ ID NO: 15614 - DNA, 35 bp, Artificial Sequence
  Synthetic oligonucleotide
gactggtagtagtagcatcacctccatttttttgt

SEQ ID NO: 15615 - DNA, 35 bp, Artificial Sequence
  Synthetic oligonucleotide
tccaaccacctgctaatatttaaggttttccactt

SEQ ID NO: 15616 - DNA, 35 bp, Artificial Sequence
  Synthetic oligonucleotide
ttggcccgcgagcactgtttcatctccccatactt

SEQ ID NO: 15617 - DNA, 35 bp, Artificial Sequence
  Synthetic oligonucleotide
acctccctgcgattccgctgctccgttgttccctt

SEQ ID NO: 15618 - DNA, 36 bp, Artificial Sequence
  Synthetic oligonucleotide
gcacaccacgcttaacactacatgccgtacttacca

SEQ ID NO: 15619 - DNA, 36 bp, Artificial Sequence
  Synthetic oligonucleotide
gtgccctccaataccactagggactccttgaattca

SEQ ID NO: 15620 - DNA, 36 bp, Artificial Sequence
  Synthetic oligonucleotide
attccgccccttttggtggtgacactacttccttca

SEQ ID NO: 15621 - DNA, 35 bp, Artificial Sequence
  Synthetic oligonucleotide
tcccctccagtccacggtcccgatcgcattctcgc

SEQ ID NO: 15622 - DNA, 35 bp, Artificial Sequence
  Synthetic oligonucleotide
gtccactcgaaacacctggctgccttcctttattg

SEQ ID NO: 15623 - DNA, 35 bp, Artificial Sequence
  Synthetic oligonucleotide
agcgccaccacctctgccatactacggccttcatt

SEQ ID NO: 15624 - DNA, 37 bp, Artificial Sequence
  Synthetic oligonucleotide
taatgcccactccccgccgacgtcacagccccaccga

SEQ ID NO: 15625 - DNA, 37 bp, Artificial Sequence
  Synthetic oligonucleotide
gatcagccatcgcgctctgacattccatcgactccga

SEQ ID NO: 15626 - DNA, 38 bp, Artificial Sequence
  Synthetic oligonucleotide
gcctggatccgttaccgtgccaacgccactccatttga

SEQ ID NO: 15627 - DNA, 35 bp, Artificial Sequence
  Synthetic oligonucleotide
actccccatcgcactgaaaggaccgcactgtactc

SEQ ID NO: 15628 - DNA, 35 bp, Artificial Sequence
  Synthetic oligonucleotide
gggaaaggtgcgagttaatacggggtggtgcggtt

SEQ ID NO: 15629 - DNA, 38 bp, Artificial Sequence
  Synthetic oligonucleotide
gatgcccacttaggtcccgtaccaccaacccagtttga

SEQ ID NO: 15630 - DNA, 35 bp, Artificial Sequence
  Synthetic oligonucleotide
acatgacggcctattttcacctgcgcaccgctcgc

SEQ ID NO: 15631 - DNA, 35 bp, Artificial Sequence
  Synthetic oligonucleotide
atgacgcatctctcttgccagttttgtgccgtgtt

SEQ ID NO: 15632 - DNA, 36 bp, Artificial Sequence
  Synthetic oligonucleotide
atcaccgccctgttttcgtaactcattcctcctaaa

SEQ ID NO: 15633 - DNA, 36 bp, Artificial Sequence
  Synthetic oligonucleotide
gatccgcgaccatggtctgttgttacctcctcctga

SEQ ID NO: 15634 - DNA, 35 bp, Artificial Sequence
  Synthetic oligonucleotide
gccccaccgatgttcacgtcgccgagtttcgcaac

SEQ ID NO: 15635 - DNA, 35 bp, Artificial Sequence
  Synthetic oligonucleotide
cctatcgcctctgccaacctgcccgatctttagct

SEQ ID NO: 15636 - DNA, 35 bp, Artificial Sequence
  Synthetic oligonucleotide
tcaacgcccatattgtcaccctgcccggtctgtgt

SEQ ID NO: 15637 - DNA, 37 bp, Artificial Sequence
  Synthetic oligonucleotide
gtctccctagccttattctgtcacgccccttacatga

SEQ ID NO: 15638 - DNA, 36 bp, Artificial Sequence
  Synthetic oligonucleotide
atttgaccatccacaccaccaaagagacaacgagta

SEQ ID NO: 15639 - DNA, 36 bp, Artificial Sequence
  Synthetic oligonucleotide
aagatggggtgcgggttaggtcaaagggggctcgta

SEQ ID NO: 15640 - DNA, 35 bp, Artificial Sequence
  Synthetic oligonucleotide
aagtgcaggatccctgatcggcacacacactccac

SEQ ID NO: 15641 - DNA, 35 bp, Artificial Sequence
  Synthetic oligonucleotide
tcccgtggtcacaggtctctctggcaattaatccc

SEQ ID NO: 15642 - DNA, 35 bp, Artificial Sequence
  Synthetic oligonucleotide
gccctcctttagcccgtgcaccattagccatgttc

SEQ ID NO: 15643 - DNA, 36 bp, Artificial Sequence
  Synthetic oligonucleotide
tgtccttgcgcacctatacactttggcccctttcaa

SEQ ID NO: 15644 - DNA, 36 bp, Artificial Sequence
  Synthetic oligonucleotide
agtccccagatctgtgggcctttttccgttccatca

SEQ ID NO: 15645 - DNA, 37 bp, Artificial Sequence
  Synthetic oligonucleotide
gtcaaccctcacgcaacccccctcgactgacttgaga

SEQ ID NO: 15646 - DNA, 37 bp, Artificial Sequence
  Synthetic oligonucleotide
accacgccttccaccgccctgagcattcggccttgga

SEQ ID NO: 15647 - DNA, 35 bp, Artificial Sequence
  Synthetic oligonucleotide
atcttcgcctgttccaacccccccggcctcttggt

SEQ ID NO: 15648 - DNA, 36 bp, Artificial Sequence
  Synthetic oligonucleotide
actccggcctccgttggttcctagtctctgtactca

SEQ ID NO: 15649 - DNA, 37 bp, Artificial Sequence
  Synthetic oligonucleotide
acccacaggatcgcccggacactcagttaaccttcga

SEQ ID NO: 15650 - DNA, 37 bp, Artificial Sequence
  Synthetic oligonucleotide
atccacctcgatacttccatccagatctcctttgtga

SEQ ID NO: 15651 - DNA, 35 bp, Artificial Sequence
  Synthetic oligonucleotide
gcaaccagccccgattcgacttccattagcacgta

SEQ ID NO: 15652 - DNA, 35 bp, Artificial Sequence
  Synthetic oligonucleotide
tatgcccccgaaacgcttggtgctcaatagtcctc

SEQ ID NO: 15653 - DNA, 37 bp, Artificial Sequence
  Synthetic oligonucleotide
gtggggcggggcggggagtcagttgattagaagggga

SEQ ID NO: 15654 - DNA, 38 bp, Artificial Sequence
  Synthetic oligonucleotide
agcggtcgcaggggtgggtaagggggggcaaaacgtga

SEQ ID NO: 15655 - DNA, 36 bp, Artificial Sequence
  Synthetic oligonucleotide
acatgcctccggaggcttacttaccatggtttatca

SEQ ID NO: 15656 - DNA, 36 bp, Artificial Sequence
  Synthetic oligonucleotide
gaaggaggagcaagaggaaaggagacggtgcacaga

SEQ ID NO: 15657 - DNA, 35 bp, Artificial Sequence
  Synthetic oligonucleotide
tataccccgcctttcctcaccagtctggcgagcac

SEQ ID NO: 15658 - DNA, 35 bp, Artificial Sequence
  Synthetic oligonucleotide
acacagtgctactgatacgcgcggtttcttcttcc

SEQ ID NO: 15659 - DNA, 35 bp, Artificial Sequence
  Synthetic oligonucleotide
tcaaccactctcacctttatcgctcaggggtcatc

SEQ ID NO: 15660 - DNA, 35 bp, Artificial Sequence
  Synthetic oligonucleotide
ggatacgcgcaatatccgctccctgctcccttttt

SEQ ID NO: 15661 - DNA, 37 bp, Artificial Sequence
  Synthetic oligonucleotide
acacgaaggtaggtggtgagagggcgggcctggttga

SEQ ID NO: 15662 - DNA, 35 bp, Artificial Sequence
  Synthetic oligonucleotide
accccgctaacgttctacgactgtaggcgccctcc

SEQ ID NO: 15663 - DNA, 31 bp, Artificial Sequence
  Synthetic oligonucleotide
ttcccgccccgttccgccggttctcatccca

SEQ ID NO: 15664 - DNA, 35 bp, Artificial Sequence
  Synthetic oligonucleotide
gccaacgccgacggtctagctggtgcgcctctgct

SEQ ID NO: 15665 - DNA, 35 bp, Artificial Sequence
  Synthetic oligonucleotide
taatccccttgtgcagtccgccgaattctgcctct

SEQ ID NO: 15666 - DNA, 37 bp, Artificial Sequence
  Synthetic oligonucleotide
tacatgcggccgcccgcaacacgccctccctcgttga

SEQ ID NO: 15667 - DNA, 35 bp, Artificial Sequence
  Synthetic oligonucleotide
tagggagggagggtgcgggggccaaggatcaagct

SEQ ID NO: 15668 - DNA, 35 bp, Artificial Sequence
  Synthetic oligonucleotide
tgctacccatatctcccgaccacgtgctacaatca

SEQ ID NO: 15669 - DNA, 37 bp, Artificial Sequence
  Synthetic oligonucleotide
acccggtggacggagggaatgggaacggtatcaagga

SEQ ID NO: 15670 - DNA, 37 bp, Artificial Sequence
  Synthetic oligonucleotide
aagggcggggctggggagggtgagtatctcaaagtga

SEQ ID NO: 15671 - DNA, 35 bp, Artificial Sequence
  Synthetic oligonucleotide
acccatcctcctgcaagttggtatctgctctccta

SEQ ID NO: 15672 - DNA, 35 bp, Artificial Sequence
  Synthetic oligonucleotide
gtgccgaactccccgaccccccgaccggaaaggcc

SEQ ID NO: 15673 - DNA, 35 bp, Artificial Sequence
  Synthetic oligonucleotide
tgcacggccgtgtgtcaccgtccctttgcatgctc

SEQ ID NO: 15674 - DNA, 35 bp, Artificial Sequence
  Synthetic oligonucleotide
aaacatcactgttgcacccttcccgtttaaaggtc

SEQ ID NO: 15675 - DNA, 35 bp, Artificial Sequence
  Synthetic oligonucleotide
tgccgtacccggacgttactaacattgcactatct

SEQ ID NO: 15676 - DNA, 35 bp, Artificial Sequence
  Synthetic oligonucleotide
aaccgccgtgtctcgcctatgctccccttatcaaa

SEQ ID NO: 15677 - DNA, 35 bp, Artificial Sequence
  Synthetic oligonucleotide
ttgcgccgacctatagttgcctgattcctttcaca

SEQ ID NO: 15678 - DNA, 35 bp, Artificial Sequence
  Synthetic oligonucleotide
tcaccactcccggcccacggatacagtcgtaaaac

SEQ ID NO: 15679 - DNA, 34 bp, Artificial Sequence
  Synthetic oligonucleotide
ggaaccgccgaggcactcgccgtacacgaccctc

SEQ ID NO: 15680 - DNA, 35 bp, Artificial Sequence
  Synthetic oligonucleotide
tgtacagcccgcttgttcgtcgcttccatcttgcg

SEQ ID NO: 15681 - DNA, 35 bp, Artificial Sequence
  Synthetic oligonucleotide
ttgcgaccacacggtttttagcccactccagctct

SEQ ID NO: 15682 - DNA, 36 bp, Artificial Sequence
  Synthetic oligonucleotide
tcaaacccctatcccccgcgcgccccaacaaggaga

SEQ ID NO: 15683 - DNA, 38 bp, Artificial Sequence
  Synthetic oligonucleotide
taggtggggcgggggggaagtttcggttaacggaatga

SEQ ID NO: 15684 - DNA, 38 bp, Artificial Sequence
  Synthetic oligonucleotide
gctgatgggcggagtgggatggggagggtagattgtga

SEQ ID NO: 15685 - DNA, 35 bp, Artificial Sequence
  Synthetic oligonucleotide
tgagtccgacccgttgcactgccgtagcccaaacc

SEQ ID NO: 15686 - DNA, 35 bp, Artificial Sequence
  Synthetic oligonucleotide
tcatcacatccatacctctagaccacctgttggag

SEQ ID NO: 15687 - DNA, 35 bp, Artificial Sequence
  Synthetic oligonucleotide
tgccaggactcagctccttgccgcattttcccatt

SEQ ID NO: 15688 - DNA, 36 bp, Artificial Sequence
  Synthetic oligonucleotide
gctgcatgtcggcatccgtcctattacccacacgaa

SEQ ID NO: 15689 - DNA, 36 bp, Artificial Sequence
  Synthetic oligonucleotide
tccaacgacccagcctgacttctcaaagctagccga

SEQ ID NO: 15690 - DNA, 35 bp, Artificial Sequence
  Synthetic oligonucleotide
aacgcacccgaaactccgggctcattactccatac

SEQ ID NO: 15691 - DNA, 35 bp, Artificial Sequence
  Synthetic oligonucleotide
tcataaccccccagcccttggcgcgccctcacaga

SEQ ID NO: 15692 - DNA, 35 bp, Artificial Sequence
  Synthetic oligonucleotide
tctggggagaagtatcccgcagcccgtttccgttc

SEQ ID NO: 15693 - DNA, 35 bp, Artificial Sequence
  Synthetic oligonucleotide
gccggtggtgggggtatggactgatagtggtgtag

SEQ ID NO: 15694 - DNA, 35 bp, Artificial Sequence
  Synthetic oligonucleotide
gaagcacgcctcttgcgcttttcgcaccttttttg

SEQ ID NO: 15695 - DNA, 36 bp, Artificial Sequence
  Synthetic oligonucleotide
tgactggccacatccaccctggactttgcatgaaca

SEQ ID NO: 15696 - DNA, 36 bp, Artificial Sequence
  Synthetic oligonucleotide
ataacaggcctcccatttcgcctcacgtgacataca

SEQ ID NO: 15697 - DNA, 35 bp, Artificial Sequence
  Synthetic oligonucleotide
tgcatcataccccgttggttattttggctcacctc

SEQ ID NO: 15698 - DNA, 35 bp, Artificial Sequence
  Synthetic oligonucleotide
tgacaccccgactattcatcgatgtactctgctat

SEQ ID NO: 15699 - DNA, 36 bp, Artificial Sequence
  Synthetic oligonucleotide
gaagcgcgctcgctcacttccgcctagcatgcccca

SEQ ID NO: 15700 - DNA, 37 bp, Artificial Sequence
  Synthetic oligonucleotide
aacacagcacgtccgcccagccctttcatcccgaaga

SEQ ID NO: 15701 - DNA, 37 bp, Artificial Sequence
  Synthetic oligonucleotide
tcagtcctccccgcctataatgtctagcatatccgga

SEQ ID NO: 15702 - DNA, 35 bp, Artificial Sequence
  Synthetic oligonucleotide
acacacccgtctcacatcatcgatttacgtctgca

SEQ ID NO: 15703 - DNA, 37 bp, Artificial Sequence
  Synthetic oligonucleotide
gaggacgtacatgggggaacggagtatggtggggaga

SEQ ID NO: 15704 - DNA, 37 bp, Artificial Sequence
  Synthetic oligonucleotide
aagagtagtgcaggaggggggggcggcggtgcgagga

SEQ ID NO: 15705 - DNA, 37 bp, Artificial Sequence
  Synthetic oligonucleotide
tcaccgagcatggcttatcacgcttcctggttactac

SEQ ID NO: 15706 - DNA, 38 bp, Artificial Sequence
  Synthetic oligonucleotide
gtgagtggggagtaggtcatggatacaggggggtgtga

SEQ ID NO: 15707 - DNA, 36 bp, Artificial Sequence
  Synthetic oligonucleotide
tgaggtcgccgtcacgctcccgcccccgcaacctta

SEQ ID NO: 15708 - DNA, 35 bp, Artificial Sequence
  Synthetic oligonucleotide
gaccatccccacgacgggcgccttttctccaaccc

SEQ ID NO: 15709 - DNA, 35 bp, Artificial Sequence
  Synthetic oligonucleotide
ttttgccccgagttttctgctattagcatccccgc

SEQ ID NO: 15710 - DNA, 35 bp, Artificial Sequence
  Synthetic oligonucleotide
agccacaaggcatttcagcgctccctgtaccacca

SEQ ID NO: 15711 - DNA, 38 bp, Artificial Sequence
  Synthetic oligonucleotide
aacgagaagggatggaaagatagtgtggatgtgtgtga

SEQ ID NO: 15712 - DNA, 38 bp, Artificial Sequence
  Synthetic oligonucleotide
gtcacccccctccattgcatagtaatatcaacctttga

SEQ ID NO: 15713 - DNA, 35 bp, Artificial Sequence
  Synthetic oligonucleotide
gtaccaatacatcactcgctcaatgagaacctcac

SEQ ID NO: 15714 - DNA, 35 bp, Artificial Sequence
  Synthetic oligonucleotide
aacttgacgcgcgccgtttatccacttacgtcacc

SEQ ID NO: 15715 - DNA, 35 bp, Artificial Sequence
  Synthetic oligonucleotide
gcaccagcccacgtgacaccatatctgccgttccc

SEQ ID NO: 15716 - DNA, 35 bp, Artificial Sequence
  Synthetic oligonucleotide
tcctatgcctccgccgtccgccatactggctttct

SEQ ID NO: 15717 - DNA, 35 bp, Artificial Sequence
  Synthetic oligonucleotide
ttacccctgccacatcctctcgattaatgtcttgt

SEQ ID NO: 15718 - DNA, 35 bp, Artificial Sequence
  Synthetic oligonucleotide
gtgacatcccccatcgcgtgggcactagccccaaa

SEQ ID NO: 15719 - DNA, 36 bp, Artificial Sequence
  Synthetic oligonucleotide
tccctaccgccgacttccataaactgttgccgccaa

SEQ ID NO: 15720 - DNA, 36 bp, Artificial Sequence
  Synthetic oligonucleotide
ttgaactggtccaactgcatgcctcccgacgcggga

SEQ ID NO: 15721 - DNA, 36 bp, Artificial Sequence
  Synthetic oligonucleotide
agcagggagtgggtgcaggagtggaaggatggggga

SEQ ID NO: 15722 - DNA, 35 bp, Artificial Sequence
  Synthetic oligonucleotide
tgccgtatcgactatttgatctcctccctctgtac

SEQ ID NO: 15723 - DNA, 35 bp, Artificial Sequence
  Synthetic oligonucleotide
gccctgtgcacctttaccaccgactgacttcggcc

SEQ ID NO: 15724 - DNA, 36 bp, Artificial Sequence
  Synthetic oligonucleotide
gtgcaaacaccttaaccgttcctggcccatcttgca

SEQ ID NO: 15725 - DNA, 36 bp, Artificial Sequence
  Synthetic oligonucleotide
acacgacccccccggcgtcttccgacacctgcctta

SEQ ID NO: 15726 - DNA, 35 bp, Artificial Sequence
  Synthetic oligonucleotide
ttgactccgttcctgcgaaagcagccacttcggtc

SEQ ID NO: 15727 - DNA, 35 bp, Artificial Sequence
  Synthetic oligonucleotide
aacagtgcgctccttatcgtttcttctttggggtc

SEQ ID NO: 15728 - DNA, 35 bp, Artificial Sequence
  Synthetic oligonucleotide
tcacaagcgcaacctccgccgcccagggagcttaa

SEQ ID NO: 15729 - DNA, 36 bp, Artificial Sequence
  Synthetic oligonucleotide
ggatacagccgcccactgggtgcatccattttttca

SEQ ID NO: 15730 - DNA, 37 bp, Artificial Sequence
  Synthetic oligonucleotide
taccgatctgcgctccatcctccctcaatgctgacga

SEQ ID NO: 15731 - DNA, 36 bp, Artificial Sequence
  Synthetic oligonucleotide
gatccgcttgcatctccgtctcacattggcctagta

SEQ ID NO: 15732 - DNA, 35 bp, Artificial Sequence
  Synthetic oligonucleotide
tacaactgtcatccggcctctatgtccctttaccg

SEQ ID NO: 15733 - DNA, 35 bp, Artificial Sequence
  Synthetic oligonucleotide
tgaacgcggttctccgtatgtccctattgtttcat

SEQ ID NO: 15734 - DNA, 35 bp, Artificial Sequence
  Synthetic oligonucleotide
gatgaccctcctcagttctcgatttaaacactgat

SEQ ID NO: 15735 - DNA, 35 bp, Artificial Sequence
  Synthetic oligonucleotide
gcctataacgccggccaccgatgcccacacccgtt

SEQ ID NO: 15736 - DNA, 35 bp, Artificial Sequence
  Synthetic oligonucleotide
tgtcccctctctgatctccgctcccgtgcgaccaa

SEQ ID NO: 15737 - DNA, 38 bp, Artificial Sequence
  Synthetic oligonucleotide
gatctgcctcccttcttcagctacagtccctgtaatga

SEQ ID NO: 15738 - DNA, 38 bp, Artificial Sequence
  Synthetic oligonucleotide
gtggggacggggggggctgacagtgtgcaggctggtga

SEQ ID NO: 15739 - DNA, 35 bp, Artificial Sequence
  Synthetic oligonucleotide
gcatacttgtcgtccgcccttcccgtgccttatgt

SEQ ID NO: 15740 - DNA, 35 bp, Artificial Sequence
  Synthetic oligonucleotide
tgagcgtgggtccacttactttgccgtgccttctt

SEQ ID NO: 15741 - DNA, 36 bp, Artificial Sequence
  Synthetic oligonucleotide
gcaccgcgcaattccttgaaggcctacaccatcaca

SEQ ID NO: 15742 - DNA, 37 bp, Artificial Sequence
  Synthetic oligonucleotide
atcgcccccgccctgaatacttctcgatgtcgcatga

SEQ ID NO: 15743 - DNA, 35 bp, Artificial Sequence
  Synthetic oligonucleotide
gtctagcgcgactaagcccccccgtctcttactct

SEQ ID NO: 15744 - DNA, 36 bp, Artificial Sequence
  Synthetic oligonucleotide
tatccccccggcctttaaggtaacccagtcactaca

SEQ ID NO: 15745 - DNA, 35 bp, Artificial Sequence
  Synthetic oligonucleotide
tagggatgccacatgcaccctcataccctagacca

SEQ ID NO: 15746 - DNA, 35 bp, Artificial Sequence
  Synthetic oligonucleotide
taacctcccagacctgaagcacgcgcgctaagcca

SEQ ID NO: 15747 - DNA, 37 bp, Artificial Sequence
  Synthetic oligonucleotide
tacgccggcctcctgtaattccccttgttatgacaga

SEQ ID NO: 15748 - DNA, 36 bp, Artificial Sequence
  Synthetic oligonucleotide
tgaggggggacgaatctgggtgaagtaactggggga

SEQ ID NO: 15749 - DNA, 35 bp, Artificial Sequence
  Synthetic oligonucleotide
ggtcaccaccacgtctacctctaagtcgaacccct

SEQ ID NO: 15750 - DNA, 35 bp, Artificial Sequence
  Synthetic oligonucleotide
tgcgacgctcgctcctatgcccaccgacgctgttt

SEQ ID NO: 15751 - DNA, 36 bp, Artificial Sequence
  Synthetic oligonucleotide
acagtcgcctctttgctcacactctgctacgtacca

SEQ ID NO: 15752 - DNA, 37 bp, Artificial Sequence
  Synthetic oligonucleotide
gagtggaggggaaggtggagggtataacagtgcagga

SEQ ID NO: 15753 - DNA, 38 bp, Artificial Sequence
  Synthetic oligonucleotide
gcactccctcgctactgtcgcgtgacttcaatctatga

SEQ ID NO: 15754 - DNA, 35 bp, Artificial Sequence
  Synthetic oligonucleotide
tgtcaacccaactggaagttactacgataatcacc

SEQ ID NO: 15755 - DNA, 35 bp, Artificial Sequence
  Synthetic oligonucleotide
gccacatccaattcgactttactgcctaggttcat

SEQ ID NO: 15756 - DNA, 36 bp, Artificial Sequence
  Synthetic oligonucleotide
acacccggacatattctacactgcaacgtgcataca

SEQ ID NO: 15757 - DNA, 36 bp, Artificial Sequence
  Synthetic oligonucleotide
gaacatcccacaagaagcctgcataatcgcgcctca

SEQ ID NO: 15758 - DNA, 37 bp, Artificial Sequence
  Synthetic oligonucleotide
ggactgccactttccagcccgtctgctccgactccga

SEQ ID NO: 15759 - DNA, 35 bp, Artificial Sequence
  Synthetic oligonucleotide
atgccgccccgaaatgccgacgaaagccaattccc

SEQ ID NO: 15760 - DNA, 35 bp, Artificial Sequence
  Synthetic oligonucleotide
gtatgctgctcgacacctgtccgccctttgccgtc

SEQ ID NO: 15761 - DNA, 35 bp, Artificial Sequence
  Synthetic oligonucleotide
tctggacccccccagaaggtcttcacactttccat

SEQ ID NO: 15762 - DNA, 37 bp, Artificial Sequence
  Synthetic oligonucleotide
taccgcctcatcacacgtcacacacccttgtcaccga

SEQ ID NO: 15763 - DNA, 37 bp, Artificial Sequence
  Synthetic oligonucleotide
tcgcccccgtccccgttatttcccagctcctccccga

SEQ ID NO: 15764 - DNA, 37 bp, Artificial Sequence
  Synthetic oligonucleotide
gtgtgctccccctgttccgtcacatagacagtcatga

SEQ ID NO: 15765 - DNA, 35 bp, Artificial Sequence
  Synthetic oligonucleotide
acccctgccccctgataagcacctcttcacggtcc

SEQ ID NO: 15766 - DNA, 35 bp, Artificial Sequence
  Synthetic oligonucleotide
gtccataccgcctagcaagctccacccttcagttt

SEQ ID NO: 15767 - DNA, 35 bp, Artificial Sequence
  Synthetic oligonucleotide
atggttccacattgccctaaatcactgctcgccca

SEQ ID NO: 15768 - DNA, 36 bp, Artificial Sequence
  Synthetic oligonucleotide
atgccgcctcaccatcctgacactctgggttaacga

SEQ ID NO: 15769 - DNA, 37 bp, Artificial Sequence
  Synthetic oligonucleotide
ttctcgccccattgacttcccggaggacgtttacgga

SEQ ID NO: 15770 - DNA, 38 bp, Artificial Sequence
  Synthetic oligonucleotide
gacctgaacgcagatcggtgggtgggagcggggtttga

SEQ ID NO: 15771 - DNA, 36 bp, Artificial Sequence
  Synthetic oligonucleotide
aacaccacaggatttgataatgccctctccgtctta

SEQ ID NO: 15772 - DNA, 35 bp, Artificial Sequence
  Synthetic oligonucleotide
tcgataccccgtcaatcgcctcattctcgtatcac

SEQ ID NO: 15773 - DNA, 35 bp, Artificial Sequence
  Synthetic oligonucleotide
atctcacgtcccatcccaccacctgtccaagcccg

SEQ ID NO: 15774 - DNA, 38 bp, Artificial Sequence
  Synthetic oligonucleotide
agcgcacccccaccaccgtatcgtaaccgcacacttga

SEQ ID NO: 15775 - DNA, 35 bp, Artificial Sequence
  Synthetic oligonucleotide
atcacgcggacgctacggcacatattgttttcccc

SEQ ID NO: 15776 - DNA, 35 bp, Artificial Sequence
  Synthetic oligonucleotide
tgtcggtgccccgcgttcgaacctgcccaactgcc

SEQ ID NO: 15777 - DNA, 35 bp, Artificial Sequence
  Synthetic oligonucleotide
tactggcggtcgtcccgtccttatggcccgcttcc

SEQ ID NO: 15778 - DNA, 35 bp, Artificial Sequence
  Synthetic oligonucleotide
acccgccatcctgcgtgccttcgtaaggtcttatc

SEQ ID NO: 15779 - DNA, 35 bp, Artificial Sequence
  Synthetic oligonucleotide
gttgggtcgtaacccgctctgttcgagttcctctc

SEQ ID NO: 15780 - DNA, 36 bp, Artificial Sequence
  Synthetic oligonucleotide
acagcctccaccccccacgacaacccggcctggtca

SEQ ID NO: 15781 - DNA, 35 bp, Artificial Sequence
  Synthetic oligonucleotide
gacggaatagaagggcaagaaagattgagcaggta

SEQ ID NO: 15782 - DNA, 36 bp, Artificial Sequence
  Synthetic oligonucleotide
tgcacgagccttgagttagtccatttctttccctta

SEQ ID NO: 15783 - DNA, 35 bp, Artificial Sequence
  Synthetic oligonucleotide
ttcgccccacttttgatttttggaacctaatacac

SEQ ID NO: 15784 - DNA, 35 bp, Artificial Sequence
  Synthetic oligonucleotide
tcctaccgcaggtacctagtactacagtacttcat

SEQ ID NO: 15785 - DNA, 35 bp, Artificial Sequence
  Synthetic oligonucleotide
ttagaatccaccggcacgcgctcgcctcaccccct

SEQ ID NO: 15786 - DNA, 36 bp, Artificial Sequence
  Synthetic oligonucleotide
atagccagtgcactgaccatcgcttaccttccttca

SEQ ID NO: 15787 - DNA, 35 bp, Artificial Sequence
  Synthetic oligonucleotide
tcgaccctttgttccttggcctgtcatgcctttca

SEQ ID NO: 15788 - DNA, 35 bp, Artificial Sequence
  Synthetic oligonucleotide
gggtaatggggtagggtgggagggctagaacggga

SEQ ID NO: 15789 - DNA, 35 bp, Artificial Sequence
  Synthetic oligonucleotide
gtgctgcaaccctgtaacgttcgtggctcgttttc

SEQ ID NO: 15790 - DNA, 35 bp, Artificial Sequence
  Synthetic oligonucleotide
gacactcggcacatccttttctctgcttggactgg

SEQ ID NO: 15791 - DNA, 35 bp, Artificial Sequence
  Synthetic oligonucleotide
gacgggagggccaggggacatggggggggccgcgt

SEQ ID NO: 15792 - DNA, 37 bp, Artificial Sequence
  Synthetic oligonucleotide
aaccgcaagtgccggtaagtttagtgggagggagaga

SEQ ID NO: 15793 - DNA, 38 bp, Artificial Sequence
  Synthetic oligonucleotide
tagctgacgcgcgttcactctcctgcccttatcggtga

SEQ ID NO: 15794 - DNA, 35 bp, Artificial Sequence
  Synthetic oligonucleotide
ttggatcgcaccgatcatatgtcctttccgtctgc

SEQ ID NO: 15795 - DNA, 35 bp, Artificial Sequence
  Synthetic oligonucleotide
gttgcttctcccgccgctggtagttttcttcttcg

SEQ ID NO: 15796 - DNA, 35 bp, Artificial Sequence
  Synthetic oligonucleotide
tgatctgcccccgactggtgcttacaattcttttt

SEQ ID NO: 15797 - DNA, 37 bp, Artificial Sequence
  Synthetic oligonucleotide
tgagcatccgttcgtacgcgcctctctactacctcga

SEQ ID NO: 15798 - DNA, 38 bp, Artificial Sequence
  Synthetic oligonucleotide
attacgcacccctcccctgctcctattacgggacatga

SEQ ID NO: 15799 - DNA, 35 bp, Artificial Sequence
  Synthetic oligonucleotide
tacgtgccgtcattaggctatcctcctgctctcta

SEQ ID NO: 15800 - DNA, 35 bp, Artificial Sequence
  Synthetic oligonucleotide
gatgcaattgcctggctgccttgcactagttcccc

SEQ ID NO: 15801 - DNA, 35 bp, Artificial Sequence
  Synthetic oligonucleotide
tccgacacccttacactgacgctaaattcccgtcc

SEQ ID NO: 15802 - DNA, 35 bp, Artificial Sequence
  Synthetic oligonucleotide
accacgctgtgtacctcctaccgatcctcgttctc

SEQ ID NO: 15803 - DNA, 35 bp, Artificial Sequence
  Synthetic oligonucleotide
ttgggacccctcaccattgccacactacatctaat

SEQ ID NO: 15804 - DNA, 36 bp, Artificial Sequence
  Synthetic oligonucleotide
tgatgggtccgaagggcgtaagaagggagggaagga

SEQ ID NO: 15805 - DNA, 37 bp, Artificial Sequence
  Synthetic oligonucleotide
ttttgcctcacccatttcgcgcattgccacagcttga

SEQ ID NO: 15806 - DNA, 35 bp, Artificial Sequence
  Synthetic oligonucleotide
acctcacacctggacacttggtcctccagcctttg

SEQ ID NO: 15807 - DNA, 35 bp, Artificial Sequence
  Synthetic oligonucleotide
agttcgacgtggcaactctctataacgttccttct

SEQ ID NO: 15808 - DNA, 36 bp, Artificial Sequence
  Synthetic oligonucleotide
gagaacagcctcgcagctacggatccctgccaccca

SEQ ID NO: 15809 - DNA, 38 bp, Artificial Sequence
  Synthetic oligonucleotide
ttccacacctcagaatttttcgctccacccacacgtga

SEQ ID NO: 15810 - DNA, 35 bp, Artificial Sequence
  Synthetic oligonucleotide
gacgccagatgccgatctatgtccacttccacaaa

SEQ ID NO: 15811 - DNA, 37 bp, Artificial Sequence
  Synthetic oligonucleotide
tgaacaaggagggtgggatggtgcgcgggggagggga

SEQ ID NO: 15812 - DNA, 37 bp, Artificial Sequence
  Synthetic oligonucleotide
atctccatccaccagccacgcaagtccgcttatgcga

SEQ ID NO: 15813 - DNA, 36 bp, Artificial Sequence
  Synthetic oligonucleotide
ttttcgcccccgccaggaatctggtacctcttttga

SEQ ID NO: 15814 - DNA, 35 bp, Artificial Sequence
  Synthetic oligonucleotide
gttgccacgcaacagcgaacggcgaatttctcttc

SEQ ID NO: 15815 - DNA, 35 bp, Artificial Sequence
  Synthetic oligonucleotide
tcccggttccatgtctcatacaggcgctccccact

SEQ ID NO: 15816 - DNA, 35 bp, Artificial Sequence
  Synthetic oligonucleotide
atgtgcccgcggcagtaacctgcatgcatcccctt

SEQ ID NO: 15817 - DNA, 37 bp, Artificial Sequence
  Synthetic oligonucleotide
gagcatcccgcacgccgcgtagccacaccattatcga

SEQ ID NO: 15818 - DNA, 37 bp, Artificial Sequence
  Synthetic oligonucleotide
aacaccttccccggtctcaactgacgaccaatttgga

SEQ ID NO: 15819 - DNA, 35 bp, Artificial Sequence
  Synthetic oligonucleotide
ttcccaactccgactatgcatacccaaaccgtggc

SEQ ID NO: 15820 - DNA, 35 bp, Artificial Sequence
  Synthetic oligonucleotide
gcatcgctgtcctattctatctgccgtacgcctcg

SEQ ID NO: 15821 - DNA, 35 bp, Artificial Sequence
  Synthetic oligonucleotide
tacttgtgccactgtcgctaataacgtgcttctcg

SEQ ID NO: 15822 - DNA, 35 bp, Artificial Sequence
  Synthetic oligonucleotide
tcaacatacgtaagcacccggtattccccctctgt

SEQ ID NO: 15823 - DNA, 37 bp, Artificial Sequence
  Synthetic oligonucleotide
gtatggtgctagccgggggggaagggaaagggaggga

SEQ ID NO: 15824 - DNA, 35 bp, Artificial Sequence
  Synthetic oligonucleotide
gtcccgcttgatcgcctcccagtcaccccagcata

SEQ ID NO: 15825 - DNA, 35 bp, Artificial Sequence
  Synthetic oligonucleotide
tagtggctgccaattgagaagtcgcgcctcccttc

SEQ ID NO: 15826 - DNA, 34 bp, Artificial Sequence
  Synthetic oligonucleotide
atgaccggactaggcggaacacgcaccccttcca

SEQ ID NO: 15827 - DNA, 36 bp, Artificial Sequence
  Synthetic oligonucleotide
gcctcttagcgctcccacctccgcccgcaattctga

SEQ ID NO: 15828 - DNA, 37 bp, Artificial Sequence
  Synthetic oligonucleotide
ttccgcctagccacttgtgcgtcgttccctcacttga

SEQ ID NO: 15829 - DNA, 38 bp, Artificial Sequence
  Synthetic oligonucleotide
aaccgaaacactggttgtctatcaccacgctcccttga

SEQ ID NO: 15830 - DNA, 38 bp, Artificial Sequence
  Synthetic oligonucleotide
tcaatcacacgactcggtttcatagccgccctgcttga

SEQ ID NO: 15831 - DNA, 38 bp, Artificial Sequence
  Synthetic oligonucleotide
tccgtctcgccactggctatttcaccgttcctgcttga

SEQ ID NO: 15832 - DNA, 35 bp, Artificial Sequence
  Synthetic oligonucleotide
gtgacactggagcttaacatgagccaccgctacta

SEQ ID NO: 15833 - DNA, 35 bp, Artificial Sequence
  Synthetic oligonucleotide
gctcatcctcccgctttttcatcagggcatcatcc

SEQ ID NO: 15834 - DNA, 35 bp, Artificial Sequence
  Synthetic oligonucleotide
tacagactaacgtagtacaaccatcactgctcatc

SEQ ID NO: 15835 - DNA, 35 bp, Artificial Sequence
  Synthetic oligonucleotide
agagcaccctgcactatgtcgaatctcactctgga

SEQ ID NO: 15836 - DNA, 35 bp, Artificial Sequence
  Synthetic oligonucleotide
accccttgcacctcttcagttggagtccccctccc

SEQ ID NO: 15837 - DNA, 35 bp, Artificial Sequence
  Synthetic oligonucleotide
cccgttagccgccgttccatcatggccatccactt

SEQ ID NO: 15838 - DNA, 35 bp, Artificial Sequence
  Synthetic oligonucleotide
tgtagccatcgcactttaatcaggctgtttcactt

SEQ ID NO: 15839 - DNA, 36 bp, Artificial Sequence
  Synthetic oligonucleotide
cactgccgctacaccacacgcgacactcttaacaca

SEQ ID NO: 15840 - DNA, 38 bp, Artificial Sequence
  Synthetic oligonucleotide
gagtcagggacccttgcgtttatttcacctccttatga

SEQ ID NO: 15841 - DNA, 35 bp, Artificial Sequence
  Synthetic oligonucleotide
tcccaccaccccaccatgtatttatgtcctattac

SEQ ID NO: 15842 - DNA, 35 bp, Artificial Sequence
  Synthetic oligonucleotide
tccatcgcactgtgcatttgctcctaggtgccttc

SEQ ID NO: 15843 - DNA, 35 bp, Artificial Sequence
  Synthetic oligonucleotide
atgtccgggagggagtgggactgatggtgtgaggg

SEQ ID NO: 15844 - DNA, 35 bp, Artificial Sequence
  Synthetic oligonucleotide
tatgcggagaggaactgttggggggtgattctggg

SEQ ID NO: 15845 - DNA, 35 bp, Artificial Sequence
  Synthetic oligonucleotide
aaccgccgtcaccacccgttcccacacattaacgt

SEQ ID NO: 15846 - DNA, 35 bp, Artificial Sequence
  Synthetic oligonucleotide
gcacctaccttccccttctgtccgcagaggagcca

SEQ ID NO: 15847 - DNA, 34 bp, Artificial Sequence
  Synthetic oligonucleotide
tcgcacacccgcgtagcatcatcccctctagtga

SEQ ID NO: 15848 - DNA, 36 bp, Artificial Sequence
  Synthetic oligonucleotide
tacgttacccccgcggatgcgcaacgacgctcctta

SEQ ID NO: 15849 - DNA, 35 bp, Artificial Sequence
  Synthetic oligonucleotide
gtccccacggcgaccaaatgaccgcacccatccac

SEQ ID NO: 15850 - DNA, 35 bp, Artificial Sequence
  Synthetic oligonucleotide
gacgcctcattttcgtgcgctgggtcatccacccc

SEQ ID NO: 15851 - DNA, 35 bp, Artificial Sequence
  Synthetic oligonucleotide
aacactccaccaatggtttaacaaagctttaagcc

SEQ ID NO: 15852 - DNA, 35 bp, Artificial Sequence
  Synthetic oligonucleotide
actcgcacctccctgacttcaaacagtgccctgtt

SEQ ID NO: 15853 - DNA, 38 bp, Artificial Sequence
  Synthetic oligonucleotide
tccccccttcaccatccgctcaagtagacttcgtatga

SEQ ID NO: 15854 - DNA, 35 bp, Artificial Sequence
  Synthetic oligonucleotide
tccaccgtaattagtccatctgcgccttttccgta

SEQ ID NO: 15855 - DNA, 36 bp, Artificial Sequence
  Synthetic oligonucleotide
ttcactcccatcgagccgataaggccaactgttcca

SEQ ID NO: 15856 - DNA, 35 bp, Artificial Sequence
  Synthetic oligonucleotide
ttgccaaggaccccttttgttatgtcacctgctca

SEQ ID NO: 15857 - DNA, 38 bp, Artificial Sequence
  Synthetic oligonucleotide
accgcatccctagaatcgccccctttgacagtagctga

SEQ ID NO: 15858 - DNA, 38 bp, Artificial Sequence
  Synthetic oligonucleotide
gtcgagggctccagccgattatcgctctctcttcttga

SEQ ID NO: 15859 - DNA, 34 bp, Artificial Sequence
  Synthetic oligonucleotide
tcgtttcccccctgccgcaggctcctgcctctgc

SEQ ID NO: 15860 - DNA, 35 bp, Artificial Sequence
  Synthetic oligonucleotide
ggaaccgcacctccgtcaggtacttgcctccaatc

SEQ ID NO: 15861 - DNA, 35 bp, Artificial Sequence
  Synthetic oligonucleotide
gcttgcccagcctaccgacaccctgttccgcgttc

SEQ ID NO: 15862 - DNA, 34 bp, Artificial Sequence
  Synthetic oligonucleotide
tcagttgcagttatctgtgcacctgttcctcccg

SEQ ID NO: 15863 - DNA, 35 bp, Artificial Sequence
  Synthetic oligonucleotide
aacataaccgcaagtgcggacgcccccgtttacca

SEQ ID NO: 15864 - DNA, 38 bp, Artificial Sequence
  Synthetic oligonucleotide
gaacgtcatgacgccaatctgccgaggcccatctctga

SEQ ID NO: 15865 - DNA, 35 bp, Artificial Sequence
  Synthetic oligonucleotide
aacacatcccgtatggcctttctcgtacagggaac

SEQ ID NO: 15866 - DNA, 35 bp, Artificial Sequence
  Synthetic oligonucleotide
ttagccgacgacttctcacgtcccaccattctggc

SEQ ID NO: 15867 - DNA, 37 bp, Artificial Sequence
  Synthetic oligonucleotide
gccatcgccgatccttgttgaatcctgtgcaccacga

SEQ ID NO: 15868 - DNA, 37 bp, Artificial Sequence
  Synthetic oligonucleotide
atcacgcccatccgtatctcaatagcctagcctggga

SEQ ID NO: 15869 - DNA, 35 bp, Artificial Sequence
  Synthetic oligonucleotide
gttagcgcacgagcactcattttgtcatccgcatc

SEQ ID NO: 15870 - DNA, 35 bp, Artificial Sequence
  Synthetic oligonucleotide
agcccaatacctcccaatgacttccgacgcttacg

SEQ ID NO: 15871 - DNA, 35 bp, Artificial Sequence
  Synthetic oligonucleotide
gccattcaagcagagcgctacccacctactccatt

SEQ ID NO: 15872 - DNA, 36 bp, Artificial Sequence
  Synthetic oligonucleotide
gagcacagccctcatctattcacgtctgcatcacca

SEQ ID NO: 15873 - DNA, 37 bp, Artificial Sequence
  Synthetic oligonucleotide
actccccgctgaatcaaaactgggaccatcccactga

SEQ ID NO: 15874 - DNA, 35 bp, Artificial Sequence
  Synthetic oligonucleotide
tcagcccactttcggtttttacctccaggatacct

SEQ ID NO: 15875 - DNA, 38 bp, Artificial Sequence
  Synthetic oligonucleotide
tccaacgctatgcctatagttccctgtgatttccgtga

SEQ ID NO: 15876 - DNA, 35 bp, Artificial Sequence
  Synthetic oligonucleotide
gatccaacccatgcaccttctctgcttaagcccta

SEQ ID NO: 15877 - DNA, 35 bp, Artificial Sequence
  Synthetic oligonucleotide
gacgcagacagtctggtgcctcagctttcctcacc

SEQ ID NO: 15878 - DNA, 36 bp, Artificial Sequence
  Synthetic oligonucleotide
tcccacatcccgaatggattttatttttctgagaca

SEQ ID NO: 15879 - DNA, 35 bp, Artificial Sequence
  Synthetic oligonucleotide
gtgctcgctgcacttttctcactaccatgatccca

SEQ ID NO: 15880 - DNA, 37 bp, Artificial Sequence
  Synthetic oligonucleotide
gccatccctccgtaatctaggtccactcactacatga

SEQ ID NO: 15881 - DNA, 35 bp, Artificial Sequence
  Synthetic oligonucleotide
taccgatcccctctgctctgaactcttcctggtga

SEQ ID NO: 15882 - DNA, 35 bp, Artificial Sequence
  Synthetic oligonucleotide
atcctctgccactgttgcgaacatgttcgagcact

SEQ ID NO: 15883 - DNA, 36 bp, Artificial Sequence
  Synthetic oligonucleotide
gtgccgcacgcacaggcttgatacaccatacctcaa

SEQ ID NO: 15884 - DNA, 37 bp, Artificial Sequence
  Synthetic oligonucleotide
tgatgatcgtactcatgccgtttgcccacacctagga

SEQ ID NO: 15885 - DNA, 38 bp, Artificial Sequence
  Synthetic oligonucleotide
gtgacgcccatctgcacctagcatattccgtgccctga

SEQ ID NO: 15886 - DNA, 35 bp, Artificial Sequence
  Synthetic oligonucleotide
gtccactcccaccgatgcccactgcaaatcacccc

SEQ ID NO: 15887 - DNA, 35 bp, Artificial Sequence
  Synthetic oligonucleotide
gagcctcccgccggtatagctggcgaccaaccccc

SEQ ID NO: 15888 - DNA, 35 bp, Artificial Sequence
  Synthetic oligonucleotide
gtggagccctaccccattgttcgttcagtgctttt

SEQ ID NO: 15889 - DNA, 35 bp, Artificial Sequence
  Synthetic oligonucleotide
atgtggggcgacgggaagacagcaggagagcggca

SEQ ID NO: 15890 - DNA, 36 bp, Artificial Sequence
  Synthetic oligonucleotide
gccctcctcactcaatctcctctcgccttaaggtga

SEQ ID NO: 15891 - DNA, 38 bp, Artificial Sequence
  Synthetic oligonucleotide
gatccaccaatgactttactgttacccgaccgttgtga

SEQ ID NO: 15892 - DNA, 35 bp, Artificial Sequence
  Synthetic oligonucleotide
tccctcaccaccagccgtccagtttcaccagttga

SEQ ID NO: 15893 - DNA, 35 bp, Artificial Sequence
  Synthetic oligonucleotide
gttggagggaggggggaagtgctgcacgaagaata

SEQ ID NO: 15894 - DNA, 35 bp, Artificial Sequence
  Synthetic oligonucleotide
gccaaaggctcaaatgctgacgcactcacacgcct

SEQ ID NO: 15895 - DNA, 35 bp, Artificial Sequence
  Synthetic oligonucleotide
agcatgaccccgcttgatctcctccgagtaggaca

SEQ ID NO: 15896 - DNA, 36 bp, Artificial Sequence
  Synthetic oligonucleotide
gtccacgcgctccgaacggtcccttgttcctttgca

SEQ ID NO: 15897 - DNA, 35 bp, Artificial Sequence
  Synthetic oligonucleotide
acccgtgcattccctccatcgtcttcttgacatca

SEQ ID NO: 15898 - DNA, 37 bp, Artificial Sequence
  Synthetic oligonucleotide
tatgtagccgccaacgtcctccataatgcctgtacga

SEQ ID NO: 15899 - DNA, 35 bp, Artificial Sequence
  Synthetic oligonucleotide
gaactcatgcccaactatcataaggcttttccata

SEQ ID NO: 15900 - DNA, 35 bp, Artificial Sequence
  Synthetic oligonucleotide
ggggcctgggggggttggaattggacgggtgggtt

SEQ ID NO: 15901 - DNA, 38 bp, Artificial Sequence
  Synthetic oligonucleotide
gcaccgcatcaccacacatacgcactgaccgtctctga

SEQ ID NO: 15902 - DNA, 35 bp, Artificial Sequence
  Synthetic oligonucleotide
tcaatcgggaagcactcatcatctcgtttacccac

SEQ ID NO: 15903 - DNA, 35 bp, Artificial Sequence
  Synthetic oligonucleotide
gccctgagcccgatcttttgttccttgttcgctgc

SEQ ID NO: 15904 - DNA, 35 bp, Artificial Sequence
  Synthetic oligonucleotide
tgtcagtgacgggtgggggggaggaatgaggcttg

SEQ ID NO: 15905 - DNA, 35 bp, Artificial Sequence
  Synthetic oligonucleotide
gaccccatcgcgcgcggggatcgttactccgccct

SEQ ID NO: 15906 - DNA, 35 bp, Artificial Sequence
  Synthetic oligonucleotide
tttgccaccttctgttcgggtcacctactagtatt

SEQ ID NO: 15907 - DNA, 37 bp, Artificial Sequence
  Synthetic oligonucleotide
gaagggggacgtggtgcaatgggcgtaggacgtgaga

SEQ ID NO: 15908 - DNA, 37 bp, Artificial Sequence
  Synthetic oligonucleotide
tccacggcaacactggacgctatctactcctccccga

SEQ ID NO: 15909 - DNA, 36 bp, Artificial Sequence
  Synthetic oligonucleotide
gaatccaccctcaccccacattgctatcggtcacta

SEQ ID NO: 15910 - DNA, 35 bp, Artificial Sequence
  Synthetic oligonucleotide
atcccccgggtcgctcatgtatcttgccatcgtac

SEQ ID NO: 15911 - DNA, 35 bp, Artificial Sequence
  Synthetic oligonucleotide
gtcccatcctcgcgcgtagatcgctctacatgtcg

SEQ ID NO: 15912 - DNA, 35 bp, Artificial Sequence
  Synthetic oligonucleotide
gcgaacgctaatgcctagcaccccttttctacttg

SEQ ID NO: 15913 - DNA, 36 bp, Artificial Sequence
  Synthetic oligonucleotide
taagtcagacctgctatgcaactcacggcctccaca

SEQ ID NO: 15914 - DNA, 37 bp, Artificial Sequence
  Synthetic oligonucleotide
gctgccacccaggagggggggaagagagggaggacga

SEQ ID NO: 15915 - DNA, 36 bp, Artificial Sequence
  Synthetic oligonucleotide
gcaccttcccgctgcggagtagcaaccacccttgga

SEQ ID NO: 15916 - DNA, 37 bp, Artificial Sequence
  Synthetic oligonucleotide
tcaaggtacggagaggaaggggggagagataggttga

SEQ ID NO: 15917 - DNA, 36 bp, Artificial Sequence
  Synthetic oligonucleotide
gagcgacgcaccacacactctcgcagccacgcaata

SEQ ID NO: 15918 - DNA, 35 bp, Artificial Sequence
  Synthetic oligonucleotide
tctatctgctttctgccccagccggcccccgctct

SEQ ID NO: 15919 - DNA, 37 bp, Artificial Sequence
  Synthetic oligonucleotide
aagatggtaggataggggattaggcgggagggcgaga

SEQ ID NO: 15920 - DNA, 38 bp, Artificial Sequence
  Synthetic oligonucleotide
gtaccgcccccccccacagtccgcttccaacatgctga

SEQ ID NO: 15921 - DNA, 35 bp, Artificial Sequence
  Synthetic oligonucleotide
atggcgcaccctagagtgcggcatcaaaaccaccc

SEQ ID NO: 15922 - DNA, 35 bp, Artificial Sequence
  Synthetic oligonucleotide
gtcaccccaacgtactatctgttgtcgtacacatc

SEQ ID NO: 15923 - DNA, 35 bp, Artificial Sequence
  Synthetic oligonucleotide
gcccaatcccgtgtgtccaccgatgcatcgccctc

SEQ ID NO: 15924 - DNA, 35 bp, Artificial Sequence
  Synthetic oligonucleotide
tcccacccccccagtaagtaatgacggctggattc

SEQ ID NO: 15925 - DNA, 35 bp, Artificial Sequence
  Synthetic oligonucleotide
gtgagtgccctgaacttcccgtatactcgttccga

SEQ ID NO: 15926 - DNA, 35 bp, Artificial Sequence
  Synthetic oligonucleotide
tgtccagatcgctccggcactttcaacacatcgta

SEQ ID NO: 15927 - DNA, 35 bp, Artificial Sequence
  Synthetic oligonucleotide
tccccgcctcatgactagggcacaggacacctctt

SEQ ID NO: 15928 - DNA, 36 bp, Artificial Sequence
  Synthetic oligonucleotide
gcctggggccagggcgtacggaaaaggtgggccgga

SEQ ID NO: 15929 - DNA, 37 bp, Artificial Sequence
  Synthetic oligonucleotide
ggaacacgcgtgggccttcctttgccttctccactga

SEQ ID NO: 15930 - DNA, 37 bp, Artificial Sequence
  Synthetic oligonucleotide
gaccgcagatgcatccattgctatctcctccgcctga

SEQ ID NO: 15931 - DNA, 38 bp, Artificial Sequence
  Synthetic oligonucleotide
gactgactgtcgaatgacttgtgcccatccctttctga

SEQ ID NO: 15932 - DNA, 36 bp, Artificial Sequence
  Synthetic oligonucleotide
gaggatagggtgccgagataatgggatggagtggta

SEQ ID NO: 15933 - DNA, 35 bp, Artificial Sequence
  Synthetic oligonucleotide
tcagactgcttcactccggcgttacttcgaatccc

SEQ ID NO: 15934 - DNA, 35 bp, Artificial Sequence
  Synthetic oligonucleotide
gcccatagacaccgcccgctctgatccaatttgtg

SEQ ID NO: 15935 - DNA, 36 bp, Artificial Sequence
  Synthetic oligonucleotide
accgtctggactctctgttgcccaagattttactta

SEQ ID NO: 15936 - DNA, 35 bp, Artificial Sequence
  Synthetic oligonucleotide
attgacagcccaacacgctcctctgtcaccctata

SEQ ID NO: 15937 - DNA, 35 bp, Artificial Sequence
  Synthetic oligonucleotide
accctcctgccgaagccctgtgcgcacttgctata

SEQ ID NO: 15938 - DNA, 36 bp, Artificial Sequence
  Synthetic oligonucleotide
cactaactgctcctaatgcgaatgttccgtgcccta

SEQ ID NO: 15939 - DNA, 36 bp, Artificial Sequence
  Synthetic oligonucleotide
tcaccatcacacttaacgaacatagatctttgccta

SEQ ID NO: 15940 - DNA, 35 bp, Artificial Sequence
  Synthetic oligonucleotide
accgacagcctgtgcgcttttggtccaacccctcc

SEQ ID NO: 15941 - DNA, 35 bp, Artificial Sequence
  Synthetic oligonucleotide
tcatccccgagctgttgtctgcctcaacgccgttc

SEQ ID NO: 15942 - DNA, 37 bp, Artificial Sequence
  Synthetic oligonucleotide
atcgcgcccactttttcatcctcgccacaccgttgga

SEQ ID NO: 15943 - DNA, 35 bp, Artificial Sequence
  Synthetic oligonucleotide
acatcatgccaccgaccagcccgcttcggcttgct

SEQ ID NO: 15944 - DNA, 36 bp, Artificial Sequence
  Synthetic oligonucleotide
gatgcgcggggccgctcgttccattctcctagttca

SEQ ID NO: 15945 - DNA, 37 bp, Artificial Sequence
  Synthetic oligonucleotide
ggcgacagccacgcctacacccacacgcatacctaga

SEQ ID NO: 15946 - DNA, 36 bp, Artificial Sequence
  Synthetic oligonucleotide
gtgaaagccggagaggggaaatgagaatggatggga

SEQ ID NO: 15947 - DNA, 37 bp, Artificial Sequence
  Synthetic oligonucleotide
acctcgaagactggtgtgggatgcatggcgggtggga

SEQ ID NO: 15948 - DNA, 38 bp, Artificial Sequence
  Synthetic oligonucleotide
aagaaaggaaaggtggaaggagagactgtacaagctga

SEQ ID NO: 15949 - DNA, 37 bp, Artificial Sequence
  Synthetic oligonucleotide
gtagtggggtgggcgggcgtgggaactgactggctga

SEQ ID NO: 15950 - DNA, 35 bp, Artificial Sequence
  Synthetic oligonucleotide
gtgcaacctcgtctgtcatctcgacgccactacgc

SEQ ID NO: 15951 - DNA, 35 bp, Artificial Sequence
  Synthetic oligonucleotide
tcccgtcacccactgccttccacaacgttcacaca

SEQ ID NO: 15952 - DNA, 37 bp, Artificial Sequence
  Synthetic oligonucleotide
gagtgcaagaggaagaaatggaaagcgagcgatgtga

SEQ ID NO: 15953 - DNA, 35 bp, Artificial Sequence
  Synthetic oligonucleotide
acctgcattgccatccggttagcctatgcacacct

SEQ ID NO: 15954 - DNA, 36 bp, Artificial Sequence
  Synthetic oligonucleotide
tcaccgctgcctcacgtacctttttttgcatccaca

SEQ ID NO: 15955 - DNA, 35 bp, Artificial Sequence
  Synthetic oligonucleotide
ggagagccgtcctacgttactcaccatcaatgcca

SEQ ID NO: 15956 - DNA, 36 bp, Artificial Sequence
  Synthetic oligonucleotide
tccactacacccgctctcttggagagacctaacgaa

SEQ ID NO: 15957 - DNA, 36 bp, Artificial Sequence
  Synthetic oligonucleotide
tcacaccgcctgtgattctcctcacatatttgacca

SEQ ID NO: 15958 - DNA, 36 bp, Artificial Sequence
  Synthetic oligonucleotide
atcacacctccgccatgcttcatccctcataaggga

SEQ ID NO: 15959 - DNA, 37 bp, Artificial Sequence
  Synthetic oligonucleotide
gtctgcatgggtggatcacagcgggtggaaggtggga

SEQ ID NO: 15960 - DNA, 34 bp, Artificial Sequence
  Synthetic oligonucleotide
atgtggacctcgcactctgtgtttgctccgttcc

SEQ ID NO: 15961 - DNA, 35 bp, Artificial Sequence
  Synthetic oligonucleotide
tcatcactgtcccgtaatccgtctgaatttctgcg

SEQ ID NO: 15962 - DNA, 35 bp, Artificial Sequence
  Synthetic oligonucleotide
gactcaacattccgaccgacccagccccctaccgt

SEQ ID NO: 15963 - DNA, 37 bp, Artificial Sequence
  Synthetic oligonucleotide
tcacaccaaacatatgtgtcactgattcctccgccga

SEQ ID NO: 15964 - DNA, 36 bp, Artificial Sequence
  Synthetic oligonucleotide
gtgaccgcagtgcttacacgctgatcgatcctcata

SEQ ID NO: 15965 - DNA, 35 bp, Artificial Sequence
  Synthetic oligonucleotide
aattgcgagccgccctcgttgtaaacagtcctccc

SEQ ID NO: 15966 - DNA, 37 bp, Artificial Sequence
  Synthetic oligonucleotide
acgtgacccccgcattgttatctagaattacacccga

SEQ ID NO: 15967 - DNA, 37 bp, Artificial Sequence
  Synthetic oligonucleotide
tttgagcacagggggcatgggaggaaagggtaaagga

SEQ ID NO: 15968 - DNA, 38 bp, Artificial Sequence
  Synthetic oligonucleotide
acaggtcagacatctgcttacacacacctcttctatga

SEQ ID NO: 15969 - DNA, 35 bp, Artificial Sequence
  Synthetic oligonucleotide
tgtgggacaggtcggcgagggaggattaggagtgg

SEQ ID NO: 15970 - DNA, 35 bp, Artificial Sequence
  Synthetic oligonucleotide
gcaccctagaccgcgctggaatttcgccgcccctt

SEQ ID NO: 15971 - DNA, 36 bp, Artificial Sequence
  Synthetic oligonucleotide
aacacgagcccgatgctcgatgcaccctttatttca

SEQ ID NO: 15972 - DNA, 37 bp, Artificial Sequence
  Synthetic oligonucleotide
gtgagggggtgggtatttgcgggtgcagggggaggga

SEQ ID NO: 15973 - DNA, 37 bp, Artificial Sequence
  Synthetic oligonucleotide
gctaacggggcggtggggtttggagggttgggctgga

SEQ ID NO: 15974 - DNA, 35 bp, Artificial Sequence
  Synthetic oligonucleotide
gatgtaagggggtcggaaggggaggggagggggac

SEQ ID NO: 15975 - DNA, 35 bp, Artificial Sequence
  Synthetic oligonucleotide
gtcaaccaggctacttacacccacccatcctgctt

SEQ ID NO: 15976 - DNA, 36 bp, Artificial Sequence
  Synthetic oligonucleotide
atcgcctcccctgacttctgaccaacttcttcgaca

SEQ ID NO: 15977 - DNA, 37 bp, Artificial Sequence
  Synthetic oligonucleotide
ggtcacgaccattatcactcaacgccctctgcctgga

SEQ ID NO: 15978 - DNA, 36 bp, Artificial Sequence
  Synthetic oligonucleotide
atgaaggtgcgaatagaacggagggtggaggaagta

SEQ ID NO: 15979 - DNA, 35 bp, Artificial Sequence
  Synthetic oligonucleotide
ggtgacgaccagtgcctgtgcaaacctgctccctc

SEQ ID NO: 15980 - DNA, 35 bp, Artificial Sequence
  Synthetic oligonucleotide
gcaccgtccgcgaatagttttgcccgtcactttgt

SEQ ID NO: 15981 - DNA, 37 bp, Artificial Sequence
  Synthetic oligonucleotide
aagacggaagaggggaggaaagcaccaataactaaga

SEQ ID NO: 15982 - DNA, 37 bp, Artificial Sequence
  Synthetic oligonucleotide
gtcggtgggatggaagtgggaaggggcatggacagga

SEQ ID NO: 15983 - DNA, 36 bp, Artificial Sequence
  Synthetic oligonucleotide
tccccgagctgctgctgccctatcgtatccatctga

SEQ ID NO: 15984 - DNA, 35 bp, Artificial Sequence
  Synthetic oligonucleotide
attagcgagcctcacctccttgcacctgtttaccc

SEQ ID NO: 15985 - DNA, 35 bp, Artificial Sequence
  Synthetic oligonucleotide
gactacctcttggccacagtgatcccatctatatc

SEQ ID NO: 15986 - DNA, 36 bp, Artificial Sequence
  Synthetic oligonucleotide
atgctcactccctggttccgcgcccggccttctaca

SEQ ID NO: 15987 - DNA, 37 bp, Artificial Sequence
  Synthetic oligonucleotide
tgcgacgacactgagtgggggagtgctggggtgggga

SEQ ID NO: 15988 - DNA, 36 bp, Artificial Sequence
  Synthetic oligonucleotide
tgacagagaacctgggtcgggggggagaggtgaata

SEQ ID NO: 15989 - DNA, 35 bp, Artificial Sequence
  Synthetic oligonucleotide
agcccaacatctaggtactttaattcgccaccgcg

SEQ ID NO: 15990 - DNA, 35 bp, Artificial Sequence
  Synthetic oligonucleotide
ttcgcctcagccgggtctatccgtcactcccaatt

SEQ ID NO: 15991 - DNA, 37 bp, Artificial Sequence
  Synthetic oligonucleotide
gagtagtgtgggaagaggggtaaatgcgcgtgagaga

SEQ ID NO: 15992 - DNA, 35 bp, Artificial Sequence
  Synthetic oligonucleotide
agtacgcgtgcccccgcctgatcgttctcaccaag

SEQ ID NO: 15993 - DNA, 35 bp, Artificial Sequence
  Synthetic oligonucleotide
ttaactcgtactaagctgccttccctcacacatcg

SEQ ID NO: 15994 - DNA, 35 bp, Artificial Sequence
  Synthetic oligonucleotide
accctgctcatgaacggtctccttaatttcccttg

SEQ ID NO: 15995 - DNA, 35 bp, Artificial Sequence
  Synthetic oligonucleotide
gagggggggaggtgggtcttatttgggtctggagt

SEQ ID NO: 15996 - DNA, 38 bp, Artificial Sequence
  Synthetic oligonucleotide
ttgccaccccggcgctgtatccactctgtaatgtctga

SEQ ID NO: 15997 - DNA, 38 bp, Artificial Sequence
  Synthetic oligonucleotide
acctcccaccccttgctgtgttacgctcttgtagttga

SEQ ID NO: 15998 - DNA, 35 bp, Artificial Sequence
  Synthetic oligonucleotide
ggaccgtgccctgggctccgaccgaatccacttac

SEQ ID NO: 15999 - DNA, 35 bp, Artificial Sequence
  Synthetic oligonucleotide
tgccaacagacggcccacgactcactccccttcag

SEQ ID NO: 16000 - DNA, 35 bp, Artificial Sequence
  Synthetic oligonucleotide
aaggtccccgcctgctctgttactctccttgcacg

SEQ ID NO: 16001 - DNA, 35 bp, Artificial Sequence
  Synthetic oligonucleotide
gttgctggccactcttgctgaattactatcattat

SEQ ID NO: 16002 - DNA, 35 bp, Artificial Sequence
  Synthetic oligonucleotide
gccgtaccacgtttctgtctatattttggttttgt

SEQ ID NO: 16003 - DNA, 36 bp, Artificial Sequence
  Synthetic oligonucleotide
taaatgccgtccgccaatatatgtcacacttcttca

SEQ ID NO: 16004 - DNA, 35 bp, Artificial Sequence
  Synthetic oligonucleotide
tgcacgtgttgcgtcatcgggcactttctcacacc

SEQ ID NO: 16005 - DNA, 35 bp, Artificial Sequence
  Synthetic oligonucleotide
gactttcgcgtgacccctgcccaatcccaaccatg

SEQ ID NO: 16006 - DNA, 35 bp, Artificial Sequence
  Synthetic oligonucleotide
agcccccgcggcgttcatacttcctaatgttcctg

SEQ ID NO: 16007 - DNA, 35 bp, Artificial Sequence
  Synthetic oligonucleotide
gtcctctcctccgcctgctccatactccagtctgt

SEQ ID NO: 16008 - DNA, 35 bp, Artificial Sequence
  Synthetic oligonucleotide
accgactaggcgccctagccccattcaccgttaca

SEQ ID NO: 16009 - DNA, 38 bp, Artificial Sequence
  Synthetic oligonucleotide
acgtccccaatgggccatcgtgttcttccatctactga

SEQ ID NO: 16010 - DNA, 38 bp, Artificial Sequence
  Synthetic oligonucleotide
tctccagccagtcccgtctcagtttcgccctgccctga

SEQ ID NO: 16011 - DNA, 35 bp, Artificial Sequence
  Synthetic oligonucleotide
ggaggggcgggaaaataggcgggtagggaacaata

SEQ ID NO: 16012 - DNA, 35 bp, Artificial Sequence
  Synthetic oligonucleotide
acaccccagaaacgctgactttaattcgactgccc

SEQ ID NO: 16013 - DNA, 35 bp, Artificial Sequence
  Synthetic oligonucleotide
aacatagccccgtcgcttttacctgcccgcgccgc

SEQ ID NO: 16014 - DNA, 37 bp, Artificial Sequence
  Synthetic oligonucleotide
gccggacactttcccgtttcgcttactcaacagacga

SEQ ID NO: 16015 - DNA, 37 bp, Artificial Sequence
  Synthetic oligonucleotide
gagccgcctgtcttacaactctagccatcctcatcga

SEQ ID NO: 16016 - DNA, 37 bp, Artificial Sequence
  Synthetic oligonucleotide
gccacctcacattcttacactacctgactgatcggga

SEQ ID NO: 16017 - DNA, 35 bp, Artificial Sequence
  Synthetic oligonucleotide
gtaaccccccgacgagtccagtccctcctcgccta

SEQ ID NO: 16018 - DNA, 36 bp, Artificial Sequence
  Synthetic oligonucleotide
gtccatatccgcttgaacgccgctccgctcttctgc

SEQ ID NO: 16019 - DNA, 35 bp, Artificial Sequence
  Synthetic oligonucleotide
ttatcccaccacctgattagacgtgaagcctcacg

SEQ ID NO: 16020 - DNA, 30 bp, Artificial Sequence
  Synthetic oligonucleotide
tagaccgactctgtcccttgactctcatgt

SEQ ID NO: 16021 - DNA, 36 bp, Artificial Sequence
  Synthetic oligonucleotide
tactacctcacctgttatctgaccaccattgcccaa

SEQ ID NO: 16022 - DNA, 35 bp, Artificial Sequence
  Synthetic oligonucleotide
gagcgggcatttgcgcggtacgactccccctttca

SEQ ID NO: 16023 - DNA, 38 bp, Artificial Sequence
  Synthetic oligonucleotide
gtgccaccagcacatatcctgccctgtaagaccactga

SEQ ID NO: 16024 - DNA, 37 bp, Artificial Sequence
  Synthetic oligonucleotide
accctacccgtaacgaccttattaggtctacccttga

SEQ ID NO: 16025 - DNA, 36 bp, Artificial Sequence
  Synthetic oligonucleotide
gacaccttcgccttcaaagttgcatttacgacttgc

SEQ ID NO: 16026 - DNA, 36 bp, Artificial Sequence
  Synthetic oligonucleotide
tacgtgtcagacacctccctctgccttatttgtcaa

SEQ ID NO: 16027 - DNA, 36 bp, Artificial Sequence
  Synthetic oligonucleotide
ttcgtcgtcctgcccctactattgattttcgtccca

SEQ ID NO: 16028 - DNA, 37 bp, Artificial Sequence
  Synthetic oligonucleotide
gtgtaccgctcccactctgatccgtgctctggggcga

SEQ ID NO: 16029 - DNA, 38 bp, Artificial Sequence
  Synthetic oligonucleotide
tgtacccctcggtgatcaacacacatacaaccacatga

SEQ ID NO: 16030 - DNA, 38 bp, Artificial Sequence
  Synthetic oligonucleotide
gcctagcttccagttccatcaattgccttgtgtcctga

SEQ ID NO: 16031 - DNA, 35 bp, Artificial Sequence
  Synthetic oligonucleotide
tcacagcccggatctcggtctcggcctttatccta

SEQ ID NO: 16032 - DNA, 36 bp, Artificial Sequence
  Synthetic oligonucleotide
atgttacgctaccgcatgttccttccctcgtttcca

SEQ ID NO: 16033 - DNA, 37 bp, Artificial Sequence
  Synthetic oligonucleotide
gaaccacccctgcggacggctcacacactcacactga

SEQ ID NO: 16034 - DNA, 38 bp, Artificial Sequence
  Synthetic oligonucleotide
agtacgagtctcgccctgtctgcagaacacctccctga

SEQ ID NO: 16035 - DNA, 36 bp, Artificial Sequence
  Synthetic oligonucleotide
taacacctggttacctgcccgttcccctaatgctga

SEQ ID NO: 16036 - DNA, 37 bp, Artificial Sequence
  Synthetic oligonucleotide
aatcaccgcagggtctcggctcgattgccccccttga

SEQ ID NO: 16037 - DNA, 36 bp, Artificial Sequence
  Synthetic oligonucleotide
gttgggacggtaggaggttggggcaagggaaatgaa

SEQ ID NO: 16038 - DNA, 36 bp, Artificial Sequence
  Synthetic oligonucleotide
gttgccacctcactcgggccgtccatttactggaca

SEQ ID NO: 16039 - DNA, 36 bp, Artificial Sequence
  Synthetic oligonucleotide
gccatgtccactgtcttccttgttattacgtctaga

SEQ ID NO: 16040 - DNA, 36 bp, Artificial Sequence
  Synthetic oligonucleotide
tgaaggtagaggggagataggaagggaatagggcta

SEQ ID NO: 16041 - DNA, 35 bp, Artificial Sequence
  Synthetic oligonucleotide
tcaagtcctcctgcgcacctccattgatccctgta

SEQ ID NO: 16042 - DNA, 35 bp, Artificial Sequence
  Synthetic oligonucleotide
gcccacacctgcaaggtgttctttgccctctttac

SEQ ID NO: 16043 - DNA, 35 bp, Artificial Sequence
  Synthetic oligonucleotide
aaccgagctgatccatggttgcgctccataaatcc

SEQ ID NO: 16044 - DNA, 35 bp, Artificial Sequence
  Synthetic oligonucleotide
taaccgcactactcgaccggctactggacaacttt

SEQ ID NO: 16045 - DNA, 35 bp, Artificial Sequence
  Synthetic oligonucleotide
ttgtgaccaccctcctcgctctacagtgtatttca

SEQ ID NO: 16046 - DNA, 37 bp, Artificial Sequence
  Synthetic oligonucleotide
gaactgagggggaatggaggtacggggttgaggtgga

SEQ ID NO: 16047 - DNA, 35 bp, Artificial Sequence
  Synthetic oligonucleotide
gtgacatcactgggcttaggcatccgaacacctct

SEQ ID NO: 16048 - DNA, 35 bp, Artificial Sequence
  Synthetic oligonucleotide
gttgacacaatatgtaatagcccgttgcctcttct

SEQ ID NO: 16049 - DNA, 35 bp, Artificial Sequence
  Synthetic oligonucleotide
gtgagataggccaaggtggaagcgggggggggaaa

SEQ ID NO: 16050 - DNA, 36 bp, Artificial Sequence
  Synthetic oligonucleotide
atcgcacccatgcgcattcccataattcccatcgaa

SEQ ID NO: 16051 - DNA, 37 bp, Artificial Sequence
  Synthetic oligonucleotide
tacgatgctggggcgggagtggctgggcggtcgcgga

SEQ ID NO: 16052 - DNA, 36 bp, Artificial Sequence
  Synthetic oligonucleotide
gggaggatggagaagggctgaatggaactgacaata

SEQ ID NO: 16053 - DNA, 35 bp, Artificial Sequence
  Synthetic oligonucleotide
tccagctcattttcgtccgtacgttacgccccgct

SEQ ID NO: 16054 - DNA, 37 bp, Artificial Sequence
  Synthetic oligonucleotide
gacttgcaccgcccctaaaatcgcctgaccgaacgga

SEQ ID NO: 16055 - DNA, 35 bp, Artificial Sequence
  Synthetic oligonucleotide
atccgccaggaccctggtttacatattgacccccg

SEQ ID NO: 16056 - DNA, 37 bp, Artificial Sequence
  Synthetic oligonucleotide
ttcgcgtccgcattctcttagctcccccgtatcccga

SEQ ID NO: 16057 - DNA, 37 bp, Artificial Sequence
  Synthetic oligonucleotide
tcaccctctccattgttaaacaccctgggtcacctga

SEQ ID NO: 16058 - DNA, 38 bp, Artificial Sequence
  Synthetic oligonucleotide
taccccacccatctggcgtcgacctcaaactgggttga

SEQ ID NO: 16059 - DNA, 36 bp, Artificial Sequence
  Synthetic oligonucleotide
ataggtccagcgccgcttagccgatcctctgtaacc

SEQ ID NO: 16060 - DNA, 34 bp, Artificial Sequence
  Synthetic oligonucleotide
ggaccctgtctccccgtgtttgcacctttacttc

SEQ ID NO: 16061 - DNA, 35 bp, Artificial Sequence
  Synthetic oligonucleotide
tttacatccccaacctcaatacgtgagacgaactg

SEQ ID NO: 16062 - DNA, 35 bp, Artificial Sequence
  Synthetic oligonucleotide
tgtcccgccgacatcatgacgctccactgtttatt

SEQ ID NO: 16063 - DNA, 35 bp, Artificial Sequence
  Synthetic oligonucleotide
tccgacgctgccgggatctgccccgcacacgcttt

SEQ ID NO: 16064 - DNA, 36 bp, Artificial Sequence
  Synthetic oligonucleotide
gcccttgtccgcccttttggtacacatcattcacga

SEQ ID NO: 16065 - DNA, 37 bp, Artificial Sequence
  Synthetic oligonucleotide
ggtgcgtgcctcagcgctctcgactatcttcctttga

SEQ ID NO: 16066 - DNA, 35 bp, Artificial Sequence
  Synthetic oligonucleotide
ttgacaccataacgcacaaaatcgcaagtcttgtc

SEQ ID NO: 16067 - DNA, 35 bp, Artificial Sequence
  Synthetic oligonucleotide
tatgccgcatatctactggtccgactttccaaatg

SEQ ID NO: 16068 - DNA, 35 bp, Artificial Sequence
  Synthetic oligonucleotide
gcacgccccgcggtgtctcgctatcccatgctggt

SEQ ID NO: 16069 - DNA, 35 bp, Artificial Sequence
  Synthetic oligonucleotide
actccgctcactatcacgttcctaaggatcccttt

SEQ ID NO: 16070 - DNA, 35 bp, Artificial Sequence
  Synthetic oligonucleotide
tttcccgccatcctccacagggtccttagacctaa

SEQ ID NO: 16071 - DNA, 36 bp, Artificial Sequence
  Synthetic oligonucleotide
gcgtattgcaccgtcctcccacgccactcgcaccca

SEQ ID NO: 16072 - DNA, 37 bp, Artificial Sequence
  Synthetic oligonucleotide
atccccgtgccacaattaataacatgacctctcctga

SEQ ID NO: 16073 - DNA, 37 bp, Artificial Sequence
  Synthetic oligonucleotide
tgcgaacgcccggccataccgttcttcattcccttga

SEQ ID NO: 16074 - DNA, 35 bp, Artificial Sequence
  Synthetic oligonucleotide
tgacaccacatgcctagccttttcccgctcactta

SEQ ID NO: 16075 - DNA, 35 bp, Artificial Sequence
  Synthetic oligonucleotide
tgccgacccttgtccacgtgaatccaccctactac

SEQ ID NO: 16076 - DNA, 35 bp, Artificial Sequence
  Synthetic oligonucleotide
tatcacgccgaaccatccattgaggtcttaactgc

SEQ ID NO: 16077 - DNA, 35 bp, Artificial Sequence
  Synthetic oligonucleotide
tatgccacctgtgcctgagccttgatttcgccaca

SEQ ID NO: 16078 - DNA, 36 bp, Artificial Sequence
  Synthetic oligonucleotide
gcccaacagacatcagtttctccgtactgccgatca

SEQ ID NO: 16079 - DNA, 35 bp, Artificial Sequence
  Synthetic oligonucleotide
tgcgcaccctttgttagcacgaatcacctgcaagc

SEQ ID NO: 16080 - DNA, 35 bp, Artificial Sequence
  Synthetic oligonucleotide
accgaatcgcggctcatttgctgcggtcacttctc

SEQ ID NO: 16081 - DNA, 35 bp, Artificial Sequence
  Synthetic oligonucleotide
ggatccccgccaactccaataacgcctcgggcctt

SEQ ID NO: 16082 - DNA, 36 bp, Artificial Sequence
  Synthetic oligonucleotide
gactatcacaacgcagccccccgtggctatcaccca

SEQ ID NO: 16083 - DNA, 35 bp, Artificial Sequence
  Synthetic oligonucleotide
gtacagagcccaacccgtatttctatgccccccta

SEQ ID NO: 16084 - DNA, 35 bp, Artificial Sequence
  Synthetic oligonucleotide
tgttatcccggcacatctaccctgcttcctttgag

SEQ ID NO: 16085 - DNA, 37 bp, Artificial Sequence
  Synthetic oligonucleotide
acgtaccgcccattgccatagtcctccgtcacacaga

SEQ ID NO: 16086 - DNA, 36 bp, Artificial Sequence
  Synthetic oligonucleotide
aacgatcacattgacgcacctcgaccccatgactga

SEQ ID NO: 16087 - DNA, 35 bp, Artificial Sequence
  Synthetic oligonucleotide
actaccaagcctgttgtctatttatcaccgcgtcc

SEQ ID NO: 16088 - DNA, 35 bp, Artificial Sequence
  Synthetic oligonucleotide
tcttgccctcacttacgaccggtcgtcttcaccct

SEQ ID NO: 16089 - DNA, 36 bp, Artificial Sequence
  Synthetic oligonucleotide
ggtgaaagcgggggcaaagaatcggtgagattggaa

SEQ ID NO: 16090 - DNA, 35 bp, Artificial Sequence
  Synthetic oligonucleotide
gttccaccgtcatttcaggtcctttcccgagtcca

SEQ ID NO: 16091 - DNA, 38 bp, Artificial Sequence
  Synthetic oligonucleotide
tcccacaccctcaatcgctgctttgacactagccctga

SEQ ID NO: 16092 - DNA, 37 bp, Artificial Sequence
  Synthetic oligonucleotide
accctcccaccgtgcactgaacaatacttgtgcctga

SEQ ID NO: 16093 - DNA, 36 bp, Artificial Sequence
  Synthetic oligonucleotide
gacaaatggagggcggtttggtgcggaactgaagta

SEQ ID NO: 16094 - DNA, 35 bp, Artificial Sequence
  Synthetic oligonucleotide
ataaccatccccgcatgactatcgcgatgtcgacc

SEQ ID NO: 16095 - DNA, 36 bp, Artificial Sequence
  Synthetic oligonucleotide
gccacgctggcccctggcttccaacataactcgcca

SEQ ID NO: 16096 - DNA, 36 bp, Artificial Sequence
  Synthetic oligonucleotide
acacaacccgatctaatcactggcgacacaaccgca

SEQ ID NO: 16097 - DNA, 36 bp, Artificial Sequence
  Synthetic oligonucleotide
tgacgctgcccgtacggttcgatctcggttccctca

SEQ ID NO: 16098 - DNA, 35 bp, Artificial Sequence
  Synthetic oligonucleotide
tggtgcacgccccgcacaaggtatcttttattcta

SEQ ID NO: 16099 - DNA, 35 bp, Artificial Sequence
  Synthetic oligonucleotide
tatgcgggccacattcctacaacttacgagcgatc

SEQ ID NO: 16100 - DNA, 35 bp, Artificial Sequence
  Synthetic oligonucleotide
gcacatcctgttcctctgcggggttctagcctctc

SEQ ID NO: 16101 - DNA, 35 bp, Artificial Sequence
  Synthetic oligonucleotide
accatgagcgtcccatttacgcccctagcccgtat

SEQ ID NO: 16102 - DNA, 35 bp, Artificial Sequence
  Synthetic oligonucleotide
gctaaaccccagaggagattgcacccactcccttt

SEQ ID NO: 16103 - DNA, 35 bp, Artificial Sequence
  Synthetic oligonucleotide
gaacacgttccctttctcgagtacccacccctttt

SEQ ID NO: 16104 - DNA, 36 bp, Artificial Sequence
  Synthetic oligonucleotide
tcccaacccgtcaccttcatgtttgtggtgctccca

SEQ ID NO: 16105 - DNA, 35 bp, Artificial Sequence
  Synthetic oligonucleotide
aacgtgcctcctcgctattttcttcgagcatgcca

SEQ ID NO: 16106 - DNA, 37 bp, Artificial Sequence
  Synthetic oligonucleotide
acaccgccctgcatgcgttcccatcactagtacttga

SEQ ID NO: 16107 - DNA, 37 bp, Artificial Sequence
  Synthetic oligonucleotide
gtacatcagctccatcgtttctatccacttccgttga

SEQ ID NO: 16108 - DNA, 35 bp, Artificial Sequence
  Synthetic oligonucleotide
ggtgccctacgatcgcgctgccaactgacccttcg

SEQ ID NO: 16109 - DNA, 35 bp, Artificial Sequence
  Synthetic oligonucleotide
tcctgcggcaattctaacaccgccctctagttgca

SEQ ID NO: 16110 - DNA, 38 bp, Artificial Sequence
  Synthetic oligonucleotide
ttagcgacctcgcgtatcgttctccaccctaatgctga

SEQ ID NO: 16111 - DNA, 35 bp, Artificial Sequence
  Synthetic oligonucleotide
gttccatgcgccgtccccccgttttaaccatcttg

SEQ ID NO: 16112 - DNA, 35 bp, Artificial Sequence
  Synthetic oligonucleotide
aatgcctgcgatcccctccccatcacacaccgtat

SEQ ID NO: 16113 - DNA, 35 bp, Artificial Sequence
  Synthetic oligonucleotide
gccctgccacgtgtggcgacgttcctcctagctct

SEQ ID NO: 16114 - DNA, 35 bp, Artificial Sequence
  Synthetic oligonucleotide
gcccagccgatcgagggctcaccgctttcaactgt

SEQ ID NO: 16115 - DNA, 35 bp, Artificial Sequence
  Synthetic oligonucleotide
tccatacccaccacgttcttatcgattgagtcctt

SEQ ID NO: 16116 - DNA, 36 bp, Artificial Sequence
  Synthetic oligonucleotide
aatccagccccaccatatcggccctagatcacgtaa

SEQ ID NO: 16117 - DNA, 37 bp, Artificial Sequence
  Synthetic oligonucleotide
atctccgcaccaccttttgtatgtccgcaatggccga

SEQ ID NO: 16118 - DNA, 36 bp, Artificial Sequence
  Synthetic oligonucleotide
accagcataacctgccatatcgtacccctcctttga

SEQ ID NO: 16119 - DNA, 36 bp, Artificial Sequence
  Synthetic oligonucleotide
gtgggagggagggttgggctccgttgggaagttata

SEQ ID NO: 16120 - DNA, 37 bp, Artificial Sequence
  Synthetic oligonucleotide
accatcctccatcagttcatgagaacatgaaccctga

SEQ ID NO: 16121 - DNA, 36 bp, Artificial Sequence
  Synthetic oligonucleotide
ttgatgcgtaccagtgcgattttccttccctctcta

SEQ ID NO: 16122 - DNA, 37 bp, Artificial Sequence
  Synthetic oligonucleotide
ggacgactccaggaaggacactgcacccaccactcga

SEQ ID NO: 16123 - DNA, 37 bp, Artificial Sequence
  Synthetic oligonucleotide
gaaccgatcgccaccattcagccagtaccttgaagga

SEQ ID NO: 16124 - DNA, 38 bp, Artificial Sequence
  Synthetic oligonucleotide
accgccccaccctaatgatatcctgctgtgaaccatga

SEQ ID NO: 16125 - DNA, 35 bp, Artificial Sequence
  Synthetic oligonucleotide
tactccccagcccttccatatcgtcaaccggcgcc

SEQ ID NO: 16126 - DNA, 35 bp, Artificial Sequence
  Synthetic oligonucleotide
gacgacacccccgtacttggactttagtagttatc

SEQ ID NO: 16127 - DNA, 35 bp, Artificial Sequence
  Synthetic oligonucleotide
tgttccagatgcaccattttccccgtcgctttggt

SEQ ID NO: 16128 - DNA, 37 bp, Artificial Sequence
  Synthetic oligonucleotide
tctagccggtccctctgtttgttacttccctgcacga

SEQ ID NO: 16129 - DNA, 37 bp, Artificial Sequence
  Synthetic oligonucleotide
tcatccagcccgataacaacggactcttctttctcga

SEQ ID NO: 16130 - DNA, 37 bp, Artificial Sequence
  Synthetic oligonucleotide
accactacacacattcatcacggacgttttcgaagga

SEQ ID NO: 16131 - DNA, 36 bp, Artificial Sequence
  Synthetic oligonucleotide
ttcaggaccaggcgggggtagggggcattgggagga

SEQ ID NO: 16132 - DNA, 37 bp, Artificial Sequence
  Synthetic oligonucleotide
tgccggggtcccaatggggtgttagatcgggtgggga

SEQ ID NO: 16133 - DNA, 38 bp, Artificial Sequence
  Synthetic oligonucleotide
acccactgccttccggaaggccacgaaccctctcttga

SEQ ID NO: 16134 - DNA, 35 bp, Artificial Sequence
  Synthetic oligonucleotide
actccatgaggaggttaactgataccgtttctgcc

SEQ ID NO: 16135 - DNA, 36 bp, Artificial Sequence
  Synthetic oligonucleotide
ggaggagcttgctgcacccgatttgaaccccaccaa

SEQ ID NO: 16136 - DNA, 38 bp, Artificial Sequence
  Synthetic oligonucleotide
tagacacctccaccccccattcgacgtgtacaaggtga

SEQ ID NO: 16137 - DNA, 35 bp, Artificial Sequence
  Synthetic oligonucleotide
ggagccccctcgagccctgcctatctcaagaagtt

SEQ ID NO: 16138 - DNA, 38 bp, Artificial Sequence
  Synthetic oligonucleotide
tgacgcaaagaagggaatgttgtggccgtggggtgtga

SEQ ID NO: 16139 - DNA, 35 bp, Artificial Sequence
  Synthetic oligonucleotide
tcgcgaccgccctcaatccgccatggcacttcact

SEQ ID NO: 16140 - DNA, 37 bp, Artificial Sequence
  Synthetic oligonucleotide
ggaccaggaaggacattaggggtgggagggttgcaga

SEQ ID NO: 16141 - DNA, 37 bp, Artificial Sequence
  Synthetic oligonucleotide
tacccagtagtcggccatgtacccgcgatccacccga

SEQ ID NO: 16142 - DNA, 35 bp, Artificial Sequence
  Synthetic oligonucleotide
tcatgacctgactagcagagcctttgcctttccga

SEQ ID NO: 16143 - DNA, 38 bp, Artificial Sequence
  Synthetic oligonucleotide
gcacaccccctgggaaagacataccgcgccacccttga

SEQ ID NO: 16144 - DNA, 35 bp, Artificial Sequence
  Synthetic oligonucleotide
gcccacgacctggacacgttatccttattcctcac

SEQ ID NO: 16145 - DNA, 35 bp, Artificial Sequence
  Synthetic oligonucleotide
ttcgtatctagccaccgcctcgccgcctactacat

SEQ ID NO: 16146 - DNA, 38 bp, Artificial Sequence
  Synthetic oligonucleotide
aacaaccccgccctccgtcatgcgaatgtcgcgaatga

SEQ ID NO: 16147 - DNA, 35 bp, Artificial Sequence
  Synthetic oligonucleotide
gacgagagtgggggatgagatagggtgcggggtag

SEQ ID NO: 16148 - DNA, 38 bp, Artificial Sequence
  Synthetic oligonucleotide
acacctgacccccacatggtttaacaaactgatcatga

SEQ ID NO: 16149 - DNA, 38 bp, Artificial Sequence
  Synthetic oligonucleotide
aaccgcggaacgggaagggggcaatcaagattgagtga

SEQ ID NO: 16150 - DNA, 38 bp, Artificial Sequence
  Synthetic oligonucleotide
atgacgacccgacacctgcgcttactcccccgcgttga

SEQ ID NO: 16151 - DNA, 36 bp, Artificial Sequence
  Synthetic oligonucleotide
tctcaaccgccctgctcttttaaattattaggccta

SEQ ID NO: 16152 - DNA, 36 bp, Artificial Sequence
  Synthetic oligonucleotide
acacctgcagagcgcgtcctcctgcccgaactttta

SEQ ID NO: 16153 - DNA, 35 bp, Artificial Sequence
  Synthetic oligonucleotide
taccccagtccggttggtcttgcctgcccctccca

SEQ ID NO: 16154 - DNA, 36 bp, Artificial Sequence
  Synthetic oligonucleotide
accctgcctcatcgtatccatgcaaacccgtgctca

SEQ ID NO: 16155 - DNA, 35 bp, Artificial Sequence
  Synthetic oligonucleotide
ttgtcaatcccaactttcctgagcgagacccatcg

SEQ ID NO: 16156 - DNA, 36 bp, Artificial Sequence
  Synthetic oligonucleotide
gtggggggggagggaggaaagggggagaaggacaaa

SEQ ID NO: 16157 - DNA, 36 bp, Artificial Sequence
  Synthetic oligonucleotide
gagtgccgtaccacgataacttggcctaccttccca

SEQ ID NO: 16158 - DNA, 38 bp, Artificial Sequence
  Synthetic oligonucleotide
aattgtgggagtaggggaagggaaggcagagaaggtga

SEQ ID NO: 16159 - DNA, 35 bp, Artificial Sequence
  Synthetic oligonucleotide
taccgcgcacgacagcccggttctcctctcgctcc

SEQ ID NO: 16160 - DNA, 35 bp, Artificial Sequence
  Synthetic oligonucleotide
tacaaagcctcaacgcccgacgaccacccgctctt

SEQ ID NO: 16161 - DNA, 38 bp, Artificial Sequence
  Synthetic oligonucleotide
gccatgatgcggccactccccccctcttcaccgtgtga

SEQ ID NO: 16162 - DNA, 35 bp, Artificial Sequence
  Synthetic oligonucleotide
gccgcccgggctgtatgtcttcctaactccgcgtc

SEQ ID NO: 16163 - DNA, 35 bp, Artificial Sequence
  Synthetic oligonucleotide
acaacagggctcccgcctgcttacctttcgttgtc

SEQ ID NO: 16164 - DNA, 35 bp, Artificial Sequence
  Synthetic oligonucleotide
ggtgtctccgaaccatcgcacacctggccctcccg

SEQ ID NO: 16165 - DNA, 35 bp, Artificial Sequence
  Synthetic oligonucleotide
attcccacacctgttgtcttgtctgtccatagttt

SEQ ID NO: 16166 - DNA, 37 bp, Artificial Sequence
  Synthetic oligonucleotide
ttcacgcgccccagtcgttctttatttgttccccgga

SEQ ID NO: 16167 - DNA, 38 bp, Artificial Sequence
  Synthetic oligonucleotide
gatgcctgggacctgcctctgtttttcactcaccttga

SEQ ID NO: 16168 - DNA, 38 bp, Artificial Sequence
  Synthetic oligonucleotide
gcccaccctcacgctcatcgttatcaaactgggtttga

SEQ ID NO: 16169 - DNA, 35 bp, Artificial Sequence
  Synthetic oligonucleotide
gacgactcaccaaccaaacatcacacaagctatag

SEQ ID NO: 16170 - DNA, 36 bp, Artificial Sequence
  Synthetic oligonucleotide
ttcccacccacagaactccggacttctcatttgaca

SEQ ID NO: 16171 - DNA, 36 bp, Artificial Sequence
  Synthetic oligonucleotide
gtgggaggggtggttgctcttactagggcgggttga

SEQ ID NO: 16172 - DNA, 35 bp, Artificial Sequence
  Synthetic oligonucleotide
gcgctgcccgcgagccatatcatcttcctcttgcc

SEQ ID NO: 16173 - DNA, 35 bp, Artificial Sequence
  Synthetic oligonucleotide
tccgagctcagtataccaccgtccgtcaaagtcct

SEQ ID NO: 16174 - DNA, 37 bp, Artificial Sequence
  Synthetic oligonucleotide
ggatgcacgtaccgcacgcccgaaaccagcccgccga

SEQ ID NO: 16175 - DNA, 38 bp, Artificial Sequence
  Synthetic oligonucleotide
gtttaaccactgccttcgtaccgtacagtcactattga

SEQ ID NO: 16176 - DNA, 35 bp, Artificial Sequence
  Synthetic oligonucleotide
gatctgccacttattatttaacgtcgacttgccta

SEQ ID NO: 16177 - DNA, 35 bp, Artificial Sequence
  Synthetic oligonucleotide
ggaatgccacatcccacctcgtatcgaaacctagt

SEQ ID NO: 16178 - DNA, 36 bp, Artificial Sequence
  Synthetic oligonucleotide
gaccgccaattccttcccgtccctgttctgctcaaa

SEQ ID NO: 16179 - DNA, 36 bp, Artificial Sequence
  Synthetic oligonucleotide
gctccacagagcccctacccccagttacccaggtaa

SEQ ID NO: 16180 - DNA, 36 bp, Artificial Sequence
  Synthetic oligonucleotide
acgactcggagcgtgctaactacccacaatttctca

SEQ ID NO: 16181 - DNA, 36 bp, Artificial Sequence
  Synthetic oligonucleotide
acccgccccattaaacgtacattacggtactctaga

SEQ ID NO: 16182 - DNA, 37 bp, Artificial Sequence
  Synthetic oligonucleotide
tgtgacacgtctcggagtactgccccccacctcacga

SEQ ID NO: 16183 - DNA, 37 bp, Artificial Sequence
  Synthetic oligonucleotide
gcgcaccccagctcacctcgcgacttatttgctgcga

SEQ ID NO: 16184 - DNA, 37 bp, Artificial Sequence
  Synthetic oligonucleotide
taaccgcacggaggaaggaaagggggtatagtaagga

SEQ ID NO: 16185 - DNA, 38 bp, Artificial Sequence
  Synthetic oligonucleotide
gcagtggaacgggggggagagaggcgagcagactttga

SEQ ID NO: 16186 - DNA, 35 bp, Artificial Sequence
  Synthetic oligonucleotide
gccacgagatggcatttgctccgccccagtccagc

SEQ ID NO: 16187 - DNA, 35 bp, Artificial Sequence
  Synthetic oligonucleotide
gtaccaacatcacaccaactgtcagaacgggcctc

SEQ ID NO: 16188 - DNA, 34 bp, Artificial Sequence
  Synthetic oligonucleotide
acacgtcgatacattaaatcctcccagccttgct

SEQ ID NO: 16189 - DNA, 36 bp, Artificial Sequence
  Synthetic oligonucleotide
gcgccgtacgctgagctcgctatatggcccttcaca

SEQ ID NO: 16190 - DNA, 36 bp, Artificial Sequence
  Synthetic oligonucleotide
gttcaccaccacacccgcctcgtaaaactgcgtcca

SEQ ID NO: 16191 - DNA, 35 bp, Artificial Sequence
  Synthetic oligonucleotide
tcccttcccgcctttgagttctggcatccttccta

SEQ ID NO: 16192 - DNA, 35 bp, Artificial Sequence
  Synthetic oligonucleotide
tcacccttgcccaactgatccgaagccgcctcaac

SEQ ID NO: 16193 - DNA, 35 bp, Artificial Sequence
  Synthetic oligonucleotide
gatgggcttcggtcttgtcaattcacctcccctcc

SEQ ID NO: 16194 - DNA, 36 bp, Artificial Sequence
  Synthetic oligonucleotide
tcaatgtgtgcatggtgtgggggggtgtgctgcgaa

SEQ ID NO: 16195 - DNA, 35 bp, Artificial Sequence
  Synthetic oligonucleotide
tcacaatgctgacttttcccacggtccatggttcc

SEQ ID NO: 16196 - DNA, 35 bp, Artificial Sequence
  Synthetic oligonucleotide
atgcccgaccccattatcttaacgatccttctgcg

SEQ ID NO: 16197 - DNA, 35 bp, Artificial Sequence
  Synthetic oligonucleotide
tcccacccccctagaaccccgcgtacgttcaatcg

SEQ ID NO: 16198 - DNA, 35 bp, Artificial Sequence
  Synthetic oligonucleotide
gatgccgtccaactcctcagcgtgccttccccgtg

SEQ ID NO: 16199 - DNA, 36 bp, Artificial Sequence
  Synthetic oligonucleotide
gatagccccctgcctaacaacgcttactgtccccca

SEQ ID NO: 16200 - DNA, 37 bp, Artificial Sequence
  Synthetic oligonucleotide
gagagaggggtgtaggagcggtgacacagggagacga

SEQ ID NO: 16201 - DNA, 36 bp, Artificial Sequence
  Synthetic oligonucleotide
acattcgcgtagaatctactaccttgcctgcttcta

SEQ ID NO: 16202 - DNA, 35 bp, Artificial Sequence
  Synthetic oligonucleotide
tgatcaaccgatttgacctccgcccctccggtacg

SEQ ID NO: 16203 - DNA, 35 bp, Artificial Sequence
  Synthetic oligonucleotide
acccaatgcccctgtagtcaccccttggtaaatct

SEQ ID NO: 16204 - DNA, 35 bp, Artificial Sequence
  Synthetic oligonucleotide
actcccccaatgctttttacaggcgacttccccga

SEQ ID NO: 16205 - DNA, 38 bp, Artificial Sequence
  Synthetic oligonucleotide
gacactcagcacatcagactatcgcgccctcccactga

SEQ ID NO: 16206 - DNA, 36 bp, Artificial Sequence
  Synthetic oligonucleotide
agagggcaatggggcgggaatagggggtgaagttta

SEQ ID NO: 16207 - DNA, 35 bp, Artificial Sequence
  Synthetic oligonucleotide
gtgacacgtcaacaatcaatgcagcccctgggtcc

SEQ ID NO: 16208 - DNA, 35 bp, Artificial Sequence
  Synthetic oligonucleotide
ttgcatgcccagtcgcattttcttctttatgattc

SEQ ID NO: 16209 - DNA, 35 bp, Artificial Sequence
  Synthetic oligonucleotide
actagtccacgatcgtctcacgcacacaattattc

SEQ ID NO: 16210 - DNA, 35 bp, Artificial Sequence
  Synthetic oligonucleotide
gcacgcaggagaaattaaaggtgggtgagcaatgg

SEQ ID NO: 16211 - DNA, 35 bp, Artificial Sequence
  Synthetic oligonucleotide
gtactcgccgggccaacatattaaaccatgcactt

SEQ ID NO: 16212 - DNA, 35 bp, Artificial Sequence
  Synthetic oligonucleotide
aaccccgccctcctacatttgtagaaattcgttta

SEQ ID NO: 16213 - DNA, 35 bp, Artificial Sequence
  Synthetic oligonucleotide
tcccccacgctggcctagtacgaaatagtctacct

SEQ ID NO: 16214 - DNA, 35 bp, Artificial Sequence
  Synthetic oligonucleotide
gcaagcccccctggcgtatctactaatacttatct

SEQ ID NO: 16215 - DNA, 35 bp, Artificial Sequence
  Synthetic oligonucleotide
tgcctagccgcccacatctgccatcgctccccaca

SEQ ID NO: 16216 - DNA, 36 bp, Artificial Sequence
  Synthetic oligonucleotide
agtgacggtagcctatatctgcacatttgccctcca

SEQ ID NO: 16217 - DNA, 36 bp, Artificial Sequence
  Synthetic oligonucleotide
tggtcagggggtgggcggtgaaggggggagagggca

SEQ ID NO: 16218 - DNA, 35 bp, Artificial Sequence
  Synthetic oligonucleotide
aaacgggcggtgggatggggcacctgggaggggaa

SEQ ID NO: 16219 - DNA, 35 bp, Artificial Sequence
  Synthetic oligonucleotide
gtgcggtccaggagatattatttgggggtgggcga

SEQ ID NO: 16220 - DNA, 36 bp, Artificial Sequence
  Synthetic oligonucleotide
tttcgtcgcctgctttgcctaatattgctcctcgta

SEQ ID NO: 16221 - DNA, 35 bp, Artificial Sequence
  Synthetic oligonucleotide
tgcaagctcccgtcgccctcgtgccttttgtgaac

SEQ ID NO: 16222 - DNA, 35 bp, Artificial Sequence
  Synthetic oligonucleotide
gacgagtctgagcgatcaccttcccgcctctcaat

SEQ ID NO: 16223 - DNA, 35 bp, Artificial Sequence
  Synthetic oligonucleotide
gatccaccgcactactgaaccctaaccagtcacct

SEQ ID NO: 16224 - DNA, 36 bp, Artificial Sequence
  Synthetic oligonucleotide
aacctgcctcttgagcagcccacttcctcccgtaca

SEQ ID NO: 16225 - DNA, 35 bp, Artificial Sequence
  Synthetic oligonucleotide
gattgctaaccgacccacttttacgcggaccacgc

SEQ ID NO: 16226 - DNA, 35 bp, Artificial Sequence
  Synthetic oligonucleotide
aacgtccaacgcaccctcccccttgagcccaaaag

SEQ ID NO: 16227 - DNA, 36 bp, Artificial Sequence
  Synthetic oligonucleotide
gaacacgacgttctactggtcctaatcgcctgccaa

SEQ ID NO: 16228 - DNA, 35 bp, Artificial Sequence
  Synthetic oligonucleotide
tcatccacttcggaccccgacatcgagtacttcca

SEQ ID NO: 16229 - DNA, 35 bp, Artificial Sequence
  Synthetic oligonucleotide
tcgcactacgcctgctattgcttgtatcaccttca

SEQ ID NO: 16230 - DNA, 34 bp, Artificial Sequence
  Synthetic oligonucleotide
tgtacttcctgccttgtccccattcctgtggtcc

SEQ ID NO: 16231 - DNA, 35 bp, Artificial Sequence
  Synthetic oligonucleotide
gatcggttgaccgctgtcttctgcccatttgctgc

SEQ ID NO: 16232 - DNA, 35 bp, Artificial Sequence
  Synthetic oligonucleotide
tacgtacgacgcactttgtttccactcactgattt

SEQ ID NO: 16233 - DNA, 35 bp, Artificial Sequence
  Synthetic oligonucleotide
gaccacctggctttggagtgtgatccaccattttt

SEQ ID NO: 16234 - DNA, 37 bp, Artificial Sequence
  Synthetic oligonucleotide
gtgcactccgtcgactccacccttccgctttcgatga

SEQ ID NO: 16235 - DNA, 36 bp, Artificial Sequence
  Synthetic oligonucleotide
gatacacccctgtgttcgatcagacccctgtttcta

SEQ ID NO: 16236 - DNA, 35 bp, Artificial Sequence
  Synthetic oligonucleotide
tagcctgccttccccgctcgaggactttgactcac

SEQ ID NO: 16237 - DNA, 35 bp, Artificial Sequence
  Synthetic oligonucleotide
tgtgatgttgtcgccccctgcctcggattctcacg

SEQ ID NO: 16238 - DNA, 35 bp, Artificial Sequence
  Synthetic oligonucleotide
acctgccacaccgaaatgctgcccttcgatgaatc

SEQ ID NO: 16239 - DNA, 35 bp, Artificial Sequence
  Synthetic oligonucleotide
gtgtagccgcatttcatttacccgagccgttcatc

SEQ ID NO: 16240 - DNA, 36 bp, Artificial Sequence
  Synthetic oligonucleotide
tccgacgtgcttcactgtccttacttctgtcaaaaa

SEQ ID NO: 16241 - DNA, 38 bp, Artificial Sequence
  Synthetic oligonucleotide
gacgtccccacgagctctcttcgaacaattcacactga

SEQ ID NO: 16242 - DNA, 35 bp, Artificial Sequence
  Synthetic oligonucleotide
gcgaaagctcggactacctaatctgcacgcctctt

SEQ ID NO: 16243 - DNA, 35 bp, Artificial Sequence
  Synthetic oligonucleotide
gctccccctcatatccgtcgccttcgcgcattgtt

SEQ ID NO: 16244 - DNA, 35 bp, Artificial Sequence
  Synthetic oligonucleotide
tctggccccaatcgctcgtaagcccccattccttt

SEQ ID NO: 16245 - DNA, 36 bp, Artificial Sequence
  Synthetic oligonucleotide
ggacatgcaggccctctgtttccgatcacctctcaa

SEQ ID NO: 16246 - DNA, 36 bp, Artificial Sequence
  Synthetic oligonucleotide
atgcacgcgcacatctcgcggaacctccacccgtaa

SEQ ID NO: 16247 - DNA, 36 bp, Artificial Sequence
  Synthetic oligonucleotide
tccagatcagcgcacactctgaactcgaccccatga

SEQ ID NO: 16248 - DNA, 35 bp, Artificial Sequence
  Synthetic oligonucleotide
aacttcagtccttggactgccgcttaatgcccccc

SEQ ID NO: 16249 - DNA, 36 bp, Artificial Sequence
  Synthetic oligonucleotide
catcgacgaagtgccacctcctatgtcatcccctgg

SEQ ID NO: 16250 - DNA, 35 bp, Artificial Sequence
  Synthetic oligonucleotide
ttcacggttgaggagggaacggaggacaatagctg

SEQ ID NO: 16251 - DNA, 35 bp, Artificial Sequence
  Synthetic oligonucleotide
ttacgcctcccactactccagccacgtgttggcaa

SEQ ID NO: 16252 - DNA, 35 bp, Artificial Sequence
  Synthetic oligonucleotide
tgctgcccgttgtccactatcgatactatgcccca

SEQ ID NO: 16253 - DNA, 38 bp, Artificial Sequence
  Synthetic oligonucleotide
aacgctgacccacgctgtacaaaagctctcctccttga

SEQ ID NO: 16254 - DNA, 37 bp, Artificial Sequence
  Synthetic oligonucleotide
tgcacacctcggggcctaatctctctgtttcctttga

SEQ ID NO: 16255 - DNA, 36 bp, Artificial Sequence
  Synthetic oligonucleotide
tcccaactgcacacggtttcgccattcgagctccaa

SEQ ID NO: 16256 - DNA, 35 bp, Artificial Sequence
  Synthetic oligonucleotide
gaccgatgccctctctttgccttaactcgcccaca

SEQ ID NO: 16257 - DNA, 36 bp, Artificial Sequence
  Synthetic oligonucleotide
gtcgctgctgcacacgtcgcctcaccaaccttctca

SEQ ID NO: 16258 - DNA, 37 bp, Artificial Sequence
  Synthetic oligonucleotide
cactgcgccttcacctcccgtacgtatctgtggcaga

SEQ ID NO: 16259 - DNA, 37 bp, Artificial Sequence
  Synthetic oligonucleotide
accgtacgacgcccgccccccgttcggatttttccga

SEQ ID NO: 16260 - DNA, 35 bp, Artificial Sequence
  Synthetic oligonucleotide
atgtgatcggcccaactgcgataccaacacccata

SEQ ID NO: 16261 - DNA, 35 bp, Artificial Sequence
  Synthetic oligonucleotide
tgccgaacacaaccatagcacctacctacggtagc

SEQ ID NO: 16262 - DNA, 36 bp, Artificial Sequence
  Synthetic oligonucleotide
gagactcgagggggttgcgtggaaagcggaggggca

SEQ ID NO: 16263 - DNA, 35 bp, Artificial Sequence
  Synthetic oligonucleotide
gtcgacagacgctttgcccattgaaacgaccctcc

SEQ ID NO: 16264 - DNA, 33 bp, Artificial Sequence
  Synthetic oligonucleotide
gcctccaatggcacattactgaaaaccatgctc

SEQ ID NO: 16265 - DNA, 38 bp, Artificial Sequence
  Synthetic oligonucleotide
tcccagtcgctgacacatcaaacccgtctccacgctga

SEQ ID NO: 16266 - DNA, 35 bp, Artificial Sequence
  Synthetic oligonucleotide
tacacctgcgcacacgcgtgctactcaatccatac

SEQ ID NO: 16267 - DNA, 35 bp, Artificial Sequence
  Synthetic oligonucleotide
atcatccccgtcgcccgggagtgttcttcataatc

SEQ ID NO: 16268 - DNA, 35 bp, Artificial Sequence
  Synthetic oligonucleotide
tatcgagccgtcgccattttgattcgcgtaatttc

SEQ ID NO: 16269 - DNA, 35 bp, Artificial Sequence
  Synthetic oligonucleotide
tatccgcccagattccaagcccctgcccatacacg

SEQ ID NO: 16270 - DNA, 36 bp, Artificial Sequence
  Synthetic oligonucleotide
atcccctgcccagccttttaagctatgtcggcccca

SEQ ID NO: 16271 - DNA, 36 bp, Artificial Sequence
  Synthetic oligonucleotide
tcacgctgcatcacggttctcatggatccatcctca

SEQ ID NO: 16272 - DNA, 36 bp, Artificial Sequence
  Synthetic oligonucleotide
gtttggagcagaaaaggtggcgggtgtgacggggga

SEQ ID NO: 16273 - DNA, 38 bp, Artificial Sequence
  Synthetic oligonucleotide
tcacgatgggggagggaggggatgaaccgttgtggtga

SEQ ID NO: 16274 - DNA, 35 bp, Artificial Sequence
  Synthetic oligonucleotide
aactccacgaggtcgccgtgattccttgaccctcc

SEQ ID NO: 16275 - DNA, 35 bp, Artificial Sequence
  Synthetic oligonucleotide
tctgcctcctgccctgtctctgacgtatgtctcgc

SEQ ID NO: 16276 - DNA, 35 bp, Artificial Sequence
  Synthetic oligonucleotide
accctgtcactgagtgcacactcacaattccactt

SEQ ID NO: 16277 - DNA, 36 bp, Artificial Sequence
  Synthetic oligonucleotide
tgaagcgctcatttcctgccaatgcaacatcttaca

SEQ ID NO: 16278 - DNA, 36 bp, Artificial Sequence
  Synthetic oligonucleotide
gttccagccctcggttttacctcactatgcgaagca

SEQ ID NO: 16279 - DNA, 35 bp, Artificial Sequence
  Synthetic oligonucleotide
tgccccacgaccccgtaattcccaggttcatccga

SEQ ID NO: 16280 - DNA, 38 bp, Artificial Sequence
  Synthetic oligonucleotide
gtcgggcccgggacgggagggggaggggaacgtagtga

SEQ ID NO: 16281 - DNA, 35 bp, Artificial Sequence
  Synthetic oligonucleotide
gtctcgctcccccattgctaatcgctatcgtacgc

SEQ ID NO: 16282 - DNA, 36 bp, Artificial Sequence
  Synthetic oligonucleotide
gtagggaggggaagaagccgatggaggttggtgtta

SEQ ID NO: 16283 - DNA, 35 bp, Artificial Sequence
  Synthetic oligonucleotide
ggttcccgccgcacccgaccgactttccatgctag

SEQ ID NO: 16284 - DNA, 31 bp, Artificial Sequence
  Synthetic oligonucleotide
tcatcctacaatccccccctgccattccgga

SEQ ID NO: 16285 - DNA, 35 bp, Artificial Sequence
  Synthetic oligonucleotide
tcacatacgcccgtttgatcttctcacagtcgacg

SEQ ID NO: 16286 - DNA, 35 bp, Artificial Sequence
  Synthetic oligonucleotide
tatacccattcgccgttgcagcccccacctgctct

SEQ ID NO: 16287 - DNA, 35 bp, Artificial Sequence
  Synthetic oligonucleotide
tcccacgccccccggctccgctaagactatactgt

SEQ ID NO: 16288 - DNA, 36 bp, Artificial Sequence
  Synthetic oligonucleotide
aggtcaccgcacgctggtcctgcccacctacaatca

SEQ ID NO: 16289 - DNA, 37 bp, Artificial Sequence
  Synthetic oligonucleotide
atggtggggagtggggtgcttcggggtgcttgtggga

SEQ ID NO: 16290 - DNA, 36 bp, Artificial Sequence
  Synthetic oligonucleotide
tcatcaccattccaaagcacgagccccttttgcgta

SEQ ID NO: 16291 - DNA, 35 bp, Artificial Sequence
  Synthetic oligonucleotide
gccacccttggcctccacagtacgattagtcttac

SEQ ID NO: 16292 - DNA, 35 bp, Artificial Sequence
  Synthetic oligonucleotide
gcctacgcccaattaactgcccgggtctagtcccc

SEQ ID NO: 16293 - DNA, 35 bp, Artificial Sequence
  Synthetic oligonucleotide
accgcacacgccccgttcaaatcgcctgaaacacg

SEQ ID NO: 16294 - DNA, 37 bp, Artificial Sequence
  Synthetic oligonucleotide
gaccagctcaaactcttgtccatcgtggctcctccga

SEQ ID NO: 16295 - DNA, 35 bp, Artificial Sequence
  Synthetic oligonucleotide
tcaccgctttagactactacctaggcacacccccc

SEQ ID NO: 16296 - DNA, 35 bp, Artificial Sequence
  Synthetic oligonucleotide
acaccccgatcattatcgccatcgctttcttatgc

SEQ ID NO: 16297 - DNA, 35 bp, Artificial Sequence
  Synthetic oligonucleotide
gtccctcctggcacaccagacgcttccgaaccttc

SEQ ID NO: 16298 - DNA, 35 bp, Artificial Sequence
  Synthetic oligonucleotide
gactcgcacccattttgttccgtaataggatcttc

SEQ ID NO: 16299 - DNA, 35 bp, Artificial Sequence
  Synthetic oligonucleotide
gacctggagtcgggtgggacgggggggaggcgagg

SEQ ID NO: 16300 - DNA, 35 bp, Artificial Sequence
  Synthetic oligonucleotide
tccaggtatctgccccgtatcgtcctccacactgg

SEQ ID NO: 16301 - DNA, 36 bp, Artificial Sequence
  Synthetic oligonucleotide
catacgcctccagcactttgataggccttcccacta

SEQ ID NO: 16302 - DNA, 35 bp, Artificial Sequence
  Synthetic oligonucleotide
tcccgagcagcattgccgtacgcaccaccgccagc

SEQ ID NO: 16303 - DNA, 35 bp, Artificial Sequence
  Synthetic oligonucleotide
atccacatccgagcgcgtatcttagcatttcttgt

SEQ ID NO: 16304 - DNA, 36 bp, Artificial Sequence
  Synthetic oligonucleotide
aaagcagggtgagggtggggcgggggctaatgctta

SEQ ID NO: 16305 - DNA, 35 bp, Artificial Sequence
  Synthetic oligonucleotide
atgttgctggccactagtatctttaaagtcctccc

SEQ ID NO: 16306 - DNA, 35 bp, Artificial Sequence
  Synthetic oligonucleotide
gttgggcccgctctccccgttctagcttacctttt

SEQ ID NO: 16307 - DNA, 35 bp, Artificial Sequence
  Synthetic oligonucleotide
gcactccccacgggtatatgcacccctactacaca

SEQ ID NO: 16308 - DNA, 38 bp, Artificial Sequence
  Synthetic oligonucleotide
gtcccacccccactcctgacgctgccttccgccgatga

SEQ ID NO: 16309 - DNA, 38 bp, Artificial Sequence
  Synthetic oligonucleotide
agaccccccgaacgtatggctcattgtaccgatcttga

SEQ ID NO: 16310 - DNA, 36 bp, Artificial Sequence
  Synthetic oligonucleotide
tgacacccttctatctcccggtaatagcattggcta

SEQ ID NO: 16311 - DNA, 35 bp, Artificial Sequence
  Synthetic oligonucleotide
gtctgcctaccgaggctaaatcgttcccgaccccc

SEQ ID NO: 16312 - DNA, 35 bp, Artificial Sequence
  Synthetic oligonucleotide
acaatccaactacacactccagccaccggcgacgc

SEQ ID NO: 16313 - DNA, 35 bp, Artificial Sequence
  Synthetic oligonucleotide
ggtcgtacgccctcactaccccctagaccaattgt

SEQ ID NO: 16314 - DNA, 38 bp, Artificial Sequence
  Synthetic oligonucleotide
gaatgccgcctcaaccaacaacgccgactgtccactga

SEQ ID NO: 16315 - DNA, 38 bp, Artificial Sequence
  Synthetic oligonucleotide
tcacccacccgtcctccaccctcagctaggtcttctga

SEQ ID NO: 16316 - DNA, 35 bp, Artificial Sequence
  Synthetic oligonucleotide
tgaactcaacccgcatactcagccctagggagggc

SEQ ID NO: 16317 - DNA, 35 bp, Artificial Sequence
  Synthetic oligonucleotide
gcatagctcgctcagttaccttcctaccgcctcat

SEQ ID NO: 16318 - DNA, 35 bp, Artificial Sequence
  Synthetic oligonucleotide
tcaacttgcgccattcgtttcccgggccttgcgat

SEQ ID NO: 16319 - DNA, 35 bp, Artificial Sequence
  Synthetic oligonucleotide
atccgctgttcccgttggctggctcgcttcccttt

SEQ ID NO: 16320 - DNA, 37 bp, Artificial Sequence
  Synthetic oligonucleotide
ttggtcccaacccttcaatcgtttctcgtcgtgacga

SEQ ID NO: 16321 - DNA, 35 bp, Artificial Sequence
  Synthetic oligonucleotide
atcccgtttgctgttcgagtttgccaccatcgtcc

SEQ ID NO: 16322 - DNA, 35 bp, Artificial Sequence
  Synthetic oligonucleotide
aaccgacgccttgcatgactcaaaacatttattgc

SEQ ID NO: 16323 - DNA, 36 bp, Artificial Sequence
  Synthetic oligonucleotide
tgagcgtgccacggactatcgcgctgctttcttcct

SEQ ID NO: 16324 - DNA, 35 bp, Artificial Sequence
  Synthetic oligonucleotide
tccaccgtcgggccggctcgacccttgaccaactt

SEQ ID NO: 16325 - DNA, 37 bp, Artificial Sequence
  Synthetic oligonucleotide
ttgccacctcactaatctgtccgcctttaccttgaga

SEQ ID NO: 16326 - DNA, 38 bp, Artificial Sequence
  Synthetic oligonucleotide
tttaacaggacggggggggagggactaatggggactga

SEQ ID NO: 16327 - DNA, 37 bp, Artificial Sequence
  Synthetic oligonucleotide
tggtgccccacggtaacttccctgtacatatccctga

SEQ ID NO: 16328 - DNA, 37 bp, Artificial Sequence
  Synthetic oligonucleotide
gctatggcctgggctggtttgcacttactctcaccga

SEQ ID NO: 16329 - DNA, 37 bp, Artificial Sequence
  Synthetic oligonucleotide
gaccgcctacgtacatcatctcgctgcatccgctcga

SEQ ID NO: 16330 - DNA, 37 bp, Artificial Sequence
  Synthetic oligonucleotide
gctccacctcacttcaaccagctgtcgcatctggtga

SEQ ID NO: 16331 - DNA, 35 bp, Artificial Sequence
  Synthetic oligonucleotide
gccatcctgcgtttccctcctttgccgggtttctc

SEQ ID NO: 16332 - DNA, 35 bp, Artificial Sequence
  Synthetic oligonucleotide
tgtcattcgccatgaaccacctctactatgtcgcg

SEQ ID NO: 16333 - DNA, 35 bp, Artificial Sequence
  Synthetic oligonucleotide
tacgaccacgaatctcgctggtggcttaatccact

SEQ ID NO: 16334 - DNA, 35 bp, Artificial Sequence
  Synthetic oligonucleotide
gtgatgcaacggatgtctcgcccttctcacaattt

SEQ ID NO: 16335 - DNA, 36 bp, Artificial Sequence
  Synthetic oligonucleotide
tcaccaaggtgacgctgccctgatcactctcatgta

SEQ ID NO: 16336 - DNA, 35 bp, Artificial Sequence
  Synthetic oligonucleotide
gtggataaagggtgtggtggaagtatgggggtagc

SEQ ID NO: 16337 - DNA, 35 bp, Artificial Sequence
  Synthetic oligonucleotide
tgctcccatccacttcggtttccagccacagcaat

SEQ ID NO: 16338 - DNA, 37 bp, Artificial Sequence
  Synthetic oligonucleotide
gggtgccgacgggaaagggaggggcaagtgttggtga

SEQ ID NO: 16339 - DNA, 38 bp, Artificial Sequence
  Synthetic oligonucleotide
tgatctgcatcctcatctgcctttcaacatcccattga

SEQ ID NO: 16340 - DNA, 35 bp, Artificial Sequence
  Synthetic oligonucleotide
tcccactcctaacgcatagcaactgccttcctgaa

SEQ ID NO: 16341 - DNA, 37 bp, Artificial Sequence
  Synthetic oligonucleotide
gcacgggaaaggggggattgagagggatacgaggtga

SEQ ID NO: 16342 - DNA, 35 bp, Artificial Sequence
  Synthetic oligonucleotide
gacctgaccccgtagcgtacccccctattctctgc

SEQ ID NO: 16343 - DNA, 37 bp, Artificial Sequence
  Synthetic oligonucleotide
gctctaccgccacctatttgctcactgacctgaacga

SEQ ID NO: 16344 - DNA, 37 bp, Artificial Sequence
  Synthetic oligonucleotide
gttcaggaggtggacatgaatgggatgggcgggagga

SEQ ID NO: 16345 - DNA, 38 bp, Artificial Sequence
  Synthetic oligonucleotide
acgtccccaccgccactgattcgcctgtgcaacactga

SEQ ID NO: 16346 - DNA, 38 bp, Artificial Sequence
  Synthetic oligonucleotide
tgccatcaaccataaccgcatcgtgcactgtctcttga

SEQ ID NO: 16347 - DNA, 35 bp, Artificial Sequence
  Synthetic oligonucleotide
tcttcccccgatgctggtcatacgggcactcgacc

SEQ ID NO: 16348 - DNA, 35 bp, Artificial Sequence
  Synthetic oligonucleotide
gcaacacgtttgttcgtaccacgggtcctatcgct

SEQ ID NO: 16349 - DNA, 35 bp, Artificial Sequence
  Synthetic oligonucleotide
gaaaagccatcccaacgccattgccctgctgatct

SEQ ID NO: 16350 - DNA, 36 bp, Artificial Sequence
  Synthetic oligonucleotide
gaggacgaaccgaactggcagaaaaggagggggtaa

SEQ ID NO: 16351 - DNA, 37 bp, Artificial Sequence
  Synthetic oligonucleotide
tgaacgcccgtgccgctcactcactttcttgtaccga

SEQ ID NO: 16352 - DNA, 37 bp, Artificial Sequence
  Synthetic oligonucleotide
gtcaatcgcggggagggagataaatcaggggagggga

SEQ ID NO: 16353 - DNA, 37 bp, Artificial Sequence
  Synthetic oligonucleotide
atggatggacgggtagggaaggtagctggggctatga

SEQ ID NO: 16354 - DNA, 35 bp, Artificial Sequence
  Synthetic oligonucleotide
gcatgtgccgatcaaacttttgtaaccacgctaac

SEQ ID NO: 16355 - DNA, 35 bp, Artificial Sequence
  Synthetic oligonucleotide
atctccgcctgctcccgttctcacctaagcctgtg

SEQ ID NO: 16356 - DNA, 38 bp, Artificial Sequence
  Synthetic oligonucleotide
tacatgcctcattcgcccatgcttaccagttttagtga

SEQ ID NO: 16357 - DNA, 35 bp, Artificial Sequence
  Synthetic oligonucleotide
acgccccagctctgttcaccacagctctttaccta

SEQ ID NO: 16358 - DNA, 35 bp, Artificial Sequence
  Synthetic oligonucleotide
acacacctctttcccgtcccatctctgtaaagcgc

SEQ ID NO: 16359 - DNA, 35 bp, Artificial Sequence
  Synthetic oligonucleotide
aactgcgaacgccatcccctgactattgacccggc

SEQ ID NO: 16360 - DNA, 35 bp, Artificial Sequence
  Synthetic oligonucleotide
gtttcactcgcattccccttttgtaccatctgtgc

SEQ ID NO: 16361 - DNA, 36 bp, Artificial Sequence
  Synthetic oligonucleotide
gtgacgcacctcttgtccttgacgactgactactaa

SEQ ID NO: 16362 - DNA, 35 bp, Artificial Sequence
  Synthetic oligonucleotide
ttgctatcccgcccccgtgttcttcgtgtcacgac

SEQ ID NO: 16363 - DNA, 35 bp, Artificial Sequence
  Synthetic oligonucleotide
tcaccgctcgcacctgcaactaacgccggaggccc

SEQ ID NO: 16364 - DNA, 35 bp, Artificial Sequence
  Synthetic oligonucleotide
accgccaccattgggggtttttgcactcctaaatc

SEQ ID NO: 16365 - DNA, 35 bp, Artificial Sequence
  Synthetic oligonucleotide
gagaggacgagaggaccaaggcaagagggaaatgt

SEQ ID NO: 16366 - DNA, 35 bp, Artificial Sequence
  Synthetic oligonucleotide
acagtagccgtccaccgtacattccttgctcgcca

SEQ ID NO: 16367 - DNA, 36 bp, Artificial Sequence
  Synthetic oligonucleotide
tgttgcgtaccagatcctcatttaccgcaccgtcca

SEQ ID NO: 16368 - DNA, 38 bp, Artificial Sequence
  Synthetic oligonucleotide
gctgccccatccatccaactagcagcgttctacactga

SEQ ID NO: 16369 - DNA, 37 bp, Artificial Sequence
  Synthetic oligonucleotide
actgccacatggtgatttaatatgctcccgcccttga

SEQ ID NO: 16370 - DNA, 35 bp, Artificial Sequence
  Synthetic oligonucleotide
taccgaaaagggtggccgggaaactggtgggtacg

SEQ ID NO: 16371 - DNA, 35 bp, Artificial Sequence
  Synthetic oligonucleotide
gcctgcctcacacctccactacgttggtcgggttt

SEQ ID NO: 16372 - DNA, 37 bp, Artificial Sequence
  Synthetic oligonucleotide
gcaccaattgacatctctgcaccacctcgtttaacga

SEQ ID NO: 16373 - DNA, 37 bp, Artificial Sequence
  Synthetic oligonucleotide
ttgggaagggagtacggtggggtccaggacgaaggga

SEQ ID NO: 16374 - DNA, 35 bp, Artificial Sequence
  Synthetic oligonucleotide
tgcgaatcacctcagatgttgtccatattacccgc

SEQ ID NO: 16375 - DNA, 35 bp, Artificial Sequence
  Synthetic oligonucleotide
taccaaccgcaggcccctttatcgtcttatcaggc

SEQ ID NO: 16376 - DNA, 35 bp, Artificial Sequence
  Synthetic oligonucleotide
atgcacccaatccaccattgcgataggtctctttc

SEQ ID NO: 16377 - DNA, 35 bp, Artificial Sequence
  Synthetic oligonucleotide
agtaccaccctcacatattgtcacgtagccccacg

SEQ ID NO: 16378 - DNA, 36 bp, Artificial Sequence
  Synthetic oligonucleotide
accaaccacacggttcatgctctaagttacctatca

SEQ ID NO: 16379 - DNA, 36 bp, Artificial Sequence
  Synthetic oligonucleotide
ttcacccgcctattccatatcccatcaggtccatga

SEQ ID NO: 16380 - DNA, 35 bp, Artificial Sequence
  Synthetic oligonucleotide
ggagaactcccgacacccgccttgatcgtaacctt

SEQ ID NO: 16381 - DNA, 36 bp, Artificial Sequence
  Synthetic oligonucleotide
aacccctcaccgctgtatcacgctctgcctccctca

SEQ ID NO: 16382 - DNA, 36 bp, Artificial Sequence
  Synthetic oligonucleotide
ggtgggggaggattcgggcgggacctgggtatggta

SEQ ID NO: 16383 - DNA, 35 bp, Artificial Sequence
  Synthetic oligonucleotide
tccccatgtaggcatacgaatccggcctcccacac

SEQ ID NO: 16384 - DNA, 37 bp, Artificial Sequence
  Synthetic oligonucleotide
gcacaccctgctactgccgtttccaagattactctga

SEQ ID NO: 16385 - DNA, 38 bp, Artificial Sequence
  Synthetic oligonucleotide
gtcacatcacccgttcccagtggcagtctttctagtga

SEQ ID NO: 16386 - DNA, 36 bp, Artificial Sequence
  Synthetic oligonucleotide
actcctacgtgctgtagtcgtccgcccctccccgta

SEQ ID NO: 16387 - DNA, 35 bp, Artificial Sequence
  Synthetic oligonucleotide
tagcctgagcccttgttttgtcctttggctcgttc

SEQ ID NO: 16388 - DNA, 35 bp, Artificial Sequence
  Synthetic oligonucleotide
tgtacagcccctgcctgcctgcccggatacatgcg

SEQ ID NO: 16389 - DNA, 35 bp, Artificial Sequence
  Synthetic oligonucleotide
gccacagtaggcatcattgcaccgctccacctcat

SEQ ID NO: 16390 - DNA, 35 bp, Artificial Sequence
  Synthetic oligonucleotide
atcgtgaaccggtcgaaccttcatggtacctctct

SEQ ID NO: 16391 - DNA, 37 bp, Artificial Sequence
  Synthetic oligonucleotide
ttctacgccaattttacgcacccactgcccgctggta

SEQ ID NO: 16392 - DNA, 35 bp, Artificial Sequence
  Synthetic oligonucleotide
tagttcctcccgagtgatttctctgcacacctgcc

SEQ ID NO: 16393 - DNA, 35 bp, Artificial Sequence
  Synthetic oligonucleotide
tcctccggagcccatcatcgcccatcttcatgttc

SEQ ID NO: 16394 - DNA, 35 bp, Artificial Sequence
  Synthetic oligonucleotide
aacgctccacatgcccccgttattgcgcaccaaat

SEQ ID NO: 16395 - DNA, 35 bp, Artificial Sequence
  Synthetic oligonucleotide
tggagtccgcatctccgtccccccctgttcgtgat

SEQ ID NO: 16396 - DNA, 35 bp, Artificial Sequence
  Synthetic oligonucleotide
atgggcacctaccctttgttcgacttcgctcccaa

SEQ ID NO: 16397 - DNA, 37 bp, Artificial Sequence
  Synthetic oligonucleotide
gccgacgcccttggctatctcgtaatcggttcaccga

SEQ ID NO: 16398 - DNA, 37 bp, Artificial Sequence
  Synthetic oligonucleotide
taacactgccgggttgggaaagggggtggagctatga

SEQ ID NO: 16399 - DNA, 38 bp, Artificial Sequence
  Synthetic oligonucleotide
gactaaccgtatgttcctccctgacccacctggcgtga

SEQ ID NO: 16400 - DNA, 38 bp, Artificial Sequence
  Synthetic oligonucleotide
tcccccccgcatgacgttttgtttcaattgcttgttga

SEQ ID NO: 16401 - DNA, 35 bp, Artificial Sequence
  Synthetic oligonucleotide
atccacgggctattggacaattgcttgtgtcccac

SEQ ID NO: 16402 - DNA, 35 bp, Artificial Sequence
  Synthetic oligonucleotide
aatccgggcccgcatcgcgaatctcaccatgcctc

SEQ ID NO: 16403 - DNA, 35 bp, Artificial Sequence
  Synthetic oligonucleotide
acatccggcatcgactcgccccacaccctccagaa

SEQ ID NO: 16404 - DNA, 38 bp, Artificial Sequence
  Synthetic oligonucleotide
aagatcgactgggtgggggggagcgggacccatattga

SEQ ID NO: 16405 - DNA, 35 bp, Artificial Sequence
  Synthetic oligonucleotide
tagtggcctcggttcccaagtcgctaacatctacc

SEQ ID NO: 16406 - DNA, 35 bp, Artificial Sequence
  Synthetic oligonucleotide
tgttggactccgcacatgcctcctggaggtctccc

SEQ ID NO: 16407 - DNA, 35 bp, Artificial Sequence
  Synthetic oligonucleotide
tgctatctgcctaacctctccaaccacgggtgtac

SEQ ID NO: 16408 - DNA, 35 bp, Artificial Sequence
  Synthetic oligonucleotide
gaccccaactgggcgctataccgatagctaacatc

SEQ ID NO: 16409 - DNA, 35 bp, Artificial Sequence
  Synthetic oligonucleotide
taataggcccgctcgccctcccttgcaacttccgt

SEQ ID NO: 16410 - DNA, 35 bp, Artificial Sequence
  Synthetic oligonucleotide
gtcgcctcccaccgatcgatccgggtacagcctaa

SEQ ID NO: 16411 - DNA, 38 bp, Artificial Sequence
  Synthetic oligonucleotide
atcaccgccggggggtccatgcactgcctataacctga

SEQ ID NO: 16412 - DNA, 38 bp, Artificial Sequence
  Synthetic oligonucleotide
aactgagaacacgtggggggaaaggtggacgcaagtga

SEQ ID NO: 16413 - DNA, 36 bp, Artificial Sequence
  Synthetic oligonucleotide
gtcatcggagaggggagggggttttggactgagcga

SEQ ID NO: 16414 - DNA, 36 bp, Artificial Sequence
  Synthetic oligonucleotide
tcagaggccacaacccgactactaccctcccccgga

SEQ ID NO: 16415 - DNA, 38 bp, Artificial Sequence
  Synthetic oligonucleotide
gaacatggcaaaagtcgggaggcatgggtggggtatga

SEQ ID NO: 16416 - DNA, 35 bp, Artificial Sequence
  Synthetic oligonucleotide
gaccgttacatcaggcatcctgggcaaaaacaacc

SEQ ID NO: 16417 - DNA, 35 bp, Artificial Sequence
  Synthetic oligonucleotide
acacgaagcgcttcccccatgccgtcactctgctc

SEQ ID NO: 16418 - DNA, 35 bp, Artificial Sequence
  Synthetic oligonucleotide
gttacacctccgccgttgccgcgctccgactcgcg

SEQ ID NO: 16419 - DNA, 35 bp, Artificial Sequence
  Synthetic oligonucleotide
ttgtaggcaaggatatggagggaagggatggggcg

SEQ ID NO: 16420 - DNA, 36 bp, Artificial Sequence
  Synthetic oligonucleotide
tgtaacccccaaccgcctcatctggtcttccgacaa

SEQ ID NO: 16421 - DNA, 35 bp, Artificial Sequence
  Synthetic oligonucleotide
atgacccacgtcgggatctctccagccaacctctg

SEQ ID NO: 16422 - DNA, 35 bp, Artificial Sequence
  Synthetic oligonucleotide
tgtcgtcgtccgcccgttaacttacttccctcttt

SEQ ID NO: 16423 - DNA, 35 bp, Artificial Sequence
  Synthetic oligonucleotide
tttgcccaacacatcgattctacttatgacgccaa

SEQ ID NO: 16424 - DNA, 36 bp, Artificial Sequence
  Synthetic oligonucleotide
aagacagcattagggcgggggaaggggtcgtgggaa

SEQ ID NO: 16425 - DNA, 37 bp, Artificial Sequence
  Synthetic oligonucleotide
gaagagggagtggttgctaagggcgcacggggagaga

SEQ ID NO: 16426 - DNA, 37 bp, Artificial Sequence
  Synthetic oligonucleotide
tgaccggtcacgctgctaacgctttcttctcccctga

SEQ ID NO: 16427 - DNA, 36 bp, Artificial Sequence
  Synthetic oligonucleotide
aaccctggacgccacttttctgggtgccctccttga

SEQ ID NO: 16428 - DNA, 35 bp, Artificial Sequence
  Synthetic oligonucleotide
acctacatgtgccgtgccgcccccgaatatgctac

SEQ ID NO: 16429 - DNA, 35 bp, Artificial Sequence
  Synthetic oligonucleotide
atcggagaagggaggaggaacgagtggggtcaggc

SEQ ID NO: 16430 - DNA, 35 bp, Artificial Sequence
  Synthetic oligonucleotide
gtacctacatccatggaatttctgcctgattacct

SEQ ID NO: 16431 - DNA, 35 bp, Artificial Sequence
  Synthetic oligonucleotide
atctgtagacgccgttgctcttgcccctacctttt

SEQ ID NO: 16432 - DNA, 38 bp, Artificial Sequence
  Synthetic oligonucleotide
gagggaagcagaacacgagagagaggaaggaacactga

SEQ ID NO: 16433 - DNA, 36 bp, Artificial Sequence
  Synthetic oligonucleotide
aacgcgctccgtaccgttggacgcaccatccttcta

SEQ ID NO: 16434 - DNA, 35 bp, Artificial Sequence
  Synthetic oligonucleotide
acccgtagccctcttgtcgttcctcgttttcgacc

SEQ ID NO: 16435 - DNA, 35 bp, Artificial Sequence
  Synthetic oligonucleotide
ggtgccgactgcctgatacctggccgcgattccct

SEQ ID NO: 16436 - DNA, 36 bp, Artificial Sequence
  Synthetic oligonucleotide
gccagacgcactgggcccttatttcgaccgacaaca

SEQ ID NO: 16437 - DNA, 38 bp, Artificial Sequence
  Synthetic oligonucleotide
gcgccctccccatcattgatactccagtccagccctga

SEQ ID NO: 16438 - DNA, 36 bp, Artificial Sequence
  Synthetic oligonucleotide
acgcctccgccctcctcaaaccacgtcagttcctta

SEQ ID NO: 16439 - DNA, 35 bp, Artificial Sequence
  Synthetic oligonucleotide
gcgcgacgcccgtgccagcccgccgctaccttgac

SEQ ID NO: 16440 - DNA, 35 bp, Artificial Sequence
  Synthetic oligonucleotide
agtgagtggtggtactgggtgaacggaggaactgg

SEQ ID NO: 16441 - DNA, 35 bp, Artificial Sequence
  Synthetic oligonucleotide
gagaccccggccaactatctacttcaccgcacaat

SEQ ID NO: 16442 - DNA, 36 bp, Artificial Sequence
  Synthetic oligonucleotide
gcctcgccccccggcctcatcgctatcaatggagca

SEQ ID NO: 16443 - DNA, 35 bp, Artificial Sequence
  Synthetic oligonucleotide
tatgcgcacgacactatatctccatctgcagcacg

SEQ ID NO: 16444 - DNA, 35 bp, Artificial Sequence
  Synthetic oligonucleotide
tcagtagccgttcgtccggtccgtaccattgcgct

SEQ ID NO: 16445 - DNA, 35 bp, Artificial Sequence
  Synthetic oligonucleotide
gccgtctcgtagtctgtcgcccttccgcctgttgt

SEQ ID NO: 16446 - DNA, 35 bp, Artificial Sequence
  Synthetic oligonucleotide
gtgcgccgacccgccttgtggacgttgcatccttt

SEQ ID NO: 16447 - DNA, 36 bp, Artificial Sequence
  Synthetic oligonucleotide
acgcatccctcctgtcatctggccactatatcgcaa

SEQ ID NO: 16448 - DNA, 35 bp, Artificial Sequence
  Synthetic oligonucleotide
gctaaccatgctgccggtcgttaccgtcctcccta

SEQ ID NO: 16449 - DNA, 35 bp, Artificial Sequence
  Synthetic oligonucleotide
agctcaccgacttcactccccagcccgactgcgcc

SEQ ID NO: 16450 - DNA, 35 bp, Artificial Sequence
  Synthetic oligonucleotide
gagttccgaccgaccttccctagatctcttgtgcc

SEQ ID NO: 16451 - DNA, 35 bp, Artificial Sequence
  Synthetic oligonucleotide
attggcccccacgattgcccccagaagcattcctc

SEQ ID NO: 16452 - DNA, 35 bp, Artificial Sequence
  Synthetic oligonucleotide
tcattccgtccttccgtcgtcagccagtccctggg

SEQ ID NO: 16453 - DNA, 36 bp, Artificial Sequence
  Synthetic oligonucleotide
tgaggctggtcccattttattccatgctgcccttca

SEQ ID NO: 16454 - DNA, 38 bp, Artificial Sequence
  Synthetic oligonucleotide
gataccatgcgccaccccctgttctggtcctactgtga

SEQ ID NO: 16455 - DNA, 35 bp, Artificial Sequence
  Synthetic oligonucleotide
ttatcgctcccaggtacatattcagctcttggccc

SEQ ID NO: 16456 - DNA, 35 bp, Artificial Sequence
  Synthetic oligonucleotide
actccacctgccttcgtgtaaatatcatatctacg

SEQ ID NO: 16457 - DNA, 36 bp, Artificial Sequence
  Synthetic oligonucleotide
ttcgaccagccataccttggtttctcgcccaacgaa

SEQ ID NO: 16458 - DNA, 36 bp, Artificial Sequence
  Synthetic oligonucleotide
tgaccccagctgcctcctcagacttcgctactccca

SEQ ID NO: 16459 - DNA, 35 bp, Artificial Sequence
  Synthetic oligonucleotide
aagagaacacagggaggtcaagtgctggtggggga

SEQ ID NO: 16460 - DNA, 38 bp, Artificial Sequence
  Synthetic oligonucleotide
tgtgaaggggggtggctatacaggaaagggtgaactga

SEQ ID NO: 16461 - DNA, 36 bp, Artificial Sequence
  Synthetic oligonucleotide
atggagcgaatcagggaggttgtggggccgggctga

SEQ ID NO: 16462 - DNA, 38 bp, Artificial Sequence
  Synthetic oligonucleotide
acttgcactccccaccaattgcgactccctatcagtga

SEQ ID NO: 16463 - DNA, 35 bp, Artificial Sequence
  Synthetic oligonucleotide
acactacattggtactttacttcagcctttcatac

SEQ ID NO: 16464 - DNA, 35 bp, Artificial Sequence
  Synthetic oligonucleotide
ggtgtccaacccccctgtccacttacgatccggcc

SEQ ID NO: 16465 - DNA, 35 bp, Artificial Sequence
  Synthetic oligonucleotide
gatcgaacctgccctgagccaccaatctcaccttc

SEQ ID NO: 16466 - DNA, 35 bp, Artificial Sequence
  Synthetic oligonucleotide
gtgtgccctccccatctaataaggatttccacttg

SEQ ID NO: 16467 - DNA, 35 bp, Artificial Sequence
  Synthetic oligonucleotide
gcaccaccgtccttctatttcagctccggttgact

SEQ ID NO: 16468 - DNA, 35 bp, Artificial Sequence
  Synthetic oligonucleotide
aacacacgttccatcgtttactcttagttagttct

SEQ ID NO: 16469 - DNA, 36 bp, Artificial Sequence
  Synthetic oligonucleotide
gatttgcgcgccgggcccccatctatacttcgcgaa

SEQ ID NO: 16470 - DNA, 35 bp, Artificial Sequence
  Synthetic oligonucleotide
tcgagggggcggggctggcgcggggtggctcgtaa

SEQ ID NO: 16471 - DNA, 35 bp, Artificial Sequence
  Synthetic oligonucleotide
ggttgccctcctgcctattttctactgtcgatacc

SEQ ID NO: 16472 - DNA, 35 bp, Artificial Sequence
  Synthetic oligonucleotide
tcctatgccaccattgtccgtatccgggtcatggc

SEQ ID NO: 16473 - DNA, 35 bp, Artificial Sequence
  Synthetic oligonucleotide
gatgtggtagtaggtagggaggggtaggtcttaat

SEQ ID NO: 16474 - DNA, 35 bp, Artificial Sequence
  Synthetic oligonucleotide
gtgacaaccgacggggggctggtgacaatgggggt

SEQ ID NO: 16475 - DNA, 36 bp, Artificial Sequence
  Synthetic oligonucleotide
atctgtcccgtcccgtctggtctcatctcatccaca

SEQ ID NO: 16476 - DNA, 37 bp, Artificial Sequence
  Synthetic oligonucleotide
tctacaatcctcactgccccgaagcgtccatccgcga

SEQ ID NO: 16477 - DNA, 37 bp, Artificial Sequence
  Synthetic oligonucleotide
gtaccatccgcagcacgtcacacgtaatctgtctgga

SEQ ID NO: 16478 - DNA, 35 bp, Artificial Sequence
  Synthetic oligonucleotide
acgaacaatacccacatatcccacggccacgagcc

SEQ ID NO: 16479 - DNA, 36 bp, Artificial Sequence
  Synthetic oligonucleotide
accaccgtaacaattgtcctgtgccatcgttcaaca

SEQ ID NO: 16480 - DNA, 36 bp, Artificial Sequence
  Synthetic oligonucleotide
gcactcccccatcacgctcctaccgttgtctgcata

SEQ ID NO: 16481 - DNA, 35 bp, Artificial Sequence
  Synthetic oligonucleotide
agccagtgccacctggcccaatcacgagtcctcgc

SEQ ID NO: 16482 - DNA, 35 bp, Artificial Sequence
  Synthetic oligonucleotide
gaacccgctacaccaacgtaccgacctgtaatatc

SEQ ID NO: 16483 - DNA, 36 bp, Artificial Sequence
  Synthetic oligonucleotide
atccgccggacgcgcgtacttcgcccccattttgca

SEQ ID NO: 16484 - DNA, 35 bp, Artificial Sequence
  Synthetic oligonucleotide
gaccatgcctcctaggtgtgctacaatttcccata

SEQ ID NO: 16485 - DNA, 35 bp, Artificial Sequence
  Synthetic oligonucleotide
tccgcacccgtgtttcctgttcaccatctatctta

SEQ ID NO: 16486 - DNA, 35 bp, Artificial Sequence
  Synthetic oligonucleotide
gttccgtagcattgttcttccccgtgcggtcgtac

SEQ ID NO: 16487 - DNA, 36 bp, Artificial Sequence
  Synthetic oligonucleotide
gatggtccgcccactctattttgcgtaattgcctaa

SEQ ID NO: 16488 - DNA, 35 bp, Artificial Sequence
  Synthetic oligonucleotide
ggagccacccatagttacttatagatccttgcacc

SEQ ID NO: 16489 - DNA, 35 bp, Artificial Sequence
  Synthetic oligonucleotide
tcgatatgtccaactgtttcgaacgtgtctcatcc

SEQ ID NO: 16490 - DNA, 35 bp, Artificial Sequence
  Synthetic oligonucleotide
tcagaggggaggggtgtttcggggcggtgggaagc

SEQ ID NO: 16491 - DNA, 35 bp, Artificial Sequence
  Synthetic oligonucleotide
atccaccctcaatctccacactattaggcttacgc

SEQ ID NO: 16492 - DNA, 35 bp, Artificial Sequence
  Synthetic oligonucleotide
atgaaggggactaggtgggggaagaaaactggtcg

SEQ ID NO: 16493 - DNA, 36 bp, Artificial Sequence
  Synthetic oligonucleotide
gccagatcagctgtgcaccctccgccaactctgtaa

SEQ ID NO: 16494 - DNA, 35 bp, Artificial Sequence
  Synthetic oligonucleotide
gttgccacaccgacgccccgatgtcctgcgatccc

SEQ ID NO: 16495 - DNA, 36 bp, Artificial Sequence
  Synthetic oligonucleotide
gtagggagccggaagggggttggtggacggggctaa

SEQ ID NO: 16496 - DNA, 37 bp, Artificial Sequence
  Synthetic oligonucleotide
tcgcaaaaacgggaaaagggaaggtgacgacgcaaga

SEQ ID NO: 16497 - DNA, 38 bp, Artificial Sequence
  Synthetic oligonucleotide
gacacccacacttaggttttgaacttctgactacatga

SEQ ID NO: 16498 - DNA, 38 bp, Artificial Sequence
  Synthetic oligonucleotide
gaaagggagtggacctggaagagtatgggctggggtga

SEQ ID NO: 16499 - DNA, 35 bp, Artificial Sequence
  Synthetic oligonucleotide
tgcaaaacctgctccccacgcccataacttacgcc

SEQ ID NO: 16500 - DNA, 35 bp, Artificial Sequence
  Synthetic oligonucleotide
gtctgagcctcgttgcctctattgactacatttcc

SEQ ID NO: 16501 - DNA, 35 bp, Artificial Sequence
  Synthetic oligonucleotide
tcatcgagtgtcaaacatctaccttgcctcgtttc

SEQ ID NO: 16502 - DNA, 36 bp, Artificial Sequence
  Synthetic oligonucleotide
gttacacccggtatgttgctcctgcttgcgcatgcg

SEQ ID NO: 16503 - DNA, 35 bp, Artificial Sequence
  Synthetic oligonucleotide
tgtggcctacctctgctcgctccagcacttacact

SEQ ID NO: 16504 - DNA, 36 bp, Artificial Sequence
  Synthetic oligonucleotide
aatcaccactggggcctatacgtacacggctttcaa

SEQ ID NO: 16505 - DNA, 37 bp, Artificial Sequence
  Synthetic oligonucleotide
tgatgcgctgctcacattcctttgctgcttccgccga

SEQ ID NO: 16506 - DNA, 36 bp, Artificial Sequence
  Synthetic oligonucleotide
atcacacagggcaggtccgagggtgggtgggaatta

SEQ ID NO: 16507 - DNA, 35 bp, Artificial Sequence
  Synthetic oligonucleotide
tcccgacgatattgtcccggccctacaacactacc

SEQ ID NO: 16508 - DNA, 35 bp, Artificial Sequence
  Synthetic oligonucleotide
tcagccacttcatcatcacacgccggtgttcctcc

SEQ ID NO: 16509 - DNA, 35 bp, Artificial Sequence
  Synthetic oligonucleotide
acccgcaccccctcgcacccgccgccttgcactaa

SEQ ID NO: 16510 - DNA, 35 bp, Artificial Sequence
  Synthetic oligonucleotide
ttgccccgacacatgtaacatattccggcttcctc

SEQ ID NO: 16511 - DNA, 32 bp, Artificial Sequence
  Synthetic oligonucleotide
tgcctattgacgccacccagcttaaccgacct

SEQ ID NO: 16512 - DNA, 35 bp, Artificial Sequence
  Synthetic oligonucleotide
gctccgtcctttccctgcttcgatgattgctacgt

SEQ ID NO: 16513 - DNA, 37 bp, Artificial Sequence
  Synthetic oligonucleotide
gctgccgccgccgtccctcacaatctgcatatttcga

SEQ ID NO: 16514 - DNA, 35 bp, Artificial Sequence
  Synthetic oligonucleotide
gtagcccagttctcagccccccgggactatcccgc

SEQ ID NO: 16515 - DNA, 35 bp, Artificial Sequence
  Synthetic oligonucleotide
gccgcctgcctatcccagcttgggcttttcttacg

SEQ ID NO: 16516 - DNA, 35 bp, Artificial Sequence
  Synthetic oligonucleotide
gatcaaccactcggtcaatagtacccctcgcttca

SEQ ID NO: 16517 - DNA, 36 bp, Artificial Sequence
  Synthetic oligonucleotide
atgcaccccttccccgtgaccacttgtattaatcga

SEQ ID NO: 16518 - DNA, 34 bp, Artificial Sequence
  Synthetic oligonucleotide
ttgaggagcaaacggtaggggttgaaggaacgga

SEQ ID NO: 16519 - DNA, 37 bp, Artificial Sequence
  Synthetic oligonucleotide
ttggaagaccgtgggtgggtagggtctgttataggga

SEQ ID NO: 16520 - DNA, 38 bp, Artificial Sequence
  Synthetic oligonucleotide
taactgcatgcgcgcctctttcgtttttgcactgttga

SEQ ID NO: 16521 - DNA, 35 bp, Artificial Sequence
  Synthetic oligonucleotide
gctgaagtggggtttaaaagggatgagggaagtta

SEQ ID NO: 16522 - DNA, 35 bp, Artificial Sequence
  Synthetic oligonucleotide
gccactcattggagtgaccaccgtaaaattccccc

SEQ ID NO: 16523 - DNA, 35 bp, Artificial Sequence
  Synthetic oligonucleotide
gccacctactcgagtaaagcgatggttcttccccc

SEQ ID NO: 16524 - DNA, 37 bp, Artificial Sequence
  Synthetic oligonucleotide
gagtaccacaccaccttaaccaagacagatcgggaga

SEQ ID NO: 16525 - DNA, 37 bp, Artificial Sequence
  Synthetic oligonucleotide
ttgatggggcggaaggaggggatgggatgatcaagga

SEQ ID NO: 16526 - DNA, 35 bp, Artificial Sequence
  Synthetic oligonucleotide
acaccagcacttccggccggccttacttacccgta

SEQ ID NO: 16527 - DNA, 35 bp, Artificial Sequence
  Synthetic oligonucleotide
tcccctacgtaggctgtctagtactcctcgtcccc

SEQ ID NO: 16528 - DNA, 35 bp, Artificial Sequence
  Synthetic oligonucleotide
tagccgggagttacacagtcgtcacctgccccatc

SEQ ID NO: 16529 - DNA, 35 bp, Artificial Sequence
  Synthetic oligonucleotide
tcgcacctacctcagtcgacgctgaccgcatttaa

SEQ ID NO: 16530 - DNA, 37 bp, Artificial Sequence
  Synthetic oligonucleotide
tgcatcactgagcgtttccttccctaccctgacccga

SEQ ID NO: 16531 - DNA, 37 bp, Artificial Sequence
  Synthetic oligonucleotide
gaagaactgggaccggggggtagaaggggctggagga

SEQ ID NO: 16532 - DNA, 34 bp, Artificial Sequence
  Synthetic oligonucleotide
tcccagctcacccattcccgccactccaaatcgc

SEQ ID NO: 16533 - DNA, 35 bp, Artificial Sequence
  Synthetic oligonucleotide
acattcagcgccccgaattctattgcttcttgctt

SEQ ID NO: 16534 - DNA, 36 bp, Artificial Sequence
  Synthetic oligonucleotide
tgtccccccgcgctttttgataaaatcggtccatca

SEQ ID NO: 16535 - DNA, 37 bp, Artificial Sequence
  Synthetic oligonucleotide
tttccagcatctcatgccattcttcacctgttcacga

SEQ ID NO: 16536 - DNA, 35 bp, Artificial Sequence
  Synthetic oligonucleotide
tccagtgggaacgtcgtaggcccatcacccccata

SEQ ID NO: 16537 - DNA, 35 bp, Artificial Sequence
  Synthetic oligonucleotide
tctaccatcaacgacgccccttcgttatcgcacct

SEQ ID NO: 16538 - DNA, 35 bp, Artificial Sequence
  Synthetic oligonucleotide
tgcgtaggcaacacgtagctccatccgccgctatt

SEQ ID NO: 16539 - DNA, 37 bp, Artificial Sequence
  Synthetic oligonucleotide
agtactgcgggcggcgggcgacaaggcaatggtggga

SEQ ID NO: 16540 - DNA, 35 bp, Artificial Sequence
  Synthetic oligonucleotide
gaacggagcgcccccctgctgatctgaatcttcaa

SEQ ID NO: 16541 - DNA, 30 bp, Artificial Sequence
  Synthetic oligonucleotide
aagcgcaaccaccatcacccatcgaacaga

SEQ ID NO: 16542 - DNA, 37 bp, Artificial Sequence
  Synthetic oligonucleotide
gagacaagctggataaggtagggaaggctgggaggga

SEQ ID NO: 16543 - DNA, 35 bp, Artificial Sequence
  Synthetic oligonucleotide
gcatgcatcccccactgatcgtcagtacatgcacc

SEQ ID NO: 16544 - DNA, 35 bp, Artificial Sequence
  Synthetic oligonucleotide
acccgagtcaggagcgtctctctgccatccctgct

SEQ ID NO: 16545 - DNA, 35 bp, Artificial Sequence
  Synthetic oligonucleotide
gcccgatcgccttcatcctatgttctgtgaaccgt

SEQ ID NO: 16546 - DNA, 35 bp, Artificial Sequence
  Synthetic oligonucleotide
tgacgctcgctgtatgtcctgttccgttcctagtt

SEQ ID NO: 16547 - DNA, 38 bp, Artificial Sequence
  Synthetic oligonucleotide
atctgcgccacgacctctcggcctgtcttatcgcctga

SEQ ID NO: 16548 - DNA, 35 bp, Artificial Sequence
  Synthetic oligonucleotide
ttgtgcctcgccatgaagggaagggggggcatggg

SEQ ID NO: 16549 - DNA, 36 bp, Artificial Sequence
  Synthetic oligonucleotide
tcaacctcctccgtgacccagcacattgccagcaaa

SEQ ID NO: 16550 - DNA, 38 bp, Artificial Sequence
  Synthetic oligonucleotide
tctcaccctctcaactgcatagactccgtactgtttga

SEQ ID NO: 16551 - DNA, 37 bp, Artificial Sequence
  Synthetic oligonucleotide
gtgaggggggtagttgcggtagaaaagggatcctaga

SEQ ID NO: 16552 - DNA, 38 bp, Artificial Sequence
  Synthetic oligonucleotide
agaccccctgccatcctgcaaccgtcaaaaccttttga

SEQ ID NO: 16553 - DNA, 36 bp, Artificial Sequence
  Synthetic oligonucleotide
aacacccacccagctgacccaggtcattccatgtta

SEQ ID NO: 16554 - DNA, 35 bp, Artificial Sequence
  Synthetic oligonucleotide
ttccgtgaaacgcccgtgttaaccccccgatagcc

SEQ ID NO: 16555 - DNA, 35 bp, Artificial Sequence
  Synthetic oligonucleotide
tccacattcttcgccacatgatataaatcctcgtc

SEQ ID NO: 16556 - DNA, 38 bp, Artificial Sequence
  Synthetic oligonucleotide
gaatggtccgtccaccacgaggcaacctccctccctga

SEQ ID NO: 16557 - DNA, 36 bp, Artificial Sequence
  Synthetic oligonucleotide
acactcagttcggtcaccatccagcgacattcgcta

SEQ ID NO: 16558 - DNA, 35 bp, Artificial Sequence
  Synthetic oligonucleotide
tccgcacggcgacaacccgttcttgatcttagccc

SEQ ID NO: 16559 - DNA, 37 bp, Artificial Sequence
  Synthetic oligonucleotide
gtaccaccgaatcaatctatcttcagtctatctccga

SEQ ID NO: 16560 - DNA, 37 bp, Artificial Sequence
  Synthetic oligonucleotide
tcgccacccagccgtcgccatattgctttactcttga

SEQ ID NO: 16561 - DNA, 36 bp, Artificial Sequence
  Synthetic oligonucleotide
gagggacggtggaggaagaacttgtggtcggggata

SEQ ID NO: 16562 - DNA, 35 bp, Artificial Sequence
  Synthetic oligonucleotide
tccactcggccatataagccttctcatcgcctgac

SEQ ID NO: 16563 - DNA, 36 bp, Artificial Sequence
  Synthetic oligonucleotide
atgagaacgggagggggggaagcgactcaaaccgag

SEQ ID NO: 16564 - DNA, 35 bp, Artificial Sequence
  Synthetic oligonucleotide
gcactgatcctcctcactgctgcccagaccacagt

SEQ ID NO: 16565 - DNA, 35 bp, Artificial Sequence
  Synthetic oligonucleotide
actcccgcccgcacaagtcccgtaatacaccgtca

SEQ ID NO: 16566 - DNA, 36 bp, Artificial Sequence
  Synthetic oligonucleotide
tgatcccgtcgcccttcttagcgtcacctaacagga

SEQ ID NO: 16567 - DNA, 38 bp, Artificial Sequence
  Synthetic oligonucleotide
gacacctctccatgtgactagcttacctccgaacctga

SEQ ID NO: 16568 - DNA, 35 bp, Artificial Sequence
  Synthetic oligonucleotide
gcgagccctcgcattgtacgcatgcccagcccgac

SEQ ID NO: 16569 - DNA, 35 bp, Artificial Sequence
  Synthetic oligonucleotide
gtgcacaactcacatcttttctcttcttaaatgcg

SEQ ID NO: 16570 - DNA, 35 bp, Artificial Sequence
  Synthetic oligonucleotide
tgtgaaagtgaggcgaaaaaggaatggtggacggt

SEQ ID NO: 16571 - DNA, 36 bp, Artificial Sequence
  Synthetic oligonucleotide
acactctatacgtagtcaccgcttccccccggagga

SEQ ID NO: 16572 - DNA, 38 bp, Artificial Sequence
  Synthetic oligonucleotide
ttggcttcccctgctccccgccgcgcatacgcccatga

SEQ ID NO: 16573 - DNA, 38 bp, Artificial Sequence
  Synthetic oligonucleotide
gtcgaccgcccccgtgccatcttacgatatacacctga

SEQ ID NO: 16574 - DNA, 36 bp, Artificial Sequence
  Synthetic oligonucleotide
ttacgtacaacgccgccgcccttccggtaccacata

SEQ ID NO: 16575 - DNA, 36 bp, Artificial Sequence
  Synthetic oligonucleotide
agtccacccctgcgctacgacccctagttatctgta

SEQ ID NO: 16576 - DNA, 37 bp, Artificial Sequence
  Synthetic oligonucleotide
gtacagcacacactattttgcatctcctccccatgga

SEQ ID NO: 16577 - DNA, 38 bp, Artificial Sequence
  Synthetic oligonucleotide
gcaccatcccttcgccactcttactgcttgtttagtga

SEQ ID NO: 16578 - DNA, 36 bp, Artificial Sequence
  Synthetic oligonucleotide
gtgttgcgcagactccactccacctatgtttatcca

SEQ ID NO: 16579 - DNA, 38 bp, Artificial Sequence
  Synthetic oligonucleotide
ggactgctcctgcggtcctctattctctcatgtaatga

SEQ ID NO: 16580 - DNA, 38 bp, Artificial Sequence
  Synthetic oligonucleotide
tagccaagccacgtacgactgcctctcctagtctctga

SEQ ID NO: 16581 - DNA, 36 bp, Artificial Sequence
  Synthetic oligonucleotide
actccctcacctgtctacacgttcgtcctctacata

SEQ ID NO: 16582 - DNA, 35 bp, Artificial Sequence
  Synthetic oligonucleotide
tatgctgcacccctttgttccctcatcaatattgg

SEQ ID NO: 16583 - DNA, 35 bp, Artificial Sequence
  Synthetic oligonucleotide
agtcgccctggccccagaaccccattagccaacat

SEQ ID NO: 16584 - DNA, 35 bp, Artificial Sequence
  Synthetic oligonucleotide
tctcgacctggaaccttgcacctcttatggacaca

SEQ ID NO: 16585 - DNA, 35 bp, Artificial Sequence
  Synthetic oligonucleotide
ttcagcaaggccccctcatccggatacgctgccca

SEQ ID NO: 16586 - DNA, 36 bp, Artificial Sequence
  Synthetic oligonucleotide
gcacgccgcatcttctccatccatacgagtctcgca

SEQ ID NO: 16587 - DNA, 35 bp, Artificial Sequence
  Synthetic oligonucleotide
agactccagttgcacgtgcactagttctttctcac

SEQ ID NO: 16588 - DNA, 35 bp, Artificial Sequence
  Synthetic oligonucleotide
gtcgaggcttccatctcagccctcaccccactatc

SEQ ID NO: 16589 - DNA, 35 bp, Artificial Sequence
  Synthetic oligonucleotide
tcatggtcgcggtccgctactcacacggtcctact

SEQ ID NO: 16590 - DNA, 35 bp, Artificial Sequence
  Synthetic oligonucleotide
actctaccgacgagcgtataccattaatgccctct

SEQ ID NO: 16591 - DNA, 35 bp, Artificial Sequence
  Synthetic oligonucleotide
accctccgcccctgcatcagcctactggcgtacgt

SEQ ID NO: 16592 - DNA, 37 bp, Artificial Sequence
  Synthetic oligonucleotide
acgggtaggggggggaagggatgatcggcctgagcga

SEQ ID NO: 16593 - DNA, 38 bp, Artificial Sequence
  Synthetic oligonucleotide
gacttccgccccatttaaatctcgtggctatgccatga

SEQ ID NO: 16594 - DNA, 38 bp, Artificial Sequence
  Synthetic oligonucleotide
gcgcaacccatcccaactaggaacagtccgaactgtga

SEQ ID NO: 16595 - DNA, 35 bp, Artificial Sequence
  Synthetic oligonucleotide
ggagtcggagacaaatgagggcttaggggatggta

SEQ ID NO: 16596 - DNA, 34 bp, Artificial Sequence
  Synthetic oligonucleotide
acacaccgacaatgacttttttttcaatagttac

SEQ ID NO: 16597 - DNA, 35 bp, Artificial Sequence
  Synthetic oligonucleotide
gcactcaccggtggcacaatactcttcgcacattg

SEQ ID NO: 16598 - DNA, 36 bp, Artificial Sequence
  Synthetic oligonucleotide
gcctccactcacagccccgataagtttccagcgaaa

SEQ ID NO: 16599 - DNA, 35 bp, Artificial Sequence
  Synthetic oligonucleotide
tatgccagagtctcgcgacccattaccgtttctcc

SEQ ID NO: 16600 - DNA, 35 bp, Artificial Sequence
  Synthetic oligonucleotide
tagtcaccccacagtctgttccacgatctccgctg

SEQ ID NO: 16601 - DNA, 35 bp, Artificial Sequence
  Synthetic oligonucleotide
gtgctctcaatgcgaaatggcccaccccctccttg

SEQ ID NO: 16602 - DNA, 35 bp, Artificial Sequence
  Synthetic oligonucleotide
gacacctacggttatcttggtggaacctgcccccc

SEQ ID NO: 16603 - DNA, 35 bp, Artificial Sequence
  Synthetic oligonucleotide
tgcgcaagccatatttgatcgtctatttcctgggg

SEQ ID NO: 16604 - DNA, 35 bp, Artificial Sequence
  Synthetic oligonucleotide
gtctgtaggaggggagttgctgggaagggggtggg

SEQ ID NO: 16605 - DNA, 36 bp, Artificial Sequence
  Synthetic oligonucleotide
tccccgaccacccgattcgaaaacgatgacccaata

SEQ ID NO: 16606 - DNA, 35 bp, Artificial Sequence
  Synthetic oligonucleotide
acaaccatccaccgcaggttgatgcctcactttac

SEQ ID NO: 16607 - DNA, 36 bp, Artificial Sequence
  Synthetic oligonucleotide
attggcggaggcatagtggggcggaggacggttacc

SEQ ID NO: 16608 - DNA, 35 bp, Artificial Sequence
  Synthetic oligonucleotide
tccccactccgtcctggataacttgaacttttccg

SEQ ID NO: 16609 - DNA, 35 bp, Artificial Sequence
  Synthetic oligonucleotide
tccaagcgtaaggtcattgcgtcccacttttccgt

SEQ ID NO: 16610 - DNA, 35 bp, Artificial Sequence
  Synthetic oligonucleotide
tcatccccggacaactgtgtccgcctcaccataaa

SEQ ID NO: 16611 - DNA, 36 bp, Artificial Sequence
  Synthetic oligonucleotide
ttacacgcccttgcttcgtttttcaggtatttgcaa

SEQ ID NO: 16612 - DNA, 36 bp, Artificial Sequence
  Synthetic oligonucleotide
ttcgcgaggaacgaagggaaggtgtgcgggaatgaa

SEQ ID NO: 16613 - DNA, 35 bp, Artificial Sequence
  Synthetic oligonucleotide
gtcgccatcctatccaggccgtccttaaccacatt

SEQ ID NO: 16614 - DNA, 36 bp, Artificial Sequence
  Synthetic oligonucleotide
gccacgcaggagccttagccctctgttctacccgca

SEQ ID NO: 16615 - DNA, 37 bp, Artificial Sequence
  Synthetic oligonucleotide
acaacccctgatcttatctttcctcgagtcatcgaga

SEQ ID NO: 16616 - DNA, 37 bp, Artificial Sequence
  Synthetic oligonucleotide
gcatgcgcgcaccgtaccacccctgattttgactcga

SEQ ID NO: 16617 - DNA, 37 bp, Artificial Sequence
  Synthetic oligonucleotide
gtgagggaggagtcatgagggtgggcggagcgattga

SEQ ID NO: 16618 - DNA, 35 bp, Artificial Sequence
  Synthetic oligonucleotide
ccaagtgccaatacgcgcattgcttggacgttaac

SEQ ID NO: 16619 - DNA, 35 bp, Artificial Sequence
  Synthetic oligonucleotide
tagctccctcacatctatgggctgtgtcctgcctc

SEQ ID NO: 16620 - DNA, 37 bp, Artificial Sequence
  Synthetic oligonucleotide
ttgagtgcaggtgtacctttcttcttccaatagttga

SEQ ID NO: 16621 - DNA, 35 bp, Artificial Sequence
  Synthetic oligonucleotide
ttgacaacacatgcgcgacgccccaatacttagcc

SEQ ID NO: 16622 - DNA, 35 bp, Artificial Sequence
  Synthetic oligonucleotide
tccagctgccacttgcccaattcgttacttccctt

SEQ ID NO: 16623 - DNA, 36 bp, Artificial Sequence
  Synthetic oligonucleotide
tcccctagccctcatcagttacttctagctctccga

SEQ ID NO: 16624 - DNA, 38 bp, Artificial Sequence
  Synthetic oligonucleotide
tccccctaccccctgcttgccataagccccggtgctga

SEQ ID NO: 16625 - DNA, 35 bp, Artificial Sequence
  Synthetic oligonucleotide
tcttgacaaccgtcgcatagtcccatctctcttcc

SEQ ID NO: 16626 - DNA, 35 bp, Artificial Sequence
  Synthetic oligonucleotide
atcggagacctcacgctacatatccccgagcttcg

SEQ ID NO: 16627 - DNA, 35 bp, Artificial Sequence
  Synthetic oligonucleotide
gaggaatagggttacgaggggcatagggcatgagg

SEQ ID NO: 16628 - DNA, 35 bp, Artificial Sequence
  Synthetic oligonucleotide
gagacgcagcactttaaccgactcctgcctcccca

SEQ ID NO: 16629 - DNA, 37 bp, Artificial Sequence
  Synthetic oligonucleotide
aagagggtacgggggtgagtgacggagaaggaacaga

SEQ ID NO: 16630 - DNA, 38 bp, Artificial Sequence
  Synthetic oligonucleotide
tgccacgcgcacctcgctgcccttttagccaacattga

SEQ ID NO: 16631 - DNA, 37 bp, Artificial Sequence
  Synthetic oligonucleotide
taccaggtccgagtcagggaggtggtagggggttgga

SEQ ID NO: 16632 - DNA, 38 bp, Artificial Sequence
  Synthetic oligonucleotide
acccacctccggtttgactcaccacatctctgacctga

SEQ ID NO: 16633 - DNA, 37 bp, Artificial Sequence
  Synthetic oligonucleotide
aacgcagggggatgagtgggggggcctgaaagggtga

SEQ ID NO: 16634 - DNA, 35 bp, Artificial Sequence
  Synthetic oligonucleotide
catccaccccaggactcacgacaacgagtgggtag

SEQ ID NO: 16635 - DNA, 35 bp, Artificial Sequence
  Synthetic oligonucleotide
tacgccctccaacttgatcgaccccagcctcactt

SEQ ID NO: 16636 - DNA, 35 bp, Artificial Sequence
  Synthetic oligonucleotide
gtgcccccttagccggttgaatgcaccaatatttt

SEQ ID NO: 16637 - DNA, 37 bp, Artificial Sequence
  Synthetic oligonucleotide
tactgtggtgaagatggggctagggggggaaggtcga

SEQ ID NO: 16638 - DNA, 38 bp, Artificial Sequence
  Synthetic oligonucleotide
gcacgttcacccggttccaacgactacatccatcctga

SEQ ID NO: 16639 - DNA, 35 bp, Artificial Sequence
  Synthetic oligonucleotide
gtagccccctgctatcaaccggtcctggcaccctc

SEQ ID NO: 16640 - DNA, 35 bp, Artificial Sequence
  Synthetic oligonucleotide
acacgccggaaggacttcctttcataactacacct

SEQ ID NO: 16641 - DNA, 35 bp, Artificial Sequence
  Synthetic oligonucleotide
acatcgcgtaggacccaccttcgcaatccgccctt

SEQ ID NO: 16642 - DNA, 35 bp, Artificial Sequence
  Synthetic oligonucleotide
gcgcctgcccctccgtacatggcctgaatgcacca

SEQ ID NO: 16643 - DNA, 37 bp, Artificial Sequence
  Synthetic oligonucleotide
tacgccacctttcccgtcttccctgcgtcgtttccga

SEQ ID NO: 16644 - DNA, 35 bp, Artificial Sequence
  Synthetic oligonucleotide
atgtaagccgcagggagggtagggggctctgtggg

SEQ ID NO: 16645 - DNA, 36 bp, Artificial Sequence
  Synthetic oligonucleotide
aagtgacgcgcagtagttttcggtcacttgtatatg

SEQ ID NO: 16646 - DNA, 36 bp, Artificial Sequence
  Synthetic oligonucleotide
tacgaacacgctgacttctcactctgttgctttgca

SEQ ID NO: 16647 - DNA, 37 bp, Artificial Sequence
  Synthetic oligonucleotide
acctaccacctgttcgcgatgatatgtgccccttcga

SEQ ID NO: 16648 - DNA, 35 bp, Artificial Sequence
  Synthetic oligonucleotide
tcaaagggacaagtagggggaggggtgttcgggga

SEQ ID NO: 16649 - DNA, 37 bp, Artificial Sequence
  Synthetic oligonucleotide
gtgcggaaacgagggaactggggaaaccgaactggga

SEQ ID NO: 16650 - DNA, 37 bp, Artificial Sequence
  Synthetic oligonucleotide
accctgcgcacctgatacctgcccctctgaacatgga

SEQ ID NO: 16651 - DNA, 35 bp, Artificial Sequence
  Synthetic oligonucleotide
accttgcccgcccacccaacgtttatcgccctagg

SEQ ID NO: 16652 - DNA, 36 bp, Artificial Sequence
  Synthetic oligonucleotide
gtgatctggtccttcaccggtttatttgccccccat

SEQ ID NO: 16653 - DNA, 35 bp, Artificial Sequence
  Synthetic oligonucleotide
attggtacgcagactagtccgcaattgtcacccct

SEQ ID NO: 16654 - DNA, 36 bp, Artificial Sequence
  Synthetic oligonucleotide
gggcggtccactgcgcgcgcctacacctgtccccca

SEQ ID NO: 16655 - DNA, 36 bp, Artificial Sequence
  Synthetic oligonucleotide
gttgcacactaccccttcgccgttccccccgcagga

SEQ ID NO: 16656 - DNA, 37 bp, Artificial Sequence
  Synthetic oligonucleotide
tacgcacccctgtactcttgcgctccagagcacttga

SEQ ID NO: 16657 - DNA, 35 bp, Artificial Sequence
  Synthetic oligonucleotide
aagtcgcaaatccaccttgcttaatgtaccgctcg

SEQ ID NO: 16658 - DNA, 35 bp, Artificial Sequence
  Synthetic oligonucleotide
gcccatcagcgacatccttaccctgccccattgta

SEQ ID NO: 16659 - DNA, 35 bp, Artificial Sequence
  Synthetic oligonucleotide
gtcattcctccacccgtgaacttgaaacaatgcac

SEQ ID NO: 16660 - DNA, 35 bp, Artificial Sequence
  Synthetic oligonucleotide
tcaccagttgaccgcgagttcttattattgctgcc

SEQ ID NO: 16661 - DNA, 35 bp, Artificial Sequence
  Synthetic oligonucleotide
ttagcgaacctgttatgtctttacccaccacctca

SEQ ID NO: 16662 - DNA, 37 bp, Artificial Sequence
  Synthetic oligonucleotide
atgatagtggggaaagtggtggaggaaagagcacgga

SEQ ID NO: 16663 - DNA, 38 bp, Artificial Sequence
  Synthetic oligonucleotide
accgaccccttcgttgccgttgcccctctaccctttga

SEQ ID NO: 16664 - DNA, 36 bp, Artificial Sequence
  Synthetic oligonucleotide
aacgaggccggctcacactttcttatcctgtcctta

SEQ ID NO: 16665 - DNA, 35 bp, Artificial Sequence
  Synthetic oligonucleotide
ttccctcccaccggtaatgtcgagcttccatctcg

SEQ ID NO: 16666 - DNA, 36 bp, Artificial Sequence
  Synthetic oligonucleotide
aacaacatgggagggagaagggtggtggagagctaa

SEQ ID NO: 16667 - DNA, 35 bp, Artificial Sequence
  Synthetic oligonucleotide
cgtggacgctgtccatacgttccgccctttcagta

SEQ ID NO: 16668 - DNA, 37 bp, Artificial Sequence
  Synthetic oligonucleotide
gtggggtagggtggaaggggctttactagtggagaga

SEQ ID NO: 16669 - DNA, 37 bp, Artificial Sequence
  Synthetic oligonucleotide
actctcccgccagactttacgcctcacaggcaccgga

SEQ ID NO: 16670 - DNA, 37 bp, Artificial Sequence
  Synthetic oligonucleotide
atgccccgcaatcatataatttcgctcttgcacttga

SEQ ID NO: 16671 - DNA, 38 bp, Artificial Sequence
  Synthetic oligonucleotide
agcgcccgacaccgctgctcttatgtacgccttcttga

SEQ ID NO: 16672 - DNA, 35 bp, Artificial Sequence
  Synthetic oligonucleotide
atcgccggagcacacatattccaaggcgtacttta

SEQ ID NO: 16673 - DNA, 35 bp, Artificial Sequence
  Synthetic oligonucleotide
tcattgccttcgaatagctgtcttggcccatctcc

SEQ ID NO: 16674 - DNA, 35 bp, Artificial Sequence
  Synthetic oligonucleotide
tgatacggaactttctgtcccacccagcactttgg

SEQ ID NO: 16675 - DNA, 37 bp, Artificial Sequence
  Synthetic oligonucleotide
gcgataccgaaggttgccttatctaacaccacaatga

SEQ ID NO: 16676 - DNA, 35 bp, Artificial Sequence
  Synthetic oligonucleotide
agtcccaacagagctaccgtggcttccccctaccc

SEQ ID NO: 16677 - DNA, 35 bp, Artificial Sequence
  Synthetic oligonucleotide
gatcaagcgcatttgccgtcacccaattcctcgtc

SEQ ID NO: 16678 - DNA, 35 bp, Artificial Sequence
  Synthetic oligonucleotide
gacgccccaaaaccacatccttagctccgcttatg

SEQ ID NO: 16679 - DNA, 36 bp, Artificial Sequence
  Synthetic oligonucleotide
gtgcgactatgcctgcacgagaatcaccctctcaca

SEQ ID NO: 16680 - DNA, 36 bp, Artificial Sequence
  Synthetic oligonucleotide
tgttgctccgtccgggctgctgcaactctcgatcca

SEQ ID NO: 16681 - DNA, 37 bp, Artificial Sequence
  Synthetic oligonucleotide
aaccctgcactccctgcgatacccgtctttttttgga

SEQ ID NO: 16682 - DNA, 38 bp, Artificial Sequence
  Synthetic oligonucleotide
gtggatggcggagcgagtggtgtggtgtgtgcgggtga

SEQ ID NO: 16683 - DNA, 36 bp, Artificial Sequence
  Synthetic oligonucleotide
gtgcctgcaccggacgtcatataccccgtccctgta

SEQ ID NO: 16684 - DNA, 32 bp, Artificial Sequence
  Synthetic oligonucleotide
accaccagggaaaaatatggtcacaattagtc

SEQ ID NO: 16685 - DNA, 35 bp, Artificial Sequence
  Synthetic oligonucleotide
gcaccacacctgcagaataacttagacttgccttt

SEQ ID NO: 16686 - DNA, 35 bp, Artificial Sequence
  Synthetic oligonucleotide
tagcctcccaggcactccctctcccgagtttgccc

SEQ ID NO: 16687 - DNA, 35 bp, Artificial Sequence
  Synthetic oligonucleotide
aatcgccgctgcatcactggtcaatcgtgatctcc

SEQ ID NO: 16688 - DNA, 35 bp, Artificial Sequence
  Synthetic oligonucleotide
ttgttgtcgcgccggcatccttctccgttggtctc

SEQ ID NO: 16689 - DNA, 35 bp, Artificial Sequence
  Synthetic oligonucleotide
aagggcacccgatatttgtccgttcctggttccat

SEQ ID NO: 16690 - DNA, 34 bp, Artificial Sequence
  Synthetic oligonucleotide
tcctcaccactctattggacttgcattcactagt

SEQ ID NO: 16691 - DNA, 34 bp, Artificial Sequence
  Synthetic oligonucleotide
gagatgacgttaggtttcgcccgcaccacccgtt

SEQ ID NO: 16692 - DNA, 38 bp, Artificial Sequence
  Synthetic oligonucleotide
tacctgtcctccctgatctgcgaacaatctttctgtga

SEQ ID NO: 16693 - DNA, 37 bp, Artificial Sequence
  Synthetic oligonucleotide
gcaacatgacgcctatacccgccccgctcagtccata

SEQ ID NO: 16694 - DNA, 35 bp, Artificial Sequence
  Synthetic oligonucleotide
acccccctcagccgtaaatttctttaaacggtccc

SEQ ID NO: 16695 - DNA, 35 bp, Artificial Sequence
  Synthetic oligonucleotide
gacacgtatagtagctcctgtgttcgttcctctgc

SEQ ID NO: 16696 - DNA, 35 bp, Artificial Sequence
  Synthetic oligonucleotide
gaaccaacccacgtgaccgagtgcgcttaatccaa

SEQ ID NO: 16697 - DNA, 36 bp, Artificial Sequence
  Synthetic oligonucleotide
tccccactcacctatagtattgtcgtgttcaatcca

SEQ ID NO: 16698 - DNA, 35 bp, Artificial Sequence
  Synthetic oligonucleotide
gcctgagcacttcatcggccttacacagcctttct

SEQ ID NO: 16699 - DNA, 35 bp, Artificial Sequence
  Synthetic oligonucleotide
acctgtacacgccctgtttttgaattctttcttgt

SEQ ID NO: 16700 - DNA, 35 bp, Artificial Sequence
  Synthetic oligonucleotide
ttccacctgacctcgagctgtaataactacggtca

SEQ ID NO: 16701 - DNA, 38 bp, Artificial Sequence
  Synthetic oligonucleotide
gatgcccacctgctgaactggccacttattttgcccga

SEQ ID NO: 16702 - DNA, 36 bp, Artificial Sequence
  Synthetic oligonucleotide
tctgcccatcatcttgcctatccgtacgtaactgga

SEQ ID NO: 16703 - DNA, 35 bp, Artificial Sequence
  Synthetic oligonucleotide
taggcacccacgcacgacgccgccctcccctgtga

SEQ ID NO: 16704 - DNA, 35 bp, Artificial Sequence
  Synthetic oligonucleotide
tacacccatgcccctgttgataatcgtgaatcgtg

SEQ ID NO: 16705 - DNA, 35 bp, Artificial Sequence
  Synthetic oligonucleotide
gaccacaatcctatctgcacttaaaaacgatacct

SEQ ID NO: 16706 - DNA, 35 bp, Artificial Sequence
  Synthetic oligonucleotide
acctacaacctcacctgccgtcaatatacctggct

SEQ ID NO: 16707 - DNA, 35 bp, Artificial Sequence
  Synthetic oligonucleotide
atgggatgccgagtacgcctataccgaaccacctt

SEQ ID NO: 16708 - DNA, 35 bp, Artificial Sequence
  Synthetic oligonucleotide
tgttgccaaccggtgcgtgccccaaccgcaaattt

SEQ ID NO: 16709 - DNA, 35 bp, Artificial Sequence
  Synthetic oligonucleotide
tgcaccacctccggttatttaccgcatgacctacg

SEQ ID NO: 16710 - DNA, 35 bp, Artificial Sequence
  Synthetic oligonucleotide
tatgagggagggcgggtaattgtgggtctatgtgt

SEQ ID NO: 16711 - DNA, 38 bp, Artificial Sequence
  Synthetic oligonucleotide
gtggcccaagcgcagcacgtctattttcgcccatctga

SEQ ID NO: 16712 - DNA, 36 bp, Artificial Sequence
  Synthetic oligonucleotide
gcttcatccctgccgcctgcccaaccctgccgggta

SEQ ID NO: 16713 - DNA, 35 bp, Artificial Sequence
  Synthetic oligonucleotide
agcggcccccccaggctggttccattccgttgttc

SEQ ID NO: 16714 - DNA, 35 bp, Artificial Sequence
  Synthetic oligonucleotide
gaggccagcctgcttgtttgccgccccgcctttct

SEQ ID NO: 16715 - DNA, 36 bp, Artificial Sequence
  Synthetic oligonucleotide
gattccaccgccgcagaacttcacactcttgcacaa

SEQ ID NO: 16716 - DNA, 35 bp, Artificial Sequence
  Synthetic oligonucleotide
atgggcgcctcgccaatgttccctgcaacccacca

SEQ ID NO: 16717 - DNA, 35 bp, Artificial Sequence
  Synthetic oligonucleotide
gatgctcatgcccgtctccccacttgattttctca

SEQ ID NO: 16718 - DNA, 37 bp, Artificial Sequence
  Synthetic oligonucleotide
tgcccccctaaccatggtccgttatccctgcctccga

SEQ ID NO: 16719 - DNA, 38 bp, Artificial Sequence
  Synthetic oligonucleotide
agtccctgttcccctgctgctatgcttgcccatcctga

SEQ ID NO: 16720 - DNA, 34 bp, Artificial Sequence
  Synthetic oligonucleotide
gcatgtgctcgcaatggcacacgctttcatccac

SEQ ID NO: 16721 - DNA, 35 bp, Artificial Sequence
  Synthetic oligonucleotide
tacgagggtcacaccgaatgtccagtcccccgtcc

SEQ ID NO: 16722 - DNA, 37 bp, Artificial Sequence
  Synthetic oligonucleotide
gatcgcagcccgccttatctatctgcccctagttgga

SEQ ID NO: 16723 - DNA, 37 bp, Artificial Sequence
  Synthetic oligonucleotide
tgttccacccgcctgctaacctggcatccatgactga

SEQ ID NO: 16724 - DNA, 35 bp, Artificial Sequence
  Synthetic oligonucleotide
gtcgccactctgacacaactaattggatttcctcc

SEQ ID NO: 16725 - DNA, 35 bp, Artificial Sequence
  Synthetic oligonucleotide
tgttttcagcccggtccctgtcttccttcttcgtc

SEQ ID NO: 16726 - DNA, 35 bp, Artificial Sequence
  Synthetic oligonucleotide
gtgagcaggggggtgtacgggagtgaggtttgatg

SEQ ID NO: 16727 - DNA, 34 bp, Artificial Sequence
  Synthetic oligonucleotide
atgccctgccactgccctccttgtttaccctggt

SEQ ID NO: 16728 - DNA, 35 bp, Artificial Sequence
  Synthetic oligonucleotide
gggaccgccagtctcttcatcatatcccagtccac

SEQ ID NO: 16729 - DNA, 35 bp, Artificial Sequence
  Synthetic oligonucleotide
tcgttgtcgcccatcatcacattcgctgattccac

SEQ ID NO: 16730 - DNA, 34 bp, Artificial Sequence
  Synthetic oligonucleotide
gtcatgtcgtcggtttcttcacacactctagcat

SEQ ID NO: 16731 - DNA, 35 bp, Artificial Sequence
  Synthetic oligonucleotide
acactcgcggaggctgcatctataccttccttcgt

SEQ ID NO: 16732 - DNA, 35 bp, Artificial Sequence
  Synthetic oligonucleotide
tatcccccgccttctgtcatcctatcagtaatgaa

SEQ ID NO: 16733 - DNA, 35 bp, Artificial Sequence
  Synthetic oligonucleotide
tataccccctgacctctgttatgcataataaccca

SEQ ID NO: 16734 - DNA, 37 bp, Artificial Sequence
  Synthetic oligonucleotide
aacgaggggggagaggatcaggtcatgggtcaaggga

SEQ ID NO: 16735 - DNA, 37 bp, Artificial Sequence
  Synthetic oligonucleotide
gtctatcccacccgtaaaggttatcacccccttggga

SEQ ID NO: 16736 - DNA, 37 bp, Artificial Sequence
  Synthetic oligonucleotide
cagtgcccggtctagctactcacgcctcccccctgga

SEQ ID NO: 16737 - DNA, 35 bp, Artificial Sequence
  Synthetic oligonucleotide
gtcctgtgctctgtttcccgtctcgcatgttccat

SEQ ID NO: 16738 - DNA, 36 bp, Artificial Sequence
  Synthetic oligonucleotide
tgctcgctccctgctacagccttcccctagagcaaa

SEQ ID NO: 16739 - DNA, 36 bp, Artificial Sequence
  Synthetic oligonucleotide
tgccttaccgccggtttacctgtccatccacccaca

SEQ ID NO: 16740 - DNA, 35 bp, Artificial Sequence
  Synthetic oligonucleotide
tgccctgcccaacacgcaccgcacagaacccgaca

SEQ ID NO: 16741 - DNA, 36 bp, Artificial Sequence
  Synthetic oligonucleotide
aactggaggtgggggcgatacatggaggtgggggta

SEQ ID NO: 16742 - DNA, 35 bp, Artificial Sequence
  Synthetic oligonucleotide
gatcacgccgtaattgacctacagccacgaaaaag

SEQ ID NO: 16743 - DNA, 34 bp, Artificial Sequence
  Synthetic oligonucleotide
gcgccctcgacacacgttttcctacccgccttgg

SEQ ID NO: 16744 - DNA, 36 bp, Artificial Sequence
  Synthetic oligonucleotide
aacgcaccgctacagcgcctttatatttacctccca

SEQ ID NO: 16745 - DNA, 37 bp, Artificial Sequence
  Synthetic oligonucleotide
ttcgcagccggaccgcatcccgcctcccacacgttga

SEQ ID NO: 16746 - DNA, 35 bp, Artificial Sequence
  Synthetic oligonucleotide
tccatcaatccgtcggactatatgcctccctgtta

SEQ ID NO: 16747 - DNA, 35 bp, Artificial Sequence
  Synthetic oligonucleotide
gtcaactcctgaataggtaacccgccctaccaatc

SEQ ID NO: 16748 - DNA, 35 bp, Artificial Sequence
  Synthetic oligonucleotide
tgaccacccgtttttgcatattttgtcctaatatc

SEQ ID NO: 16749 - DNA, 35 bp, Artificial Sequence
  Synthetic oligonucleotide
accaatcagagcatggaaggggcggatggatgggg

SEQ ID NO: 16750 - DNA, 35 bp, Artificial Sequence
  Synthetic oligonucleotide
gtaccgggaagagtagagcgggaatagagggtggg

SEQ ID NO: 16751 - DNA, 36 bp, Artificial Sequence
  Synthetic oligonucleotide
agctcaacgccgcaccacctagcgaccgcccgtaca

SEQ ID NO: 16752 - DNA, 35 bp, Artificial Sequence
  Synthetic oligonucleotide
tcccccattcgcacccctccagaggaatgtcccga

SEQ ID NO: 16753 - DNA, 36 bp, Artificial Sequence
  Synthetic oligonucleotide
tgtccttccatacggctcatgtcacatccttcccga

SEQ ID NO: 16754 - DNA, 38 bp, Artificial Sequence
  Synthetic oligonucleotide
ttgactcactccatatgcattggcccacagtattatga

SEQ ID NO: 16755 - DNA, 38 bp, Artificial Sequence
  Synthetic oligonucleotide
gccaccacaataggtcttcgcaggccgttccctgctga

SEQ ID NO: 16756 - DNA, 38 bp, Artificial Sequence
  Synthetic oligonucleotide
taccacgaccaccgacatggtgccgccctgttccttga

SEQ ID NO: 16757 - DNA, 35 bp, Artificial Sequence
  Synthetic oligonucleotide
gacacgaccggctctctctttctgaatcaactagg

SEQ ID NO: 16758 - DNA, 35 bp, Artificial Sequence
  Synthetic oligonucleotide
cacgtaccaccgcgggcgccacggatcacttcact

SEQ ID NO: 16759 - DNA, 36 bp, Artificial Sequence
  Synthetic oligonucleotide
tgcataacatctgtcttcacgcccatcccagctcga

SEQ ID NO: 16760 - DNA, 35 bp, Artificial Sequence
  Synthetic oligonucleotide
tccgctcactcggttatccatcaatcacagtggcc

SEQ ID NO: 16761 - DNA, 36 bp, Artificial Sequence
  Synthetic oligonucleotide
gtatgaccctgtcctgagcctgcctaccctgctaca

SEQ ID NO: 16762 - DNA, 35 bp, Artificial Sequence
  Synthetic oligonucleotide
tcccgtccacagtcgcgtgtcatgctttcgccctc

SEQ ID NO: 16763 - DNA, 35 bp, Artificial Sequence
  Synthetic oligonucleotide
gtccacgctggtggctgtgcgccaaggctcccttt

SEQ ID NO: 16764 - DNA, 35 bp, Artificial Sequence
  Synthetic oligonucleotide
acccacggtacgtacgatttagcaccatctcataa

SEQ ID NO: 16765 - DNA, 35 bp, Artificial Sequence
  Synthetic oligonucleotide
gaccccagtcaggttggtcttgcctgcccctccca

SEQ ID NO: 16766 - DNA, 38 bp, Artificial Sequence
  Synthetic oligonucleotide
tcagcttatgcccccgagtcttaacgccaccaccttga

SEQ ID NO: 16767 - DNA, 35 bp, Artificial Sequence
  Synthetic oligonucleotide
acagcgcatccggcgacctaaattccgagctgaca

SEQ ID NO: 16768 - DNA, 36 bp, Artificial Sequence
  Synthetic oligonucleotide
tccgagcctcccctttggtattccaagaacttgcca

SEQ ID NO: 16769 - DNA, 38 bp, Artificial Sequence
  Synthetic oligonucleotide
ttcgccgaccgccttttcctcatacgagtgccatctga

SEQ ID NO: 16770 - DNA, 35 bp, Artificial Sequence
  Synthetic oligonucleotide
gtacactcgtcattggcgcctgtccccctgctacc

SEQ ID NO: 16771 - DNA, 35 bp, Artificial Sequence
  Synthetic oligonucleotide
gtacaccacacgtactgaatcggttctatgtaccc

SEQ ID NO: 16772 - DNA, 35 bp, Artificial Sequence
  Synthetic oligonucleotide
ggaggggtggggggaccaagggtggcgttggtggc

SEQ ID NO: 16773 - DNA, 35 bp, Artificial Sequence
  Synthetic oligonucleotide
gtggaagagaacagaggggataggcaggtagatat

SEQ ID NO: 16774 - DNA, 35 bp, Artificial Sequence
  Synthetic oligonucleotide
atccccgcctacagagccccgatagccattttgaa

SEQ ID NO: 16775 - DNA, 36 bp, Artificial Sequence
  Synthetic oligonucleotide
gagcactacccacgactcgtcccacttgctgctaca

SEQ ID NO: 16776 - DNA, 35 bp, Artificial Sequence
  Synthetic oligonucleotide
gacactgccttgtacgtacccgtaccattttgatc

SEQ ID NO: 16777 - DNA, 34 bp, Artificial Sequence
  Synthetic oligonucleotide
aagccgcactctagtctcgcctagcacctctacg

SEQ ID NO: 16778 - DNA, 36 bp, Artificial Sequence
  Synthetic oligonucleotide
ggtccccagccgagttatgaaaaacgcacccacaca

SEQ ID NO: 16779 - DNA, 36 bp, Artificial Sequence
  Synthetic oligonucleotide
gagcactctgcccgaacttaacaacctactgctgca

SEQ ID NO: 16780 - DNA, 36 bp, Artificial Sequence
  Synthetic oligonucleotide
tcaacgtgcttagacgcgttacccccgttattcgta

SEQ ID NO: 16781 - DNA, 35 bp, Artificial Sequence
  Synthetic oligonucleotide
tctcgtcgcacggtacgattctcccactcgctccc

SEQ ID NO: 16782 - DNA, 35 bp, Artificial Sequence
  Synthetic oligonucleotide
gctcagccgcccggactgccgtactgccctgtttc

SEQ ID NO: 16783 - DNA, 35 bp, Artificial Sequence
  Synthetic oligonucleotide
ttcgtcgaaaggggggcaatgggaggtcggtggtt

SEQ ID NO: 16784 - DNA, 35 bp, Artificial Sequence
  Synthetic oligonucleotide
gccgcgctgtattcacctgcctcgactccccgaaa

SEQ ID NO: 16785 - DNA, 37 bp, Artificial Sequence
  Synthetic oligonucleotide
gggagggtgacgggaaaaagtgctaggtagggaagga

SEQ ID NO: 16786 - DNA, 35 bp, Artificial Sequence
  Synthetic oligonucleotide
gtacaccacctttagtgcctaacctgtaggatctc

SEQ ID NO: 16787 - DNA, 35 bp, Artificial Sequence
  Synthetic oligonucleotide
gatccgtcagatcccactccacgttaaccactctc

SEQ ID NO: 16788 - DNA, 35 bp, Artificial Sequence
  Synthetic oligonucleotide
gacggtagccctccaagatctagtcctgctttctc

SEQ ID NO: 16789 - DNA, 35 bp, Artificial Sequence
  Synthetic oligonucleotide
tacctatcgcggttgagataatccgccgtaacttt

SEQ ID NO: 16790 - DNA, 38 bp, Artificial Sequence
  Synthetic oligonucleotide
accaccttagcgatgacaccgctgacctctccacatga

SEQ ID NO: 16791 - DNA, 37 bp, Artificial Sequence
  Synthetic oligonucleotide
atgtggccgctgccgactccttatattgcactcctga

SEQ ID NO: 16792 - DNA, 36 bp, Artificial Sequence
  Synthetic oligonucleotide
actcccaacgcatttccgtatcctcgccaaggtata

SEQ ID NO: 16793 - DNA, 35 bp, Artificial Sequence
  Synthetic oligonucleotide
tctgttcccacctctcgcgacgtcaccagccgtgc

SEQ ID NO: 16794 - DNA, 35 bp, Artificial Sequence
  Synthetic oligonucleotide
tgagaacccctgccgctcgtacgcgaaaaaacttc

SEQ ID NO: 16795 - DNA, 35 bp, Artificial Sequence
  Synthetic oligonucleotide
tcctaacctacagactggtcataacccccacttct

SEQ ID NO: 16796 - DNA, 36 bp, Artificial Sequence
  Synthetic oligonucleotide
ttcagacccatcaggcgcatccattccattccacaa

SEQ ID NO: 16797 - DNA, 38 bp, Artificial Sequence
  Synthetic oligonucleotide
gctagagggtggaaggggtaagtgggcgcccggcatga

SEQ ID NO: 16798 - DNA, 35 bp, Artificial Sequence
  Synthetic oligonucleotide
ttgcatcccgccgttgcgtttcacagctatttgcc

SEQ ID NO: 16799 - DNA, 35 bp, Artificial Sequence
  Synthetic oligonucleotide
agctaccaccccgtttcaacgcctgatcctccatg

SEQ ID NO: 16800 - DNA, 38 bp, Artificial Sequence
  Synthetic oligonucleotide
gcgatatcgcacggatcgccactcctgcaccttgctga

SEQ ID NO: 16801 - DNA, 38 bp, Artificial Sequence
  Synthetic oligonucleotide
gtacgtgggggggttaagcttagcaggggtcggggtga

SEQ ID NO: 16802 - DNA, 38 bp, Artificial Sequence
  Synthetic oligonucleotide
tcgcatgccggacctgtacggccatccgcttttcttga

SEQ ID NO: 16803 - DNA, 36 bp, Artificial Sequence
  Synthetic oligonucleotide
gaacacacatagctgtgcgcccacttccttcccata

SEQ ID NO: 16804 - DNA, 35 bp, Artificial Sequence
  Synthetic oligonucleotide
taggacatgtctgacatttgcccactcccaccgta

SEQ ID NO: 16805 - DNA, 35 bp, Artificial Sequence
  Synthetic oligonucleotide
tgcttgctaccccattccatccgcccgttcctgta

SEQ ID NO: 16806 - DNA, 35 bp, Artificial Sequence
  Synthetic oligonucleotide
ggacatgacgcatgcttaacccctgctctgtttcc

SEQ ID NO: 16807 - DNA, 35 bp, Artificial Sequence
  Synthetic oligonucleotide
gtcactatgcattcgccacctcgtccaccctggtc

SEQ ID NO: 16808 - DNA, 35 bp, Artificial Sequence
  Synthetic oligonucleotide
gttaccccaccgtgctcctaccatgtcatattctt

SEQ ID NO: 16809 - DNA, 35 bp, Artificial Sequence
  Synthetic oligonucleotide
ttgtacgcaacgctacaatcctacacctccgcttt

SEQ ID NO: 16810 - DNA, 35 bp, Artificial Sequence
  Synthetic oligonucleotide
gatgtagcaccatgccggctcccactttcattttt

SEQ ID NO: 16811 - DNA, 35 bp, Artificial Sequence
  Synthetic oligonucleotide
tactccaagctccgaccctccacgtttatgttgcc

SEQ ID NO: 16812 - DNA, 35 bp, Artificial Sequence
  Synthetic oligonucleotide
gccatcgatcgtcaatattagtccctttcctcggc

SEQ ID NO: 16813 - DNA, 35 bp, Artificial Sequence
  Synthetic oligonucleotide
gattacgcccctctcattttgcctgacctagctat

SEQ ID NO: 16814 - DNA, 35 bp, Artificial Sequence
  Synthetic oligonucleotide
tttgcctcgcctatcctgcaagtgtctcatccact

SEQ ID NO: 16815 - DNA, 38 bp, Artificial Sequence
  Synthetic oligonucleotide
agtgcgcgagcccccatgatatgttctttccctgctga

SEQ ID NO: 16816 - DNA, 35 bp, Artificial Sequence
  Synthetic oligonucleotide
gttcgtggtgcaaacgcgcctcactcccgatatct

SEQ ID NO: 16817 - DNA, 36 bp, Artificial Sequence
  Synthetic oligonucleotide
tttgggcgagacaagggagaaagaagggcatagtaa

SEQ ID NO: 16818 - DNA, 38 bp, Artificial Sequence
  Synthetic oligonucleotide
ggaacagggtgcaggaggggatagacggcggagggtga

SEQ ID NO: 16819 - DNA, 35 bp, Artificial Sequence
  Synthetic oligonucleotide
gcctagccatatgccaccttgtccgcgccgcatgc

SEQ ID NO: 16820 - DNA, 36 bp, Artificial Sequence
  Synthetic oligonucleotide
acacgctgagacgtacacccatgtctagttcccaca

SEQ ID NO: 16821 - DNA, 35 bp, Artificial Sequence
  Synthetic oligonucleotide
aaagcgagggaaaacaccattgggggatagggaga

SEQ ID NO: 16822 - DNA, 37 bp, Artificial Sequence
  Synthetic oligonucleotide
tcgacatgtcctcgcgtcatcatccctcctctctgga

SEQ ID NO: 16823 - DNA, 36 bp, Artificial Sequence
  Synthetic oligonucleotide
acccaaacggcgtgacgtcggcttcaatcccatcta

SEQ ID NO: 16824 - DNA, 35 bp, Artificial Sequence
  Synthetic oligonucleotide
gttgagtcgaccgccccctgcaccccgatagtctt

SEQ ID NO: 16825 - DNA, 35 bp, Artificial Sequence
  Synthetic oligonucleotide
ttaggcgccctactctactgcctgttttgtccaca

SEQ ID NO: 16826 - DNA, 36 bp, Artificial Sequence
  Synthetic oligonucleotide
gccaatcgcgcactgttcaccatgtttctttctcca

SEQ ID NO: 16827 - DNA, 37 bp, Artificial Sequence
  Synthetic oligonucleotide
gcacgccgggtgggagggagggtccctttatcgcaga

SEQ ID NO: 16828 - DNA, 38 bp, Artificial Sequence
  Synthetic oligonucleotide
tcccaacttcacccatgtcgctcttacccggtctgtga

SEQ ID NO: 16829 - DNA, 35 bp, Artificial Sequence
  Synthetic oligonucleotide
ttatgtcctcacgctgtcctgacctccgacgcccc

SEQ ID NO: 16830 - DNA, 34 bp, Artificial Sequence
  Synthetic oligonucleotide
gaaccaaatggcccttgtcgcctgccatcatatc

SEQ ID NO: 16831 - DNA, 35 bp, Artificial Sequence
  Synthetic oligonucleotide
accgtcccgccggatcactttctgatctatccttg

SEQ ID NO: 16832 - DNA, 37 bp, Artificial Sequence
  Synthetic oligonucleotide
accgattccgttagcttaccatctgtacatcccttga

SEQ ID NO: 16833 - DNA, 35 bp, Artificial Sequence
  Synthetic oligonucleotide
accgtccgcccttttggttgtactttggccccccg

SEQ ID NO: 16834 - DNA, 36 bp, Artificial Sequence
  Synthetic oligonucleotide
aactgcacgcctgttctacctaccgttttacacaca

SEQ ID NO: 16835 - DNA, 36 bp, Artificial Sequence
  Synthetic oligonucleotide
atgacacccatagcacgctggccttcccatggatca

SEQ ID NO: 16836 - DNA, 37 bp, Artificial Sequence
  Synthetic oligonucleotide
gccgccatctcgacggtacctatccagccacacccga

SEQ ID NO: 16837 - DNA, 37 bp, Artificial Sequence
  Synthetic oligonucleotide
tccagcgggggaaggggtctcgtaatgtgcgggggga

SEQ ID NO: 16838 - DNA, 38 bp, Artificial Sequence
  Synthetic oligonucleotide
tccccaccgcctgggtgctgttcaacatattcatctga

SEQ ID NO: 16839 - DNA, 36 bp, Artificial Sequence
  Synthetic oligonucleotide
gggcaccctgtaccacctgcgcttaggccaccgcta

SEQ ID NO: 16840 - DNA, 35 bp, Artificial Sequence
  Synthetic oligonucleotide
gcgcttgctcgccgacccgacgcttcactagtttc

SEQ ID NO: 16841 - DNA, 35 bp, Artificial Sequence
  Synthetic oligonucleotide
gttgcacccaccatttactacacattagatcgact

SEQ ID NO: 16842 - DNA, 36 bp, Artificial Sequence
  Synthetic oligonucleotide
ttccgcacccagcccgactcgccgctgctactacga

SEQ ID NO: 16843 - DNA, 38 bp, Artificial Sequence
  Synthetic oligonucleotide
gtccccgccgcgggatttgcgccccttcccttgggtga

SEQ ID NO: 16844 - DNA, 35 bp, Artificial Sequence
  Synthetic oligonucleotide
gccaacctgatttgtcactcattccctccgttgtc

SEQ ID NO: 16845 - DNA, 36 bp, Artificial Sequence
  Synthetic oligonucleotide
tggaccaggaaggaggacacaaaagtggggttcaaa

SEQ ID NO: 16846 - DNA, 36 bp, Artificial Sequence
  Synthetic oligonucleotide
accctgaccttggttcgtatcatgccctcttggtga

SEQ ID NO: 16847 - DNA, 35 bp, Artificial Sequence
  Synthetic oligonucleotide
tcatgattccgctcctgcacgctgccatttcccac

SEQ ID NO: 16848 - DNA, 35 bp, Artificial Sequence
  Synthetic oligonucleotide
gcagtccgaccccgagcatgccgccgccattatat

SEQ ID NO: 16849 - DNA, 35 bp, Artificial Sequence
  Synthetic oligonucleotide
gatagcccggggcgtacccttatacatgcgatcct

SEQ ID NO: 16850 - DNA, 35 bp, Artificial Sequence
  Synthetic oligonucleotide
tctaagccgctcctcacacgccattcctgcaagaa

SEQ ID NO: 16851 - DNA, 35 bp, Artificial Sequence
  Synthetic oligonucleotide
aactcacagttaccgactatcatcgcccgttctca

SEQ ID NO: 16852 - DNA, 35 bp, Artificial Sequence
  Synthetic oligonucleotide
gcaaccattaggccctttctccgagagtcacttca

SEQ ID NO: 16853 - DNA, 35 bp, Artificial Sequence
  Synthetic oligonucleotide
tactcgcttaacatcctccacactgtacgggcacc

SEQ ID NO: 16854 - DNA, 35 bp, Artificial Sequence
  Synthetic oligonucleotide
ttgacttcgagcgccccctcacctcacacgtcccc

SEQ ID NO: 16855 - DNA, 35 bp, Artificial Sequence
  Synthetic oligonucleotide
gtgaccgccctagttctgcgtaccttgtctacgtc

SEQ ID NO: 16856 - DNA, 35 bp, Artificial Sequence
  Synthetic oligonucleotide
tacagccgcatctgttttctctcgtatcccggtcg

SEQ ID NO: 16857 - DNA, 35 bp, Artificial Sequence
  Synthetic oligonucleotide
ttcacccggaagcacgtctcggccccacctcccct

SEQ ID NO: 16858 - DNA, 35 bp, Artificial Sequence
  Synthetic oligonucleotide
tacatgctcccatgtcctagtaccgtagatcgccc

SEQ ID NO: 16859 - DNA, 35 bp, Artificial Sequence
  Synthetic oligonucleotide
gccggaccaggcgacactctagtcttttcgtctct

SEQ ID NO: 16860 - DNA, 35 bp, Artificial Sequence
  Synthetic oligonucleotide
gccgtctcacaccaaccctatgcattccatctggt

SEQ ID NO: 16861 - DNA, 37 bp, Artificial Sequence
  Synthetic oligonucleotide
gctgcggtggggttcaaagggcggtggggggttggga

SEQ ID NO: 16862 - DNA, 38 bp, Artificial Sequence
  Synthetic oligonucleotide
ttagtgccgccgtcttgtcccacgtcctccattcatga

SEQ ID NO: 16863 - DNA, 37 bp, Artificial Sequence
  Synthetic oligonucleotide
acaccacctccaatctctaccgatccagcgacaccga

SEQ ID NO: 16864 - DNA, 38 bp, Artificial Sequence
  Synthetic oligonucleotide
gagcgaagggagggcggtctgcagatagggggtgatga

SEQ ID NO: 16865 - DNA, 38 bp, Artificial Sequence
  Synthetic oligonucleotide
acacgatccatgtacgatcgtgatcagtctttttctga

SEQ ID NO: 16866 - DNA, 35 bp, Artificial Sequence
  Synthetic oligonucleotide
tgccaaccccttgtacttcgtaccctgattttcat

SEQ ID NO: 16867 - DNA, 36 bp, Artificial Sequence
  Synthetic oligonucleotide
acatccgccccggtgtcgttttttgttggttcgaaa

SEQ ID NO: 16868 - DNA, 37 bp, Artificial Sequence
  Synthetic oligonucleotide
gtcatcacctccttctcgtcagtccctcgcggggcga

SEQ ID NO: 16869 - DNA, 35 bp, Artificial Sequence
  Synthetic oligonucleotide
taccgagacgggaaaaaagggaatggctgtctggg

SEQ ID NO: 16870 - DNA, 37 bp, Artificial Sequence
  Synthetic oligonucleotide
acccccccctcatgcccatatggacacaagcttatga

SEQ ID NO: 16871 - DNA, 35 bp, Artificial Sequence
  Synthetic oligonucleotide
gttgcgcagattactctgctcataacacgctactc

SEQ ID NO: 16872 - DNA, 35 bp, Artificial Sequence
  Synthetic oligonucleotide
agcccgagccccaaggtccacgtaaacaaaatctc

SEQ ID NO: 16873 - DNA, 35 bp, Artificial Sequence
  Synthetic oligonucleotide
gcacaccacctctcaatgcgatgcatatcttttgg

SEQ ID NO: 16874 - DNA, 35 bp, Artificial Sequence
  Synthetic oligonucleotide
gctcaacgacccccggcgctagtaagggcctccct

SEQ ID NO: 16875 - DNA, 35 bp, Artificial Sequence
  Synthetic oligonucleotide
gaaccaccgggcaggtctcaccgctgccgccgcct

SEQ ID NO: 16876 - DNA, 35 bp, Artificial Sequence
  Synthetic oligonucleotide
tttccgcaatcgcccgtgcaccctccgatattctt

SEQ ID NO: 16877 - DNA, 37 bp, Artificial Sequence
  Synthetic oligonucleotide
tgcgacaccatttctctagtgcctgggccctctctga

SEQ ID NO: 16878 - DNA, 38 bp, Artificial Sequence
  Synthetic oligonucleotide
gtcgacactcgtggggggaaaggggatggagggtttga

SEQ ID NO: 16879 - DNA, 38 bp, Artificial Sequence
  Synthetic oligonucleotide
accaaccgccgaccgcctcctgcagtcaagaccgttta

SEQ ID NO: 16880 - DNA, 35 bp, Artificial Sequence
  Synthetic oligonucleotide
tcgcatcaggagcttaaaaacgcggccaccactcc

SEQ ID NO: 16881 - DNA, 35 bp, Artificial Sequence
  Synthetic oligonucleotide
gccgacaaccaccgcacccacgaccgctgcgctgc

SEQ ID NO: 16882 - DNA, 34 bp, Artificial Sequence
  Synthetic oligonucleotide
atcaccttcccaatatattgacccaatcaccatg

SEQ ID NO: 16883 - DNA, 37 bp, Artificial Sequence
  Synthetic oligonucleotide
agccaacgctactgcgtattatcgcttctttctcgga

SEQ ID NO: 16884 - DNA, 35 bp, Artificial Sequence
  Synthetic oligonucleotide
agacagggtggggggaggtgccaggagggggttag

SEQ ID NO: 16885 - DNA, 35 bp, Artificial Sequence
  Synthetic oligonucleotide
gccgtcggtggtactatcattcacttttcggtcat

SEQ ID NO: 16886 - DNA, 35 bp, Artificial Sequence
  Synthetic oligonucleotide
tatgcagactgtatcttgccggtatcttcctatct

SEQ ID NO: 16887 - DNA, 35 bp, Artificial Sequence
  Synthetic oligonucleotide
taagggggtacgaaggggtaggggtgtggtggttt

SEQ ID NO: 16888 - DNA, 35 bp, Artificial Sequence
  Synthetic oligonucleotide
tccaacggctcctgcatgagacgttgtttcatttt

SEQ ID NO: 16889 - DNA, 36 bp, Artificial Sequence
  Synthetic oligonucleotide
ttgacctgcacccgcgcccttgagctcgcacgacca

SEQ ID NO: 16890 - DNA, 35 bp, Artificial Sequence
  Synthetic oligonucleotide
gtccccctgcccccatccatcgcttggaaccgaga

SEQ ID NO: 16891 - DNA, 37 bp, Artificial Sequence
  Synthetic oligonucleotide
aagtacgcctgtgatttttcgtgcccatcctttccga

SEQ ID NO: 16892 - DNA, 38 bp, Artificial Sequence
  Synthetic oligonucleotide
tagaccacgccacacgcgccacccaatctactccgtga

SEQ ID NO: 16893 - DNA, 35 bp, Artificial Sequence
  Synthetic oligonucleotide
tgtaaacgctgtccgtattcgttccctctccacct

SEQ ID NO: 16894 - DNA, 35 bp, Artificial Sequence
  Synthetic oligonucleotide
atgacccactacaaagcttgctaggctccgaccct

SEQ ID NO: 16895 - DNA, 35 bp, Artificial Sequence
  Synthetic oligonucleotide
tcagcccactgcccccttacgatgcacgacgcctt

SEQ ID NO: 16896 - DNA, 36 bp, Artificial Sequence
  Synthetic oligonucleotide
gagccccccacctgaatgccctctaatgttcagcca

SEQ ID NO: 16897 - DNA, 37 bp, Artificial Sequence
  Synthetic oligonucleotide
tgtggctcaacacacctttctgcccccttcgtttgga

SEQ ID NO: 16898 - DNA, 36 bp, Artificial Sequence
  Synthetic oligonucleotide
gggtggacgggggagggagtgagtcggaatctcgta

SEQ ID NO: 16899 - DNA, 35 bp, Artificial Sequence
  Synthetic oligonucleotide
actgaatcacgaacgttaactgcccttgccatgcc

SEQ ID NO: 16900 - DNA, 37 bp, Artificial Sequence
  Synthetic oligonucleotide
gaagcgggggggttggcgtcacgaaaatcggcgggga

SEQ ID NO: 16901 - DNA, 38 bp, Artificial Sequence
  Synthetic oligonucleotide
tccaccgcgtgcctttaacactacaccccgactcctga

SEQ ID NO: 16902 - DNA, 35 bp, Artificial Sequence
  Synthetic oligonucleotide
aagcaaggaggagagcatggggcgggatattggta

SEQ ID NO: 16903 - DNA, 35 bp, Artificial Sequence
  Synthetic oligonucleotide
gcacgcctcgctccttgatagtaagttcactcgcc

SEQ ID NO: 16904 - DNA, 35 bp, Artificial Sequence
  Synthetic oligonucleotide
taatccagtgtcgtctgactccgcccatactgctc

SEQ ID NO: 16905 - DNA, 37 bp, Artificial Sequence
  Synthetic oligonucleotide
ccgcctgggggtaccaggccatcccctcttggaacga

SEQ ID NO: 16906 - DNA, 37 bp, Artificial Sequence
  Synthetic oligonucleotide
tactcactggcaaactgtattttggcttcaccctcga

SEQ ID NO: 16907 - DNA, 37 bp, Artificial Sequence
  Synthetic oligonucleotide
acacactacagacctcccttgcctcctccttcgggga

SEQ ID NO: 16908 - DNA, 38 bp, Artificial Sequence
  Synthetic oligonucleotide
gatgcatgccctctgttacacccgagtccctttggtga

SEQ ID NO: 16909 - DNA, 37 bp, Artificial Sequence
  Synthetic oligonucleotide
gtaggaagaccggatggatgatagggataggggttga

SEQ ID NO: 16910 - DNA, 36 bp, Artificial Sequence
  Synthetic oligonucleotide
ttcaccccactatcattgcccaacgagtaagtgcta

SEQ ID NO: 16911 - DNA, 35 bp, Artificial Sequence
  Synthetic oligonucleotide
ggagccacctaccacgtttgattattgttcgcttt

SEQ ID NO: 16912 - DNA, 35 bp, Artificial Sequence
  Synthetic oligonucleotide
ttgttacgccaagcccatgcattctgtctctccaa

SEQ ID NO: 16913 - DNA, 35 bp, Artificial Sequence
  Synthetic oligonucleotide
ccaaggcctcaagacacacttcgcttaccttccca

SEQ ID NO: 16914 - DNA, 35 bp, Artificial Sequence
  Synthetic oligonucleotide
agatccccaacccatgttcatcacccggcgttgcc

SEQ ID NO: 16915 - DNA, 35 bp, Artificial Sequence
  Synthetic oligonucleotide
acattccctctggccgttttgctgagcatctacgc

SEQ ID NO: 16916 - DNA, 36 bp, Artificial Sequence
  Synthetic oligonucleotide
atccactgcctgtcaattggtcctggtccctcacaa

SEQ ID NO: 16917 - DNA, 36 bp, Artificial Sequence
  Synthetic oligonucleotide
ggacacgttcccccgcagccgccccagttctcacaa

SEQ ID NO: 16918 - DNA, 37 bp, Artificial Sequence
  Synthetic oligonucleotide
gtaggggcagggcgtagtataggtggtgggatggaga

SEQ ID NO: 16919 - DNA, 35 bp, Artificial Sequence
  Synthetic oligonucleotide
tccctctcctggactatgacgctaatcttttttga

SEQ ID NO: 16920 - DNA, 35 bp, Artificial Sequence
  Synthetic oligonucleotide
acaaccatacgctcgcatgccttcgtactgcatac

SEQ ID NO: 16921 - DNA, 35 bp, Artificial Sequence
  Synthetic oligonucleotide
tgccaaactcaacactgaacaacactacgggggcc

SEQ ID NO: 16922 - DNA, 35 bp, Artificial Sequence
  Synthetic oligonucleotide
acccctcgttgcgcactccatatccggtcttcctg

SEQ ID NO: 16923 - DNA, 37 bp, Artificial Sequence
  Synthetic oligonucleotide
tccccctcaccatgtagctgcactctattttatgcga

SEQ ID NO: 16924 - DNA, 36 bp, Artificial Sequence
  Synthetic oligonucleotide
gatggtgagatgatgggcgcagggttgggaggggga

SEQ ID NO: 16925 - DNA, 38 bp, Artificial Sequence
  Synthetic oligonucleotide
gcacgcacggaaagaggggaaggctgaactcaatgtga

SEQ ID NO: 16926 - DNA, 35 bp, Artificial Sequence
  Synthetic oligonucleotide
gtgccactcctaccccgtattgcctcgaagactac

SEQ ID NO: 16927 - DNA, 35 bp, Artificial Sequence
  Synthetic oligonucleotide
agtacccgctacagcttgcacaccgtcccatatcc

SEQ ID NO: 16928 - DNA, 36 bp, Artificial Sequence
  Synthetic oligonucleotide
acacgcaatccacgcctcctagaggttcccttgcca

SEQ ID NO: 16929 - DNA, 35 bp, Artificial Sequence
  Synthetic oligonucleotide
tgatcacggcttgcttcgaccatcactcctgccta

SEQ ID NO: 16930 - DNA, 35 bp, Artificial Sequence
  Synthetic oligonucleotide
tatgctcctcgctcttgaagttcctgcatgcttta

SEQ ID NO: 16931 - DNA, 35 bp, Artificial Sequence
  Synthetic oligonucleotide
ttcaggacagcagccggccgctcatactgatcacc

SEQ ID NO: 16932 - DNA, 35 bp, Artificial Sequence
  Synthetic oligonucleotide
acccaccttagatcacaagcggtcaagcatctgcc

SEQ ID NO: 16933 - DNA, 35 bp, Artificial Sequence
  Synthetic oligonucleotide
atgaaccgcgcttatcgaatgggcgcgagaaatcc

SEQ ID NO: 16934 - DNA, 35 bp, Artificial Sequence
  Synthetic oligonucleotide
atggagccgcatcccctccccgagatacacgttat

SEQ ID NO: 16935 - DNA, 35 bp, Artificial Sequence
  Synthetic oligonucleotide
tccctgcggctaaatgcccacttacctatctttgt

SEQ ID NO: 16936 - DNA, 35 bp, Artificial Sequence
  Synthetic oligonucleotide
ttagggcttgctctgcatctgtcgccttttgccca

SEQ ID NO: 16937 - DNA, 36 bp, Artificial Sequence
  Synthetic oligonucleotide
atcgcccttcaccccactcttgagttagttcgctca

SEQ ID NO: 16938 - DNA, 37 bp, Artificial Sequence
  Synthetic oligonucleotide
tacacgcgtccgtcaccccccgagcacctgaattcga

SEQ ID NO: 16939 - DNA, 35 bp, Artificial Sequence
  Synthetic oligonucleotide
gatacctcctccgcaccacgaagtccgttatagga

SEQ ID NO: 16940 - DNA, 38 bp, Artificial Sequence
  Synthetic oligonucleotide
gcacgctaccggcccgctgctgaatcccacccgcttga

SEQ ID NO: 16941 - DNA, 35 bp, Artificial Sequence
  Synthetic oligonucleotide
tccatgatcgcgtcgtcctcggttttccgcccacg

SEQ ID NO: 16942 - DNA, 35 bp, Artificial Sequence
  Synthetic oligonucleotide
acccgttcaaccatcaccactgctagcctgactgg

SEQ ID NO: 16943 - DNA, 35 bp, Artificial Sequence
  Synthetic oligonucleotide
acccgaacaaacccgcatcctgagacagtagcgtt

SEQ ID NO: 16944 - DNA, 35 bp, Artificial Sequence
  Synthetic oligonucleotide
ttcgcaccgaccggtttctactgccactgattgaa

SEQ ID NO: 16945 - DNA, 35 bp, Artificial Sequence
  Synthetic oligonucleotide
gtcccgaagctccatgctcgctttccacacttgaa

SEQ ID NO: 16946 - DNA, 35 bp, Artificial Sequence
  Synthetic oligonucleotide
gtaccatcctcaacatatgattttgaaagctccac

SEQ ID NO: 16947 - DNA, 35 bp, Artificial Sequence
  Synthetic oligonucleotide
attggtcacgtacacgctcccagcctgtctgctcc

SEQ ID NO: 16948 - DNA, 35 bp, Artificial Sequence
  Synthetic oligonucleotide
tcgccaccttcgccaatgccatcagttttagctct

SEQ ID NO: 16949 - DNA, 36 bp, Artificial Sequence
  Synthetic oligonucleotide
atgactggaaggggtgtggtggcgggcaggtaaaca

SEQ ID NO: 16950 - DNA, 36 bp, Artificial Sequence
  Synthetic oligonucleotide
ggtaggcaatcagcccattcgcactcgttttcatca

SEQ ID NO: 16951 - DNA, 37 bp, Artificial Sequence
  Synthetic oligonucleotide
acaccaccgcgctggtgccattccagacgagaaacga

SEQ ID NO: 16952 - DNA, 37 bp, Artificial Sequence
  Synthetic oligonucleotide
acgactgtgccttatttttgccttcacccttacgcga

SEQ ID NO: 16953 - DNA, 37 bp, Artificial Sequence
  Synthetic oligonucleotide
gtgctgatgcaccggtgatgggggggtagtggtgtga

SEQ ID NO: 16954 - DNA, 36 bp, Artificial Sequence
  Synthetic oligonucleotide
tcagggggggagggattaacgattgtgggcccacga

SEQ ID NO: 16955 - DNA, 36 bp, Artificial Sequence
  Synthetic oligonucleotide
atcccgcccgtgctacgttcacttctgacttgaata

SEQ ID NO: 16956 - DNA, 35 bp, Artificial Sequence
  Synthetic oligonucleotide
tgttggggagtacgataggggggagggaattggtg

SEQ ID NO: 16957 - DNA, 36 bp, Artificial Sequence
  Synthetic oligonucleotide
gtgacttccacagccggtgctccccacatggttaca

SEQ ID NO: 16958 - DNA, 36 bp, Artificial Sequence
  Synthetic oligonucleotide
aaaacgccactgactgcccgctcctgtctcgcacca

SEQ ID NO: 16959 - DNA, 36 bp, Artificial Sequence
  Synthetic oligonucleotide
gcaagccccatcttcgtaacagtctcttttggctca

SEQ ID NO: 16960 - DNA, 36 bp, Artificial Sequence
  Synthetic oligonucleotide
acgctcgtcagcatggctccatttccctccacttca

SEQ ID NO: 16961 - DNA, 37 bp, Artificial Sequence
  Synthetic oligonucleotide
acccacccacttcaatgtttcattgtgactcatacga

SEQ ID NO: 16962 - DNA, 35 bp, Artificial Sequence
  Synthetic oligonucleotide
ggaccccgaccgtgatctcgcagcattctatttag

SEQ ID NO: 16963 - DNA, 35 bp, Artificial Sequence
  Synthetic oligonucleotide
acattccatccttccgtattcgtgcccaaagggct

SEQ ID NO: 16964 - DNA, 35 bp, Artificial Sequence
  Synthetic oligonucleotide
ttgactcttgcctgtgccacctgataaccgctcca

SEQ ID NO: 16965 - DNA, 35 bp, Artificial Sequence
  Synthetic oligonucleotide
tcccgctagcttaccacatctctcttgccgtgcga

SEQ ID NO: 16966 - DNA, 37 bp, Artificial Sequence
  Synthetic oligonucleotide
tgcacgcaccaccatcatttgcacgtcaggagcatga

SEQ ID NO: 16967 - DNA, 38 bp, Artificial Sequence
  Synthetic oligonucleotide
ttcccctcacttgctctatcgcctgttgccattcgtga

SEQ ID NO: 16968 - DNA, 38 bp, Artificial Sequence
  Synthetic oligonucleotide
gtcgcctccgccgctctggcacttttacgacctcttga

SEQ ID NO: 16969 - DNA, 35 bp, Artificial Sequence
  Synthetic oligonucleotide
actccgccgctcaatcagttctccggccgctacac

SEQ ID NO: 16970 - DNA, 35 bp, Artificial Sequence
  Synthetic oligonucleotide
tgctacacacctccatttttgtgttcactacctcc

SEQ ID NO: 16971 - DNA, 35 bp, Artificial Sequence
  Synthetic oligonucleotide
gccaccccccatcgccgatatttaggctaattatg

SEQ ID NO: 16972 - DNA, 37 bp, Artificial Sequence
  Synthetic oligonucleotide
gcccctccctacacatgcttccacgtcttcacgtaga

SEQ ID NO: 16973 - DNA, 35 bp, Artificial Sequence
  Synthetic oligonucleotide
tctaccgccgctttcctcccttattgggtaccttt

SEQ ID NO: 16974 - DNA, 35 bp, Artificial Sequence
  Synthetic oligonucleotide
tacttccgcggcctttctgtctcctcggcgaccct

SEQ ID NO: 16975 - DNA, 35 bp, Artificial Sequence
  Synthetic oligonucleotide
tccgcgttcgaagtgcagctacacgccctctacca

SEQ ID NO: 16976 - DNA, 36 bp, Artificial Sequence
  Synthetic oligonucleotide
gtgctctcaacgcgtgtccttatcgttcgccactca

SEQ ID NO: 16977 - DNA, 35 bp, Artificial Sequence
  Synthetic oligonucleotide
aatgcaccatttccccttactcgcgtatttgctcc

SEQ ID NO: 16978 - DNA, 35 bp, Artificial Sequence
  Synthetic oligonucleotide
aatcccggccgtggtaaccgttcttagcgctgcct

SEQ ID NO: 16979 - DNA, 37 bp, Artificial Sequence
  Synthetic oligonucleotide
gacgcgcagactaccctaccccgcagcctcccttgga

SEQ ID NO: 16980 - DNA, 36 bp, Artificial Sequence
  Synthetic oligonucleotide
accacgactcgcccgtgcggaaccgcccccaatcta

SEQ ID NO: 16981 - DNA, 36 bp, Artificial Sequence
  Synthetic oligonucleotide
gcctgttccctgcctcaccgtgcgtccaaaccatta

SEQ ID NO: 16982 - DNA, 35 bp, Artificial Sequence
  Synthetic oligonucleotide
gcaacaaacccgtctttttacagacaccgtactac

SEQ ID NO: 16983 - DNA, 35 bp, Artificial Sequence
  Synthetic oligonucleotide
tgtccccccccggcaagagcagtgctggtgctccc

SEQ ID NO: 16984 - DNA, 35 bp, Artificial Sequence
  Synthetic oligonucleotide
gttccacccagcacttaccactgagcaacacaagt

SEQ ID NO: 16985 - DNA, 35 bp, Artificial Sequence
  Synthetic oligonucleotide
gccaccactcagtccaaccccacgacgcgtttatt

SEQ ID NO: 16986 - DNA, 37 bp, Artificial Sequence
  Synthetic oligonucleotide
actgcctccagtgccgttcgcagccctctcaacccga

SEQ ID NO: 16987 - DNA, 37 bp, Artificial Sequence
  Synthetic oligonucleotide
atgagggaaatgacgaaaggggtggaccggtggggga

SEQ ID NO: 16988 - DNA, 37 bp, Artificial Sequence
  Synthetic oligonucleotide
ttactcgacagaggaggggggactgggtagggaatga

SEQ ID NO: 16989 - DNA, 38 bp, Artificial Sequence
  Synthetic oligonucleotide
gctacactgccgttgtaaagcgccttcccctcggttga

SEQ ID NO: 16990 - DNA, 35 bp, Artificial Sequence
  Synthetic oligonucleotide
agccccactagaaacggtcatgcctgcctgctctg

SEQ ID NO: 16991 - DNA, 36 bp, Artificial Sequence
  Synthetic oligonucleotide
attcgcgtgcccatccccacggtccgctaccccaca

SEQ ID NO: 16992 - DNA, 35 bp, Artificial Sequence
  Synthetic oligonucleotide
tgtgacctcctccctatccgcgctgctccagtcac

SEQ ID NO: 16993 - DNA, 35 bp, Artificial Sequence
  Synthetic oligonucleotide
accactcctagtaggtcctgactgtttcttacgcc

SEQ ID NO: 16994 - DNA, 35 bp, Artificial Sequence
  Synthetic oligonucleotide
gccctgccgaacatagcccgcgattgcacttgctc

SEQ ID NO: 16995 - DNA, 35 bp, Artificial Sequence
  Synthetic oligonucleotide
accacggtctgataactcgtctttttgtctccctg

SEQ ID NO: 16996 - DNA, 35 bp, Artificial Sequence
  Synthetic oligonucleotide
ttgccacatcactatcacgctgcttccgtaccttg

SEQ ID NO: 16997 - DNA, 35 bp, Artificial Sequence
  Synthetic oligonucleotide
tgcgccacacctgcacccattagtcccccgaattt

SEQ ID NO: 16998 - DNA, 37 bp, Artificial Sequence
  Synthetic oligonucleotide
ttctgctacactggtagcccctgccatcactgcccga

SEQ ID NO: 16999 - DNA, 37 bp, Artificial Sequence
  Synthetic oligonucleotide
atgtggtgttggccacgtcctgtcttctgcctttcga

SEQ ID NO: 17000 - DNA, 36 bp, Artificial Sequence
  Synthetic oligonucleotide
tcaagagggggcgtaggaggagggaaggtggcggta

SEQ ID NO: 17001 - DNA, 36 bp, Artificial Sequence
  Synthetic oligonucleotide
aaacgagtggggttggagttggcgataggggaaatg

SEQ ID NO: 17002 - DNA, 35 bp, Artificial Sequence
  Synthetic oligonucleotide
ttcgcgagcgagggagaattgcggtgagggttatg

SEQ ID NO: 17003 - DNA, 35 bp, Artificial Sequence
  Synthetic oligonucleotide
ccacgccccacttgcaacattagcaccacactttg

SEQ ID NO: 17004 - DNA, 36 bp, Artificial Sequence
  Synthetic oligonucleotide
acattcgccacgcgccatctctgcatgaccctcgca

SEQ ID NO: 17005 - DNA, 37 bp, Artificial Sequence
  Synthetic oligonucleotide
gacaaacagcgggggggggaaacgtacggaggtatga

SEQ ID NO: 17006 - DNA, 37 bp, Artificial Sequence
  Synthetic oligonucleotide
ttaagcacgttccctgcttggtctgcctcacctttga

SEQ ID NO: 17007 - DNA, 35 bp, Artificial Sequence
  Synthetic oligonucleotide
caccttcgcatgcccacaagtaaccgacccggaac

SEQ ID NO: 17008 - DNA, 35 bp, Artificial Sequence
  Synthetic oligonucleotide
tgatgcagtagcaccactgttgaacgccttgtttc

SEQ ID NO: 17009 - DNA, 35 bp, Artificial Sequence
  Synthetic oligonucleotide
ggtagtaaggaaaggcaaaatagggaagggaaacg

SEQ ID NO: 17010 - DNA, 35 bp, Artificial Sequence
  Synthetic oligonucleotide
tgaccacgttctcctcacttcacacaacttctcca

SEQ ID NO: 17011 - DNA, 35 bp, Artificial Sequence
  Synthetic oligonucleotide
tgttcgacgtacgcaatgatcggcccacccttcta

SEQ ID NO: 17012 - DNA, 36 bp, Artificial Sequence
  Synthetic oligonucleotide
gccacctccatgcctgtatccgtattctcttgctta

SEQ ID NO: 17013 - DNA, 35 bp, Artificial Sequence
  Synthetic oligonucleotide
agcctccatgcacaacagacgcgaaacacccttcc

SEQ ID NO: 17014 - DNA, 34 bp, Artificial Sequence
  Synthetic oligonucleotide
ttcaagcctgcctgttcgtccaaaccacaaccaa

SEQ ID NO: 17015 - DNA, 37 bp, Artificial Sequence
  Synthetic oligonucleotide
tcaacgccctcctggcgatcccatccgtcgctctcga

SEQ ID NO: 17016 - DNA, 35 bp, Artificial Sequence
  Synthetic oligonucleotide
gcaacccaccagtagccacgtccgttgatctcccc

SEQ ID NO: 17017 - DNA, 36 bp, Artificial Sequence
  Synthetic oligonucleotide
aagcatggtcgctgcctcacacccccgtagtccgca

SEQ ID NO: 17018 - DNA, 37 bp, Artificial Sequence
  Synthetic oligonucleotide
gcactcaagggggaaggaactagggtccaacaggtga

SEQ ID NO: 17019 - DNA, 35 bp, Artificial Sequence
  Synthetic oligonucleotide
taacatccccaacactggcttcaggaccggtaggc

SEQ ID NO: 17020 - DNA, 35 bp, Artificial Sequence
  Synthetic oligonucleotide
tgacgccctgccttcccgtctttatgattggtccg

SEQ ID NO: 17021 - DNA, 34 bp, Artificial Sequence
  Synthetic oligonucleotide
gtgacgtgggataactacttggcaccatcctttt

SEQ ID NO: 17022 - DNA, 35 bp, Artificial Sequence
  Synthetic oligonucleotide
tatgcgcgtacctaggttttgtctgcggctttcca

SEQ ID NO: 17023 - DNA, 35 bp, Artificial Sequence
  Synthetic oligonucleotide
gaaacaaccgaacaaaggagaatgaagggtaaagt

SEQ ID NO: 17024 - DNA, 35 bp, Artificial Sequence
  Synthetic oligonucleotide
atccactcactaactgcattttactgactttagca

SEQ ID NO: 17025 - DNA, 38 bp, Artificial Sequence
  Synthetic oligonucleotide
gctcacctcacacggggtaatctcggtcccaaccttga

SEQ ID NO: 17026 - DNA, 36 bp, Artificial Sequence
  Synthetic oligonucleotide
atgcgatcgggccagtttttgcgcatcatactccta

SEQ ID NO: 17027 - DNA, 35 bp, Artificial Sequence
  Synthetic oligonucleotide
gctgtcccgtcattggcttgttttttctgtccccg

SEQ ID NO: 17028 - DNA, 34 bp, Artificial Sequence
  Synthetic oligonucleotide
gttgcacatctgtccccctcgcaggttcctacgt

SEQ ID NO: 17029 - DNA, 36 bp, Artificial Sequence
  Synthetic oligonucleotide
tgtgatgagaggtcggtggggggagtccaagggcaa

SEQ ID NO: 17030 - DNA, 36 bp, Artificial Sequence
  Synthetic oligonucleotide
gacgcactgctcgtcctcaatttcaccttctgcgca

SEQ ID NO: 17031 - DNA, 37 bp, Artificial Sequence
  Synthetic oligonucleotide
tgcaccccatcccactcgccccacctcggttggtgga

SEQ ID NO: 17032 - DNA, 38 bp, Artificial Sequence
  Synthetic oligonucleotide
acagaatggccaagtggggtaaagtgggttggggttga

SEQ ID NO: 17033 - DNA, 37 bp, Artificial Sequence
  Synthetic oligonucleotide
gtaccctcacatcgacagcagccgttgtaccttccga

SEQ ID NO: 17034 - DNA, 37 bp, Artificial Sequence
  Synthetic oligonucleotide
atccgcgcccaatgttttccctgctgcgaacccctga

SEQ ID NO: 17035 - DNA, 38 bp, Artificial Sequence
  Synthetic oligonucleotide
gacgctggtcagcctatatcttgcccctgctcatgtga

SEQ ID NO: 17036 - DNA, 35 bp, Artificial Sequence
  Synthetic oligonucleotide
gatgcctacgcgagtgcactaactccttatatacc

SEQ ID NO: 17037 - DNA, 36 bp, Artificial Sequence
  Synthetic oligonucleotide
tcatcgtacaccttatagggcctcccccgcctcgcc

SEQ ID NO: 17038 - DNA, 35 bp, Artificial Sequence
  Synthetic oligonucleotide
tcacgcacatccgttctttgggcctgggaaattgc

SEQ ID NO: 17039 - DNA, 35 bp, Artificial Sequence
  Synthetic oligonucleotide
tccgccctacaccattttaccgagcataaacaccg

SEQ ID NO: 17040 - DNA, 35 bp, Artificial Sequence
  Synthetic oligonucleotide
tccacgcccgtactagcatttcacagacctctcat

SEQ ID NO: 17041 - DNA, 37 bp, Artificial Sequence
  Synthetic oligonucleotide
gccatgtcacatctcgtgctaactcgccaccaatgga

SEQ ID NO: 17042 - DNA, 38 bp, Artificial Sequence
  Synthetic oligonucleotide
accgccccgcagatagctttctttttgctccccattga

SEQ ID NO: 17043 - DNA, 35 bp, Artificial Sequence
  Synthetic oligonucleotide
gcgaacgccatggacgttcggttaactggcccacc

SEQ ID NO: 17044 - DNA, 35 bp, Artificial Sequence
  Synthetic oligonucleotide
gacccgcttacttgtccacagcgatgtttcacccc

SEQ ID NO: 17045 - DNA, 35 bp, Artificial Sequence
  Synthetic oligonucleotide
tcacccgttagggcgttttttcactttactatgtc

SEQ ID NO: 17046 - DNA, 32 bp, Artificial Sequence
  Synthetic oligonucleotide
ttatgcccatcgtgctttgttgtcttttctcg

SEQ ID NO: 17047 - DNA, 35 bp, Artificial Sequence
  Synthetic oligonucleotide
gccatacaaccaatggtttaatccttccatcccat

SEQ ID NO: 17048 - DNA, 36 bp, Artificial Sequence
  Synthetic oligonucleotide
tcaccgcgtgctattcgtcgcatacaccagccccaa

SEQ ID NO: 17049 - DNA, 37 bp, Artificial Sequence
  Synthetic oligonucleotide
gtgcctccctctgctcttcatagtacctgtgaaccga

SEQ ID NO: 17050 - DNA, 37 bp, Artificial Sequence
  Synthetic oligonucleotide
ttagcccccacgaaccggaaccccaggcctacacgga

SEQ ID NO: 17051 - DNA, 37 bp, Artificial Sequence
  Synthetic oligonucleotide
gcgtagggtggttgaggggatgacggggactagggga

SEQ ID NO: 17052 - DNA, 38 bp, Artificial Sequence
  Synthetic oligonucleotide
gagcaacatgcactacgccacacgccaatcgtacctga

SEQ ID NO: 17053 - DNA, 38 bp, Artificial Sequence
  Synthetic oligonucleotide
atgggagggagaagggaagtggtccacctgttgggtga

SEQ ID NO: 17054 - DNA, 35 bp, Artificial Sequence
  Synthetic oligonucleotide
tatcactacctgccctgacactggtgaacacacgc

SEQ ID NO: 17055 - DNA, 35 bp, Artificial Sequence
  Synthetic oligonucleotide
gatgaccccattgcacgtcatcgcgcccctcttcg

SEQ ID NO: 17056 - DNA, 36 bp, Artificial Sequence
  Synthetic oligonucleotide
aaccacgccggcaactagcacactaaaccacctcga

SEQ ID NO: 17057 - DNA, 37 bp, Artificial Sequence
  Synthetic oligonucleotide
atccagtcccaatcgcactttcgtcatccatttcgga

SEQ ID NO: 17058 - DNA, 35 bp, Artificial Sequence
  Synthetic oligonucleotide
gccataccacccgatgaatattaacacacccgtat

SEQ ID NO: 17059 - DNA, 35 bp, Artificial Sequence
  Synthetic oligonucleotide
accaggacgtcgcccgttacttaggcctcttttgt

SEQ ID NO: 17060 - DNA, 35 bp, Artificial Sequence
  Synthetic oligonucleotide
gccccgccaatccgacaatatgcagctgccccgtt

SEQ ID NO: 17061 - DNA, 36 bp, Artificial Sequence
  Synthetic oligonucleotide
gcctgacccccgcgccacactatgaatcgtttcgaa

SEQ ID NO: 17062 - DNA, 36 bp, Artificial Sequence
  Synthetic oligonucleotide
tgcctgcctccggagcaatcatcttgttcaccttca

SEQ ID NO: 17063 - DNA, 38 bp, Artificial Sequence
  Synthetic oligonucleotide
aagccatgccgccggttcctatcatacgcctcaactga

SEQ ID NO: 17064 - DNA, 38 bp, Artificial Sequence
  Synthetic oligonucleotide
gtcccccgctaacacttaccacgcccagcctgccgtga

SEQ ID NO: 17065 - DNA, 35 bp, Artificial Sequence
  Synthetic oligonucleotide
tctccggtcaaccttgcgtgcctctccttttgccg

SEQ ID NO: 17066 - DNA, 36 bp, Artificial Sequence
  Synthetic oligonucleotide
ttccgtatcaccagttagctcttattcccaggttca

SEQ ID NO: 17067 - DNA, 37 bp, Artificial Sequence
  Synthetic oligonucleotide
ttgcgcacacatggctacgttgtccctcctcaatcga

SEQ ID NO: 17068 - DNA, 36 bp, Artificial Sequence
  Synthetic oligonucleotide
tatgcacaccacaccgtctacaacgctcccgtccta

SEQ ID NO: 17069 - DNA, 35 bp, Artificial Sequence
  Synthetic oligonucleotide
atgccctcctctgcaacagccacgcttattgtctg

SEQ ID NO: 17070 - DNA, 35 bp, Artificial Sequence
  Synthetic oligonucleotide
gttctccctcccttcgcaccccaggctccctcgtg

SEQ ID NO: 17071 - DNA, 35 bp, Artificial Sequence
  Synthetic oligonucleotide
atcacccgccctattatggactatgacgtcctaat

SEQ ID NO: 17072 - DNA, 35 bp, Artificial Sequence
  Synthetic oligonucleotide
ttccagtgccgcattcctcgcatctatcccgttct

SEQ ID NO: 17073 - DNA, 36 bp, Artificial Sequence
  Synthetic oligonucleotide
ttcccatcccgcctcgcaaccacgcctaaaaagaca

SEQ ID NO: 17074 - DNA, 36 bp, Artificial Sequence
  Synthetic oligonucleotide
gaaaggtgaggtgggggcacgcatacaggggcggga

SEQ ID NO: 17075 - DNA, 36 bp, Artificial Sequence
  Synthetic oligonucleotide
gacgtcctagcacctgtaacgccactccgaaactta

SEQ ID NO: 17076 - DNA, 35 bp, Artificial Sequence
  Synthetic oligonucleotide
actcacgacacaactgccctatgggatgcacttac

SEQ ID NO: 17077 - DNA, 35 bp, Artificial Sequence
  Synthetic oligonucleotide
gagtcgccggacctgtaattcactcccactgtggc

SEQ ID NO: 17078 - DNA, 35 bp, Artificial Sequence
  Synthetic oligonucleotide
tatcgctccatccttcaccgcctgatcccatttag

SEQ ID NO: 17079 - DNA, 35 bp, Artificial Sequence
  Synthetic oligonucleotide
tagaccacattatccatcctccgaccacagaggcg

SEQ ID NO: 17080 - DNA, 35 bp, Artificial Sequence
  Synthetic oligonucleotide
tacgagacctccgagctctaaaacgctgccccctg

SEQ ID NO: 17081 - DNA, 35 bp, Artificial Sequence
  Synthetic oligonucleotide
gacactcctctgagcgatgattttccttacgttgt

SEQ ID NO: 17082 - DNA, 35 bp, Artificial Sequence
  Synthetic oligonucleotide
tccaccaacgacgccatcgagcggccacattttgt

SEQ ID NO: 17083 - DNA, 36 bp, Artificial Sequence
  Synthetic oligonucleotide
gggacgacgggcgaatacggggggagggacttacca

SEQ ID NO: 17084 - DNA, 36 bp, Artificial Sequence
  Synthetic oligonucleotide
gtccagccgggaagaaaaaaggcgggggcattagta

SEQ ID NO: 17085 - DNA, 36 bp, Artificial Sequence
  Synthetic oligonucleotide
acccacaacaggcccgacttctagcgaacttccgta

SEQ ID NO: 17086 - DNA, 35 bp, Artificial Sequence
  Synthetic oligonucleotide
acagcaccatctcacgttcctgccccgcacgaaag

SEQ ID NO: 17087 - DNA, 36 bp, Artificial Sequence
  Synthetic oligonucleotide
tgccacggccgactacctatcgccacaatccaccca

SEQ ID NO: 17088 - DNA, 37 bp, Artificial Sequence
  Synthetic oligonucleotide
gctggagtgtgggagggggaaggggggggcggataga

SEQ ID NO: 17089 - DNA, 35 bp, Artificial Sequence
  Synthetic oligonucleotide
gtgataaggcatgatggaatagggaggagtgggtg

SEQ ID NO: 17090 - DNA, 36 bp, Artificial Sequence
  Synthetic oligonucleotide
taacaccaacgaggtctcacttatgctttggcacaa

SEQ ID NO: 17091 - DNA, 36 bp, Artificial Sequence
  Synthetic oligonucleotide
gaatcagcctgctgcatctgctcttgggaattttca

SEQ ID NO: 17092 - DNA, 37 bp, Artificial Sequence
  Synthetic oligonucleotide
gcgaccacacgacactcgccaaagcccttcccccgga

SEQ ID NO: 17093 - DNA, 37 bp, Artificial Sequence
  Synthetic oligonucleotide
gaggagaggacgaagtcgtggggaacagggatgcgga

SEQ ID NO: 17094 - DNA, 38 bp, Artificial Sequence
  Synthetic oligonucleotide
tccctgcgcatctgacttcttccttccccctgcgttga

SEQ ID NO: 17095 - DNA, 35 bp, Artificial Sequence
  Synthetic oligonucleotide
agcccaccgtacatgcagccgctccgttagctcgc

SEQ ID NO: 17096 - DNA, 35 bp, Artificial Sequence
  Synthetic oligonucleotide
taggtcaacccccatcgtcagcttatacctgcctc

SEQ ID NO: 17097 - DNA, 35 bp, Artificial Sequence
  Synthetic oligonucleotide
tcccgactcctcacccgtttctgcgttgcacgctc

SEQ ID NO: 17098 - DNA, 35 bp, Artificial Sequence
  Synthetic oligonucleotide
gtccatcgctggacccccgacccgcacaatagggt

SEQ ID NO: 17099 - DNA, 35 bp, Artificial Sequence
  Synthetic oligonucleotide
actcactttggagcagtattacgcctcatctccca

SEQ ID NO: 17100 - DNA, 35 bp, Artificial Sequence
  Synthetic oligonucleotide
gggtggtgggagggtggagagtgttgaggtacaga

SEQ ID NO: 17101 - DNA, 35 bp, Artificial Sequence
  Synthetic oligonucleotide
tattcctcacgtgatccggcctcaggattgcctcc

SEQ ID NO: 17102 - DNA, 35 bp, Artificial Sequence
  Synthetic oligonucleotide
tacacgcgcagccctctccacgaacccagcgacgc

SEQ ID NO: 17103 - DNA, 35 bp, Artificial Sequence
  Synthetic oligonucleotide
aatcacatcccgttcatagtcctccgttctctggg

SEQ ID NO: 17104 - DNA, 36 bp, Artificial Sequence
  Synthetic oligonucleotide
tcactacccacagtccagagcaccggctcaccttca

SEQ ID NO: 17105 - DNA, 38 bp, Artificial Sequence
  Synthetic oligonucleotide
gatgactgcccctcttctcccagcgacaaatcgcttga

SEQ ID NO: 17106 - DNA, 36 bp, Artificial Sequence
  Synthetic oligonucleotide
tgcatgccccaccctggcagaggacctctaatctta

SEQ ID NO: 17107 - DNA, 35 bp, Artificial Sequence
  Synthetic oligonucleotide
atgtcagcccagtcactacctcattcgttcccagg

SEQ ID NO: 17108 - DNA, 35 bp, Artificial Sequence
  Synthetic oligonucleotide
tcctgaccgccgtgtcccctttcgtcacagaggct

SEQ ID NO: 17109 - DNA, 36 bp, Artificial Sequence
  Synthetic oligonucleotide
tgacgcccacttaatcacctctgccctgctcatcga

SEQ ID NO: 17110 - DNA, 37 bp, Artificial Sequence
  Synthetic oligonucleotide
tcaccatcctcctctgtcgtggaatcaatcccgttga

SEQ ID NO: 17111 - DNA, 35 bp, Artificial Sequence
  Synthetic oligonucleotide
tatggacgccatcctccgccacacttcgatagatc

SEQ ID NO: 17112 - DNA, 35 bp, Artificial Sequence
  Synthetic oligonucleotide
acccacctccataacgatcaatgcacgattttcaa

SEQ ID NO: 17113 - DNA, 36 bp, Artificial Sequence
  Synthetic oligonucleotide
atacaacgatcctatcgtacctggaacctccgccca

SEQ ID NO: 17114 - DNA, 37 bp, Artificial Sequence
  Synthetic oligonucleotide
atccgctggccacattacgacctctgaaatctgacga

SEQ ID NO: 17115 - DNA, 37 bp, Artificial Sequence
  Synthetic oligonucleotide
acagggcaggtggagaatagggggagggggtggttga

SEQ ID NO: 17116 - DNA, 35 bp, Artificial Sequence
  Synthetic oligonucleotide
tgccgccggtgccgttcgcatagtcccgcattctc

SEQ ID NO: 17117 - DNA, 35 bp, Artificial Sequence
  Synthetic oligonucleotide
gcatgcccctccgctctaaccaagccgaagcactg

SEQ ID NO: 17118 - DNA, 37 bp, Artificial Sequence
  Synthetic oligonucleotide
acgaggggggaaggcatgatctaggcggaggagcaga

SEQ ID NO: 17119 - DNA, 37 bp, Artificial Sequence
  Synthetic oligonucleotide
gtcccctggctcctggcctttgcccacatcctactga

SEQ ID NO: 17120 - DNA, 35 bp, Artificial Sequence
  Synthetic oligonucleotide
gcccactgacacctgcctaataattgcaataccgt

SEQ ID NO: 17121 - DNA, 36 bp, Artificial Sequence
  Synthetic oligonucleotide
gaccgcccccgcgacctaaccctccggttcaacaca

SEQ ID NO: 17122 - DNA, 35 bp, Artificial Sequence
  Synthetic oligonucleotide
atcaacccacggataccgcttcgtttaggctccac

SEQ ID NO: 17123 - DNA, 35 bp, Artificial Sequence
  Synthetic oligonucleotide
tatccgatagttgcccgccctgttcccagttctgc

SEQ ID NO: 17124 - DNA, 35 bp, Artificial Sequence
  Synthetic oligonucleotide
ttgacgcaaacgactggaagcaaagcaaggaaagg

SEQ ID NO: 17125 - DNA, 34 bp, Artificial Sequence
  Synthetic oligonucleotide
atgccctgcacctgccctccttgtttaccctggt

SEQ ID NO: 17126 - DNA, 35 bp, Artificial Sequence
  Synthetic oligonucleotide
tccacctgtagcattaccagtctacacacctgatt

SEQ ID NO: 17127 - DNA, 35 bp, Artificial Sequence
  Synthetic oligonucleotide
tttgtcagggctactcgtctgcttttctgccactt

SEQ ID NO: 17128 - DNA, 37 bp, Artificial Sequence
  Synthetic oligonucleotide
gtggtggaagagaagcgggtaggagaagggcgggcga

SEQ ID NO: 17129 - DNA, 38 bp, Artificial Sequence
  Synthetic oligonucleotide
accacggccgttccctaccgttttcagtgcctccatga

SEQ ID NO: 17130 - DNA, 36 bp, Artificial Sequence
  Synthetic oligonucleotide
gccactgtgcgcctctcccttgtactcttgttcgta

SEQ ID NO: 17131 - DNA, 35 bp, Artificial Sequence
  Synthetic oligonucleotide
agcaacggctcgctctgccacgtctgactcttctc

SEQ ID NO: 17132 - DNA, 35 bp, Artificial Sequence
  Synthetic oligonucleotide
ttacgcgcgggcgagtttctctttattttttcgtc

SEQ ID NO: 17133 - DNA, 35 bp, Artificial Sequence
  Synthetic oligonucleotide
tccgagcctacacattcccgtcgagtcacttttcg

SEQ ID NO: 17134 - DNA, 36 bp, Artificial Sequence
  Synthetic oligonucleotide
gctgatccgccgctgcctatttagtcttggtcacaa

SEQ ID NO: 17135 - DNA, 33 bp, Artificial Sequence
  Synthetic oligonucleotide
gtgacgccgtcatcttgcttgacctctttctat

SEQ ID NO: 17136 - DNA, 36 bp, Artificial Sequence
  Synthetic oligonucleotide
gcaccctctctgttttgaccttggataggcccctca

SEQ ID NO: 17137 - DNA, 37 bp, Artificial Sequence
  Synthetic oligonucleotide
gttacacgccatatcactcttttcgagtacctcttga

SEQ ID NO: 17138 - DNA, 35 bp, Artificial Sequence
  Synthetic oligonucleotide
ttccgccacgtatggcccagttccaacaataccta

SEQ ID NO: 17139 - DNA, 35 bp, Artificial Sequence
  Synthetic oligonucleotide
tcaatgcaacgccggcactatcgatcgtcccgtcc

SEQ ID NO: 17140 - DNA, 36 bp, Artificial Sequence
  Synthetic oligonucleotide
gtactccgccataccttcttcggtaactgtgctcca

SEQ ID NO: 17141 - DNA, 37 bp, Artificial Sequence
  Synthetic oligonucleotide
gaggggcgcagggggggcatggcctagtgggcgggga

SEQ ID NO: 17142 - DNA, 38 bp, Artificial Sequence
  Synthetic oligonucleotide
agctcagccctgctgccctgaatcgtaatacactctga

SEQ ID NO: 17143 - DNA, 35 bp, Artificial Sequence
  Synthetic oligonucleotide
tcccgtccggagagcatcgctagcttgtaccctcc

SEQ ID NO: 17144 - DNA, 35 bp, Artificial Sequence
  Synthetic oligonucleotide
tgacattactggcctgctctaaaccgcgcccctcc

SEQ ID NO: 17145 - DNA, 35 bp, Artificial Sequence
  Synthetic oligonucleotide
ggaaccgccacgcacgtaccttatccgctccattg

SEQ ID NO: 17146 - DNA, 37 bp, Artificial Sequence
  Synthetic oligonucleotide
tccacatcaatccgagcgtagttggccccctcctgga

SEQ ID NO: 17147 - DNA, 36 bp, Artificial Sequence
  Synthetic oligonucleotide
ttgacggtccctacttcgcaaccaccactgcttgta

SEQ ID NO: 17148 - DNA, 35 bp, Artificial Sequence
  Synthetic oligonucleotide
gcctgttgccgcagacgctccccccgaacaacaac

SEQ ID NO: 17149 - DNA, 35 bp, Artificial Sequence
  Synthetic oligonucleotide
gtttagccgtggttttcacacacgtcctcctctac

SEQ ID NO: 17150 - DNA, 35 bp, Artificial Sequence
  Synthetic oligonucleotide
atatccgccgcactaagggatcagcccgatccgcc

SEQ ID NO: 17151 - DNA, 35 bp, Artificial Sequence
  Synthetic oligonucleotide
aaggggggagggggtggtggtgttcgagagtgtaa

SEQ ID NO: 17152 - DNA, 37 bp, Artificial Sequence
  Synthetic oligonucleotide
gacggggggtgggcaaggatttgagattgaaggacga

SEQ ID NO: 17153 - DNA, 35 bp, Artificial Sequence
  Synthetic oligonucleotide
taacctcccagttatcgtctggcctccattcccga

SEQ ID NO: 17154 - DNA, 38 bp, Artificial Sequence
  Synthetic oligonucleotide
aacgaaaggggaagagagaatgggcggaggaactatga

SEQ ID NO: 17155 - DNA, 37 bp, Artificial Sequence
  Synthetic oligonucleotide
accaccatcgagtggtacctacctgatttacaggtga

SEQ ID NO: 17156 - DNA, 38 bp, Artificial Sequence
  Synthetic oligonucleotide
tatcagactaacatggtgcacgccacacacacatttga

SEQ ID NO: 17157 - DNA, 35 bp, Artificial Sequence
  Synthetic oligonucleotide
atcagtcacctgtcggttttcgataccatgccctc

SEQ ID NO: 17158 - DNA, 36 bp, Artificial Sequence
  Synthetic oligonucleotide
ttggccagctccaccctcactgcgtctcagtcccaa

SEQ ID NO: 17159 - DNA, 36 bp, Artificial Sequence
  Synthetic oligonucleotide
gtggtggaccggaagaaagaggaaatgtggctagaa

SEQ ID NO: 17160 - DNA, 36 bp, Artificial Sequence
  Synthetic oligonucleotide
gctaccgtcgcactctccactccgcttgagtcccga

SEQ ID NO: 17161 - DNA, 38 bp, Artificial Sequence
  Synthetic oligonucleotide
acgccccggcctctgctgtttcccttacgatatgctga

SEQ ID NO: 17162 - DNA, 38 bp, Artificial Sequence
  Synthetic oligonucleotide
atgagaggtgggagatcgacggatagaggggtgtgtga

SEQ ID NO: 17163 - DNA, 35 bp, Artificial Sequence
  Synthetic oligonucleotide
tactcgtagttcgcttccccatattcctatgccga

SEQ ID NO: 17164 - DNA, 35 bp, Artificial Sequence
  Synthetic oligonucleotide
gaccaacctcccgcccgacaattcttagtgctcga

SEQ ID NO: 17165 - DNA, 38 bp, Artificial Sequence
  Synthetic oligonucleotide
atgccccacagttcttgatgctactaaccccgccctga

SEQ ID NO: 17166 - DNA, 35 bp, Artificial Sequence
  Synthetic oligonucleotide
tgccaccctctctcaagttcgagtagttccccccc

SEQ ID NO: 17167 - DNA, 37 bp, Artificial Sequence
  Synthetic oligonucleotide
ggacgtccacgacttttaacaattgcctcctctatga

SEQ ID NO: 17168 - DNA, 36 bp, Artificial Sequence
  Synthetic oligonucleotide
gcccatgcccgatccctgcacggggctgtatctata

SEQ ID NO: 17169 - DNA, 36 bp, Artificial Sequence
  Synthetic oligonucleotide
accccatcccgtcaagtcgcgcgcttggcagactta

SEQ ID NO: 17170 - DNA, 37 bp, Artificial Sequence
  Synthetic oligonucleotide
tcgacatgggccggggtagccacgggcggggagggga

SEQ ID NO: 17171 - DNA, 37 bp, Artificial Sequence
  Synthetic oligonucleotide
atcgctccccacgcccttgatcgacttaggtttttga

SEQ ID NO: 17172 - DNA, 35 bp, Artificial Sequence
  Synthetic oligonucleotide
tagaccgggggaatgaaggaaggtggaggatgatt

SEQ ID NO: 17173 - DNA, 35 bp, Artificial Sequence
  Synthetic oligonucleotide
acaacactccgggcccgttataacagcaaatctca

SEQ ID NO: 17174 - DNA, 37 bp, Artificial Sequence
  Synthetic oligonucleotide
gtgccatccacgcatatttacttcttgcagtctatga

SEQ ID NO: 17175 - DNA, 34 bp, Artificial Sequence
  Synthetic oligonucleotide
tcatctacactgcacctcctgtttgacgtcatta

SEQ ID NO: 17176 - DNA, 35 bp, Artificial Sequence
  Synthetic oligonucleotide
atgacctagcactcctgggttctcatttcacctta

SEQ ID NO: 17177 - DNA, 37 bp, Artificial Sequence
  Synthetic oligonucleotide
gccaccccagcacattgaaccggctcccagtagctta

SEQ ID NO: 17178 - DNA, 35 bp, Artificial Sequence
  Synthetic oligonucleotide
gcacaaacgacgaacgtgcattgccctagcccacc

SEQ ID NO: 17179 - DNA, 35 bp, Artificial Sequence
  Synthetic oligonucleotide
gcccgacccaccatgctagcctccgtagcaggccc

SEQ ID NO: 17180 - DNA, 35 bp, Artificial Sequence
  Synthetic oligonucleotide
tcccagccctacactgtcaacgaacttttgcatct

SEQ ID NO: 17181 - DNA, 36 bp, Artificial Sequence
  Synthetic oligonucleotide
gcatcggtccaactgctccatccgttgtctgcttaa

SEQ ID NO: 17182 - DNA, 36 bp, Artificial Sequence
  Synthetic oligonucleotide
gcgccaaccgttcctgtctcgaccgtctaccgccca

SEQ ID NO: 17183 - DNA, 37 bp, Artificial Sequence
  Synthetic oligonucleotide
tcgccaagcacctcctcagtctcccgccgtttcgcga

SEQ ID NO: 17184 - DNA, 38 bp, Artificial Sequence
  Synthetic oligonucleotide
tccgacgcccgtcagtcactctctgcgacctcttatga

SEQ ID NO: 17185 - DNA, 37 bp, Artificial Sequence
  Synthetic oligonucleotide
tcgcctggtccaacgcgtctagtttaccctctcctga

SEQ ID NO: 17186 - DNA, 38 bp, Artificial Sequence
  Synthetic oligonucleotide
acaccaggccaaatggtgagctacatcccacactctga

SEQ ID NO: 17187 - DNA, 37 bp, Artificial Sequence
  Synthetic oligonucleotide
ttgagacggtggagggggggcgtgggttaaggtgtga

SEQ ID NO: 17188 - DNA, 35 bp, Artificial Sequence
  Synthetic oligonucleotide
ttcgctatggggcagtctctttcgttttttacctc

SEQ ID NO: 17189 - DNA, 37 bp, Artificial Sequence
  Synthetic oligonucleotide
acctccacgccaatgcccttccatctgctacactgga

SEQ ID NO: 17190 - DNA, 35 bp, Artificial Sequence
  Synthetic oligonucleotide
ggtgatgaggctggaggtactggggtggctgttga

SEQ ID NO: 17191 - DNA, 35 bp, Artificial Sequence
  Synthetic oligonucleotide
actacgctacactccccctttgatctggtccacgc

SEQ ID NO: 17192 - DNA, 36 bp, Artificial Sequence
  Synthetic oligonucleotide
tacaaccccgtattgtttaatttatgccccccggtc

SEQ ID NO: 17193 - DNA, 35 bp, Artificial Sequence
  Synthetic oligonucleotide
gactacagcgacggagggagcagggctggggaggg

SEQ ID NO: 17194 - DNA, 36 bp, Artificial Sequence
  Synthetic oligonucleotide
tcgcgtgcccatcgcatctcaaattgaaccttttca

SEQ ID NO: 17195 - DNA, 37 bp, Artificial Sequence
  Synthetic oligonucleotide
gcatcaagggggggaagagcgtggagggcttgataga

SEQ ID NO: 17196 - DNA, 38 bp, Artificial Sequence
  Synthetic oligonucleotide
gctggttccggcgcgtatagttccgtctcactccctga

SEQ ID NO: 17197 - DNA, 35 bp, Artificial Sequence
  Synthetic oligonucleotide
tcccctacgacttccctctggccctgcccctgtac

SEQ ID NO: 17198 - DNA, 35 bp, Artificial Sequence
  Synthetic oligonucleotide
gctgtcctgcctgtcgccttctttaccacgcttct

SEQ ID NO: 17199 - DNA, 35 bp, Artificial Sequence
  Synthetic oligonucleotide
tgccatgcttacgaccacatactgttacctctttt

SEQ ID NO: 17200 - DNA, 37 bp, Artificial Sequence
  Synthetic oligonucleotide
gagtacccgccgggtttctaatgattcttttcaccga

SEQ ID NO: 17201 - DNA, 38 bp, Artificial Sequence
  Synthetic oligonucleotide
tccaacccacccagtaacagcccttcgacccggcgtga

SEQ ID NO: 17202 - DNA, 38 bp, Artificial Sequence
  Synthetic oligonucleotide
tgaaccaccgattcgccgtttgcatttacccacattga

SEQ ID NO: 17203 - DNA, 36 bp, Artificial Sequence
  Synthetic oligonucleotide
gccacccgctcgaggcccccaaacgatacccgccaa

SEQ ID NO: 17204 - DNA, 35 bp, Artificial Sequence
  Synthetic oligonucleotide
gcgcaccatcccgcatcgacgatcctattgatcca

SEQ ID NO: 17205 - DNA, 31 bp, Artificial Sequence
  Synthetic oligonucleotide
gtgagggttcctgggcaattttcgaatatca

SEQ ID NO: 17206 - DNA, 35 bp, Artificial Sequence
  Synthetic oligonucleotide
aacaacgctccatggctcttgcctgcccacaccga

SEQ ID NO: 17207 - DNA, 37 bp, Artificial Sequence
  Synthetic oligonucleotide
acaccccacactataactaagtgtatctccgatagga

SEQ ID NO: 17208 - DNA, 38 bp, Artificial Sequence
  Synthetic oligonucleotide
tcagcgggtcagtttccctcattgctctatccctttga

SEQ ID NO: 17209 - DNA, 35 bp, Artificial Sequence
  Synthetic oligonucleotide
aagctatgcccccccgaccgacttgagtacatttg

SEQ ID NO: 17210 - DNA, 36 bp, Artificial Sequence
  Synthetic oligonucleotide
aacccaaactgttgctgtttgtacactctacccaca

SEQ ID NO: 17211 - DNA, 35 bp, Artificial Sequence
  Synthetic oligonucleotide
actgcaccctatatctccacactcggtgtcatcat

SEQ ID NO: 17212 - DNA, 35 bp, Artificial Sequence
  Synthetic oligonucleotide
taggctggtcacctcttggctacatcaccctgttt

SEQ ID NO: 17213 - DNA, 37 bp, Artificial Sequence
  Synthetic oligonucleotide
tgaccacgcaatcgtgtggcgcactatctcccgaaga

SEQ ID NO: 17214 - DNA, 37 bp, Artificial Sequence
  Synthetic oligonucleotide
gatggacgggtggcggttggaagaggagatgagggga

SEQ ID NO: 17215 - DNA, 37 bp, Artificial Sequence
  Synthetic oligonucleotide
ggaccatgtgccgccctacgtttgtccgctccactga

SEQ ID NO: 17216 - DNA, 38 bp, Artificial Sequence
  Synthetic oligonucleotide
tctagcctcgctgatctgctcccagtgtcctcccctga

SEQ ID NO: 17217 - DNA, 35 bp, Artificial Sequence
  Synthetic oligonucleotide
acccctcttgcctcttgtcacccgacatgtaccgc

SEQ ID NO: 17218 - DNA, 35 bp, Artificial Sequence
  Synthetic oligonucleotide
gattgcctccaccctggggaattgtaccttatctc

SEQ ID NO: 17219 - DNA, 37 bp, Artificial Sequence
  Synthetic oligonucleotide
gagcaaatggggccgggagggggggtttctaacgaga

SEQ ID NO: 17220 - DNA, 37 bp, Artificial Sequence
  Synthetic oligonucleotide
acgatgatgtgtaggtgtatgtgggggtgtaaagtga

SEQ ID NO: 17221 - DNA, 35 bp, Artificial Sequence
  Synthetic oligonucleotide
ttgaatgaccgcagagccgcatcaggcccctcccc

SEQ ID NO: 17222 - DNA, 35 bp, Artificial Sequence
  Synthetic oligonucleotide
atcgacgctaccgtgcaccatcggcttctactact

SEQ ID NO: 17223 - DNA, 37 bp, Artificial Sequence
  Synthetic oligonucleotide
gtgtgacaaggaggtgcaatgtgagctgaagggggga

SEQ ID NO: 17224 - DNA, 35 bp, Artificial Sequence
  Synthetic oligonucleotide
tctccaggccggtatgtctccttagctcaatgtcc

SEQ ID NO: 17225 - DNA, 35 bp, Artificial Sequence
  Synthetic oligonucleotide
acataccactgcttatatgataatctccagtcctc

SEQ ID NO: 17226 - DNA, 35 bp, Artificial Sequence
  Synthetic oligonucleotide
ttgtgcatactcgaaatgcccctcctggatcttgt

SEQ ID NO: 17227 - DNA, 37 bp, Artificial Sequence
  Synthetic oligonucleotide
tgtcctggaccaccgtgcatctctgtcccctttgtga

SEQ ID NO: 17228 - DNA, 36 bp, Artificial Sequence
  Synthetic oligonucleotide
atacgcccgatccaggccatcctgtgctcaattcta

SEQ ID NO: 17229 - DNA, 35 bp, Artificial Sequence
  Synthetic oligonucleotide
gaccgacctctgtccctgtctattatcccgccggc

SEQ ID NO: 17230 - DNA, 37 bp, Artificial Sequence
  Synthetic oligonucleotide
tcagatccgcctgccctgaaaacttgccatttgtaga

SEQ ID NO: 17231 - DNA, 38 bp, Artificial Sequence
  Synthetic oligonucleotide
tccgcataccacctgagggcatcagaccgggtctgtga

SEQ ID NO: 17232 - DNA, 35 bp, Artificial Sequence
  Synthetic oligonucleotide
tgaagtgagggagggggaaagatagggcacggcta

SEQ ID NO: 17233 - DNA, 35 bp, Artificial Sequence
  Synthetic oligonucleotide
attgccaccctttcggatttaccaatcctctggac

SEQ ID NO: 17234 - DNA, 35 bp, Artificial Sequence
  Synthetic oligonucleotide
tgctacctctgtccgacgccggaaccttaaactgc

SEQ ID NO: 17235 - DNA, 35 bp, Artificial Sequence
  Synthetic oligonucleotide
atgcccgtgctcttccgtgcgaaccaccccccaca

SEQ ID NO: 17236 - DNA, 38 bp, Artificial Sequence
  Synthetic oligonucleotide
tcttcaccgcacattgccgctgtctccatctcacgtga

SEQ ID NO: 17237 - DNA, 35 bp, Artificial Sequence
  Synthetic oligonucleotide
tatcatgtccgttgcttgttcacttccgatttacc

SEQ ID NO: 17238 - DNA, 36 bp, Artificial Sequence
  Synthetic oligonucleotide
gttgccgccgcatggattactccacttactgaccgc

SEQ ID NO: 17239 - DNA, 35 bp, Artificial Sequence
  Synthetic oligonucleotide
accctcccatgcctgagggaagctccttcacttgc

SEQ ID NO: 17240 - DNA, 35 bp, Artificial Sequence
  Synthetic oligonucleotide
accaaccactactgagatcacgcgcgtccatgacg

SEQ ID NO: 17241 - DNA, 37 bp, Artificial Sequence
  Synthetic oligonucleotide
aaggatcatggaaggggtggttaaggaagggctcgga

SEQ ID NO: 17242 - DNA, 35 bp, Artificial Sequence
  Synthetic oligonucleotide
tcagccctgcccccctatccgtgacatccggcaag

SEQ ID NO: 17243 - DNA, 35 bp, Artificial Sequence
  Synthetic oligonucleotide
aataccaccctcaccgcctatcaatgttcactatg

SEQ ID NO: 17244 - DNA, 35 bp, Artificial Sequence
  Synthetic oligonucleotide
tctacctccgatagctgccctctatgacggcccat

SEQ ID NO: 17245 - DNA, 35 bp, Artificial Sequence
  Synthetic oligonucleotide
gccatgtttccctgcgtacactcccttattacggt

SEQ ID NO: 17246 - DNA, 35 bp, Artificial Sequence
  Synthetic oligonucleotide
accacttcgcctgccgtactctcaccctctcaaaa

SEQ ID NO: 17247 - DNA, 37 bp, Artificial Sequence
  Synthetic oligonucleotide
actcaccgcaatagttcccgcgctgtcctcccctaga

SEQ ID NO: 17248 - DNA, 38 bp, Artificial Sequence
  Synthetic oligonucleotide
ttgaccgtagcagagggaatggctggctggggaaatga

SEQ ID NO: 17249 - DNA, 35 bp, Artificial Sequence
  Synthetic oligonucleotide
attgaccggacattacgtcgtactccagcctgccc

SEQ ID NO: 17250 - DNA, 35 bp, Artificial Sequence
  Synthetic oligonucleotide
tactgcccggcacccaccattactgttgccatatc

SEQ ID NO: 17251 - DNA, 35 bp, Artificial Sequence
  Synthetic oligonucleotide
tagcaacacccttactcacatgcgatgccgcctca

SEQ ID NO: 17252 - DNA, 36 bp, Artificial Sequence
  Synthetic oligonucleotide
gtatgcgcccgaaaacgccgcacccatataacccga

SEQ ID NO: 17253 - DNA, 36 bp, Artificial Sequence
  Synthetic oligonucleotide
acttgcctccgtaggtctcacgtactcctatcccga

SEQ ID NO: 17254 - DNA, 37 bp, Artificial Sequence
  Synthetic oligonucleotide
accaggaggaacacattgagcaaggggagttacggga

SEQ ID NO: 17255 - DNA, 36 bp, Artificial Sequence
  Synthetic oligonucleotide
gttgtggcccatgacttgttttctttttttgtccta

SEQ ID NO: 17256 - DNA, 36 bp, Artificial Sequence
  Synthetic oligonucleotide
tacgcctccgcaatactgcgatccattgcctccgta

SEQ ID NO: 17257 - DNA, 35 bp, Artificial Sequence
  Synthetic oligonucleotide
tcccctccgtggtatcgcttgtctaaatcatctac

SEQ ID NO: 17258 - DNA, 35 bp, Artificial Sequence
  Synthetic oligonucleotide
tagatccccgattccactgtgcaaacctgtattcc

SEQ ID NO: 17259 - DNA, 35 bp, Artificial Sequence
  Synthetic oligonucleotide
tattcccctcatggcctgtgtcctgcttaccacat

SEQ ID NO: 17260 - DNA, 37 bp, Artificial Sequence
  Synthetic oligonucleotide
ttctccccaccagccacctattttagaacagcacgga

SEQ ID NO: 17261 - DNA, 35 bp, Artificial Sequence
  Synthetic oligonucleotide
tcaaacaaggaggatggggctcggtggaaagattt

SEQ ID NO: 17262 - DNA, 35 bp, Artificial Sequence
  Synthetic oligonucleotide
gtctcgccccccaatggacctatctctagtagaca

SEQ ID NO: 17263 - DNA, 35 bp, Artificial Sequence
  Synthetic oligonucleotide
acatcctgagcttcgacaagacctctgttacccac

SEQ ID NO: 17264 - DNA, 35 bp, Artificial Sequence
  Synthetic oligonucleotide
gtcgactcctcggtacattcctgttaaggttttcc

SEQ ID NO: 17265 - DNA, 35 bp, Artificial Sequence
  Synthetic oligonucleotide
gagaccagcagcccgttccgtgtcacacctttcac

SEQ ID NO: 17266 - DNA, 35 bp, Artificial Sequence
  Synthetic oligonucleotide
acacccgtccagactctcggtagagtcgaaacacc

SEQ ID NO: 17267 - DNA, 36 bp, Artificial Sequence
  Synthetic oligonucleotide
atacccaccgctcgttgtatcaacctttgccccgaa

SEQ ID NO: 17268 - DNA, 36 bp, Artificial Sequence
  Synthetic oligonucleotide
ttgatcgcatgatctcccctccaaacgggttttaca

SEQ ID NO: 17269 - DNA, 37 bp, Artificial Sequence
  Synthetic oligonucleotide
atcagccgcaacgtcttttcccgttcgatttcgccga

SEQ ID NO: 17270 - DNA, 35 bp, Artificial Sequence
  Synthetic oligonucleotide
actggggtggtggtggtatcgggtggtttcatgga

SEQ ID NO: 17271 - DNA, 38 bp, Artificial Sequence
  Synthetic oligonucleotide
accagtgccatctgccacccctgcctcacccacaatga

SEQ ID NO: 17272 - DNA, 37 bp, Artificial Sequence
  Synthetic oligonucleotide
tgttccgccttcgtgaacaaccactttttgcccttga

SEQ ID NO: 17273 - DNA, 36 bp, Artificial Sequence
  Synthetic oligonucleotide
atgtagcgacggggggcgggttggggctggctcata

SEQ ID NO: 17274 - DNA, 35 bp, Artificial Sequence
  Synthetic oligonucleotide
aacccgccacctccatcgtgtcttgcacgtcatac

SEQ ID NO: 17275 - DNA, 35 bp, Artificial Sequence
  Synthetic oligonucleotide
gctgttcaagcccgacctccactatgacacacccc

SEQ ID NO: 17276 - DNA, 35 bp, Artificial Sequence
  Synthetic oligonucleotide
aaatacgtggggtggggcggaaaaaaggaaagttc

SEQ ID NO: 17277 - DNA, 37 bp, Artificial Sequence
  Synthetic oligonucleotide
tgttcacccccagagcgaaaattctccccttgccgga

SEQ ID NO: 17278 - DNA, 38 bp, Artificial Sequence
  Synthetic oligonucleotide
tatcaccatccgatctcgtgccgtttgcttggcattga

SEQ ID NO: 17279 - DNA, 35 bp, Artificial Sequence
  Synthetic oligonucleotide
gacccgcgaagccacacagtcctcccgtcgtttac

SEQ ID NO: 17280 - DNA, 35 bp, Artificial Sequence
  Synthetic oligonucleotide
cacacctcacactggcaggatgactgtccttttcc

SEQ ID NO: 17281 - DNA, 35 bp, Artificial Sequence
  Synthetic oligonucleotide
gtgtgaccggccggcactctcttgttgttttatcg

SEQ ID NO: 17282 - DNA, 35 bp, Artificial Sequence
  Synthetic oligonucleotide
gcgtttagctcggccctgcttaatttgatctttct

SEQ ID NO: 17283 - DNA, 37 bp, Artificial Sequence
  Synthetic oligonucleotide
gtggggaggcccgtgggtgggggatcgcctggaatga

SEQ ID NO: 17284 - DNA, 37 bp, Artificial Sequence
  Synthetic oligonucleotide
tcacctacacgccctccatgtcatctgacctcgatga

SEQ ID NO: 17285 - DNA, 37 bp, Artificial Sequence
  Synthetic oligonucleotide
tctccatccgctacgtcgtaaggccgcacattactga

SEQ ID NO: 17286 - DNA, 35 bp, Artificial Sequence
  Synthetic oligonucleotide
agatgcttccgcctcccgcccttatcgtttccggt

SEQ ID NO: 17287 - DNA, 35 bp, Artificial Sequence
  Synthetic oligonucleotide
ttacccccgttcccctgctctctagctgtcaggca

SEQ ID NO: 17288 - DNA, 37 bp, Artificial Sequence
  Synthetic oligonucleotide
tgtccatcacaccgtgtcccctgcggtgccaacccga

SEQ ID NO: 17289 - DNA, 38 bp, Artificial Sequence
  Synthetic oligonucleotide
gataccgcccggacgcgttactcgcataactcctttga

SEQ ID NO: 17290 - DNA, 37 bp, Artificial Sequence
  Synthetic oligonucleotide
tctgtccccctgcccattgactaatggtaatctttga

SEQ ID NO: 17291 - DNA, 35 bp, Artificial Sequence
  Synthetic oligonucleotide
ttcgaagctccgggaaagcgcaccttattttgtcc

SEQ ID NO: 17292 - DNA, 35 bp, Artificial Sequence
  Synthetic oligonucleotide
tcatcccttgcctatctttccactcgctgagagtg

SEQ ID NO: 17293 - DNA, 36 bp, Artificial Sequence
  Synthetic oligonucleotide
gaccatagtccggcacccggtctctatcccgttaaa

SEQ ID NO: 17294 - DNA, 38 bp, Artificial Sequence
  Synthetic oligonucleotide
tgcacgcggtccctctgtctttccacgtcctacattga

SEQ ID NO: 17295 - DNA, 35 bp, Artificial Sequence
  Synthetic oligonucleotide
acgaaccccctcgcggatcggtttcgttgtctttc

SEQ ID NO: 17296 - DNA, 35 bp, Artificial Sequence
  Synthetic oligonucleotide
tttttccccgccaccactgcttagacacgtagccg

SEQ ID NO: 17297 - DNA, 35 bp, Artificial Sequence
  Synthetic oligonucleotide
accgatgagggtgacggggtttagggagtggtgtg

SEQ ID NO: 17298 - DNA, 38 bp, Artificial Sequence
  Synthetic oligonucleotide
gagagcggtaggtgggaagggctctcgagatgggctga

SEQ ID NO: 17299 - DNA, 35 bp, Artificial Sequence
  Synthetic oligonucleotide
acgagccctgcttcacgccagtactttgtcccaac

SEQ ID NO: 17300 - DNA, 35 bp, Artificial Sequence
  Synthetic oligonucleotide
tcaactgcccacctttgtagctagttttctccact

SEQ ID NO: 17301 - DNA, 37 bp, Artificial Sequence
  Synthetic oligonucleotide
actgcacgtcctacgactcccgcgcagtacaccctga

SEQ ID NO: 17302 - DNA, 35 bp, Artificial Sequence
  Synthetic oligonucleotide
gcaacctagcgcctgccacccattttacccacata

SEQ ID NO: 17303 - DNA, 35 bp, Artificial Sequence
  Synthetic oligonucleotide
tcgccctccgcccccaactgttgacgtaatattac

SEQ ID NO: 17304 - DNA, 35 bp, Artificial Sequence
  Synthetic oligonucleotide
gccacttctggcactgataactatacactctccca

SEQ ID NO: 17305 - DNA, 37 bp, Artificial Sequence
  Synthetic oligonucleotide
taggccccttgcccatctgtacaacgtttttgctcga

SEQ ID NO: 17306 - DNA, 38 bp, Artificial Sequence
  Synthetic oligonucleotide
gcaccgccaatggtccatgtactttgcctccattctga

SEQ ID NO: 17307 - DNA, 38 bp, Artificial Sequence
  Synthetic oligonucleotide
acacaccgacatgccttgcgttctgctccttttggtga

SEQ ID NO: 17308 - DNA, 35 bp, Artificial Sequence
  Synthetic oligonucleotide
acaccccccccctgctatcttattactttgtagcc

SEQ ID NO: 17309 - DNA, 35 bp, Artificial Sequence
  Synthetic oligonucleotide
atccctcccgctatcggcggcaccctcaccatgcc

SEQ ID NO: 17310 - DNA, 35 bp, Artificial Sequence
  Synthetic oligonucleotide
ttaagaggggaagtgggcaaaaaaagggtcggtct

SEQ ID NO: 17311 - DNA, 34 bp, Artificial Sequence
  Synthetic oligonucleotide
gtccacacccccccaacctagcagacgaccctgt

SEQ ID NO: 17312 - DNA, 36 bp, Artificial Sequence
  Synthetic oligonucleotide
tctgacgcagggcagatccctccatcctccgattca

SEQ ID NO: 17313 - DNA, 35 bp, Artificial Sequence
  Synthetic oligonucleotide
acatcgactcggtactagctcttcgtttctgctta

SEQ ID NO: 17314 - DNA, 36 bp, Artificial Sequence
  Synthetic oligonucleotide
ttctgcgccactccgtgctctcgtcctaaaccttta

SEQ ID NO: 17315 - DNA, 35 bp, Artificial Sequence
  Synthetic oligonucleotide
gaaacatccacgtgtcatcttctgccacatagttc

SEQ ID NO: 17316 - DNA, 35 bp, Artificial Sequence
  Synthetic oligonucleotide
acacctcctcaccaggtcacttacttccttcgaag

SEQ ID NO: 17317 - DNA, 34 bp, Artificial Sequence
  Synthetic oligonucleotide
tgccaccacccaacattgtcatgatgtctgccat

SEQ ID NO: 17318 - DNA, 36 bp, Artificial Sequence
  Synthetic oligonucleotide
taagctcaggcgctactctgccaactgctgtcttca

SEQ ID NO: 17319 - DNA, 37 bp, Artificial Sequence
  Synthetic oligonucleotide
tgccacccacatttctggcctaccacacttcgacaga

SEQ ID NO: 17320 - DNA, 36 bp, Artificial Sequence
  Synthetic oligonucleotide
tacctggccctcattcactcattgacttctttgaga

SEQ ID NO: 17321 - DNA, 37 bp, Artificial Sequence
  Synthetic oligonucleotide
gccagagaccgcctcctaattatttgcgccacctcga

SEQ ID NO: 17322 - DNA, 37 bp, Artificial Sequence
  Synthetic oligonucleotide
tcagatcgcatgctatacgtccatcttcttactctga

SEQ ID NO: 17323 - DNA, 35 bp, Artificial Sequence
  Synthetic oligonucleotide
gagccatggccaatacccctgggaccctcctacgc

SEQ ID NO: 17324 - DNA, 35 bp, Artificial Sequence
  Synthetic oligonucleotide
taggacggtgcgcgtgcaggaggaagggggtaggt

SEQ ID NO: 17325 - DNA, 35 bp, Artificial Sequence
  Synthetic oligonucleotide
gtacgcatccttacgacgctgtctccgaccccatt

SEQ ID NO: 17326 - DNA, 35 bp, Artificial Sequence
  Synthetic oligonucleotide
gcatgcaaccggtacactcccttacctgcctcgaa

SEQ ID NO: 17327 - DNA, 37 bp, Artificial Sequence
  Synthetic oligonucleotide
aagggtggggaggggagggtgtgagatctcatgtaga

SEQ ID NO: 17328 - DNA, 37 bp, Artificial Sequence
  Synthetic oligonucleotide
ggtggagggaatgggaaatagcacgcaatggagggga

SEQ ID NO: 17329 - DNA, 38 bp, Artificial Sequence
  Synthetic oligonucleotide
gcgaagtgagaggggtgcggataacattggcaacgtga

SEQ ID NO: 17330 - DNA, 35 bp, Artificial Sequence
  Synthetic oligonucleotide
gactcccccccgtgtcctacgggcactatgcacgc

SEQ ID NO: 17331 - DNA, 35 bp, Artificial Sequence
  Synthetic oligonucleotide
acgacactcgcacctatctccttgtccttatcggg

SEQ ID NO: 17332 - DNA, 35 bp, Artificial Sequence
  Synthetic oligonucleotide
tctatccgcactgcctcatcaaaccgattagctct

SEQ ID NO: 17333 - DNA, 36 bp, Artificial Sequence
  Synthetic oligonucleotide
tcgactccgcccataatctggccccgtcattacgca

SEQ ID NO: 17334 - DNA, 36 bp, Artificial Sequence
  Synthetic oligonucleotide
gccacagcaccattacccactaccacctcgagaaca

SEQ ID NO: 17335 - DNA, 37 bp, Artificial Sequence
  Synthetic oligonucleotide
tagtccaggggaagagagaagattggagaagaaggga

SEQ ID NO: 17336 - DNA, 38 bp, Artificial Sequence
  Synthetic oligonucleotide
acatcaccacactcctagcagtcttaccgtaacggtga

SEQ ID NO: 17337 - DNA, 35 bp, Artificial Sequence
  Synthetic oligonucleotide
actacccccgattgactggtctgtggcttaccatt

SEQ ID NO: 17338 - DNA, 35 bp, Artificial Sequence
  Synthetic oligonucleotide
gacatgcaccacgaggatccacctttctttgcccc

SEQ ID NO: 17339 - DNA, 35 bp, Artificial Sequence
  Synthetic oligonucleotide
tgttcgccccagctcttgcccgttccgctcgtacg

SEQ ID NO: 17340 - DNA, 37 bp, Artificial Sequence
  Synthetic oligonucleotide
aaggagaccagggggactggagaggaggatgttagga

SEQ ID NO: 17341 - DNA, 37 bp, Artificial Sequence
  Synthetic oligonucleotide
gtccaacgtcctacctgccatctgcacctatttatga

SEQ ID NO: 17342 - DNA, 35 bp, Artificial Sequence
  Synthetic oligonucleotide
gagaagagcaatgggagcaggaagagagaagagta

SEQ ID NO: 17343 - DNA, 35 bp, Artificial Sequence
  Synthetic oligonucleotide
gtgcacataccgccacgatccaggtcctcccccag

SEQ ID NO: 17344 - DNA, 35 bp, Artificial Sequence
  Synthetic oligonucleotide
gccaaggacaacccactgagccgcccaccatcatg

SEQ ID NO: 17345 - DNA, 36 bp, Artificial Sequence
  Synthetic oligonucleotide
aatcctcgctccgaccatacgctatggtgccctaca

SEQ ID NO: 17346 - DNA, 36 bp, Artificial Sequence
  Synthetic oligonucleotide
tgttcgtacaccgtgcttcctgggtccttacattca

SEQ ID NO: 17347 - DNA, 36 bp, Artificial Sequence
  Synthetic oligonucleotide
accatcctcgggtcatctctttctcgcattccgaga

SEQ ID NO: 17348 - DNA, 35 bp, Artificial Sequence
  Synthetic oligonucleotide
tcctgggaatggtggtgtgggggtggtaaggagga

SEQ ID NO: 17349 - DNA, 36 bp, Artificial Sequence
  Synthetic oligonucleotide
ggaccgcatgagcagggaatgggggttgttgcaata

SEQ ID NO: 17350 - DNA, 35 bp, Artificial Sequence
  Synthetic oligonucleotide
tccagcctttcttccctggatccgcgcccccgtta

SEQ ID NO: 17351 - DNA, 36 bp, Artificial Sequence
  Synthetic oligonucleotide
ttcgatacggcgccacatccacatgccactctgtta

SEQ ID NO: 17352 - DNA, 36 bp, Artificial Sequence
  Synthetic oligonucleotide
actcccatctgccacttgcgtccacggctgatctca

SEQ ID NO: 17353 - DNA, 35 bp, Artificial Sequence
  Synthetic oligonucleotide
gataccagccggtctccaattatcctgtcatgctg

SEQ ID NO: 17354 - DNA, 36 bp, Artificial Sequence
  Synthetic oligonucleotide
gactgcccgtgcgcacagcatctacccatttcgtca

SEQ ID NO: 17355 - DNA, 38 bp, Artificial Sequence
  Synthetic oligonucleotide
tccagtcgcccccgcacccatctccccgcgtgaaatga

SEQ ID NO: 17356 - DNA, 35 bp, Artificial Sequence
  Synthetic oligonucleotide
ggggcatcgtaccctcctgctccgtcctaagcccc

SEQ ID NO: 17357 - DNA, 35 bp, Artificial Sequence
  Synthetic oligonucleotide
ttccatcccgagttcatatcgaacgtcgatatatc

SEQ ID NO: 17358 - DNA, 35 bp, Artificial Sequence
  Synthetic oligonucleotide
tctgccctgtgctcaccggcttgtccatttatcct

SEQ ID NO: 17359 - DNA, 36 bp, Artificial Sequence
  Synthetic oligonucleotide
tccacccttgctgctctcgtcccaatatataggcca

SEQ ID NO: 17360 - DNA, 36 bp, Artificial Sequence
  Synthetic oligonucleotide
gccccccgtacttcccctgtcctcttggtttccaga

SEQ ID NO: 17361 - DNA, 36 bp, Artificial Sequence
  Synthetic oligonucleotide
gggaatgaaaagggcggggaatgagagttgcgggga

SEQ ID NO: 17362 - DNA, 38 bp, Artificial Sequence
  Synthetic oligonucleotide
taatgcgcgagggtggggggctatgagtggctatgtga

SEQ ID NO: 17363 - DNA, 38 bp, Artificial Sequence
  Synthetic oligonucleotide
atgccctcagtctgtactgcctggccacactttattga

SEQ ID NO: 17364 - DNA, 35 bp, Artificial Sequence
  Synthetic oligonucleotide
ttgacagactccctttccccgaggactccttgccc

SEQ ID NO: 17365 - DNA, 35 bp, Artificial Sequence
  Synthetic oligonucleotide
gggaaaagggggcagagaggaaaattgaaggtgcg

SEQ ID NO: 17366 - DNA, 35 bp, Artificial Sequence
  Synthetic oligonucleotide
tacaagcccgcgctcccatcaatgctcacttccga

SEQ ID NO: 17367 - DNA, 38 bp, Artificial Sequence
  Synthetic oligonucleotide
tttgcgtggagagggctgctaggagtggctgggggtga

SEQ ID NO: 17368 - DNA, 38 bp, Artificial Sequence
  Synthetic oligonucleotide
tcacaaatcgcctgtgccgtgtgccctttctactttga

SEQ ID NO: 17369 - DNA, 35 bp, Artificial Sequence
  Synthetic oligonucleotide
tacgaatagccgttgcacatgtcctctcctgtttc

SEQ ID NO: 17370 - DNA, 35 bp, Artificial Sequence
  Synthetic oligonucleotide
tcgcaacaccctttcgagcacctgttatacccccg

SEQ ID NO: 17371 - DNA, 35 bp, Artificial Sequence
  Synthetic oligonucleotide
accatcgtgcacctggtatgcgccacttccttcat

SEQ ID NO: 17372 - DNA, 35 bp, Artificial Sequence
  Synthetic oligonucleotide
tctgcggggccaccaggtcaagcacccactcgcct

SEQ ID NO: 17373 - DNA, 35 bp, Artificial Sequence
  Synthetic oligonucleotide
gatgctcgttggtctcctcgtctccgccctctgta

SEQ ID NO: 17374 - DNA, 35 bp, Artificial Sequence
  Synthetic oligonucleotide
atcatacaggcaggacgttatcatctgcccctttc

SEQ ID NO: 17375 - DNA, 34 bp, Artificial Sequence
  Synthetic oligonucleotide
accagacgacaacaccccttttgcccctccgtag

SEQ ID NO: 17376 - DNA, 35 bp, Artificial Sequence
  Synthetic oligonucleotide
attgtgcaccccctgaccgcagtgaccgcccctcc

SEQ ID NO: 17377 - DNA, 35 bp, Artificial Sequence
  Synthetic oligonucleotide
accacaccccgtattttcggtattcaacttgtatc

SEQ ID NO: 17378 - DNA, 35 bp, Artificial Sequence
  Synthetic oligonucleotide
aaacaccgaagttgactatcacccttcttttcacg

SEQ ID NO: 17379 - DNA, 32 bp, Artificial Sequence
  Synthetic oligonucleotide
accgaaggtccgttgtactcgttttttgccat

SEQ ID NO: 17380 - DNA, 35 bp, Artificial Sequence
  Synthetic oligonucleotide
gcttcctcctggcctgtttaagttcattgaagtat

SEQ ID NO: 17381 - DNA, 36 bp, Artificial Sequence
  Synthetic oligonucleotide
acttatacgcacagggggaggaggggtaggggttaa

SEQ ID NO: 17382 - DNA, 36 bp, Artificial Sequence
  Synthetic oligonucleotide
agcggaatggaaggggggaacaaatagggcctcgga

SEQ ID NO: 17383 - DNA, 35 bp, Artificial Sequence
  Synthetic oligonucleotide
tcacacgctagctctggatttctccgcggtgtctc

SEQ ID NO: 17384 - DNA, 35 bp, Artificial Sequence
  Synthetic oligonucleotide
tagtgctgcagaggatccacctagcacgctaatat

SEQ ID NO: 17385 - DNA, 35 bp, Artificial Sequence
  Synthetic oligonucleotide
acatagagcgtagccctcctaccatgcttcttgtt

SEQ ID NO: 17386 - DNA, 35 bp, Artificial Sequence
  Synthetic oligonucleotide
gccaacgtacgatagcaccctaaataactcccttt

SEQ ID NO: 17387 - DNA, 37 bp, Artificial Sequence
  Synthetic oligonucleotide
ttgtgccccgttcgcctgatctccctgtttgcatgga

SEQ ID NO: 17388 - DNA, 37 bp, Artificial Sequence
  Synthetic oligonucleotide
acgcccgcctccgctttgatttagcctttctccatga

SEQ ID NO: 17389 - DNA, 38 bp, Artificial Sequence
  Synthetic oligonucleotide
acctcccatccgcaatatttatgatctagttaccgtga

SEQ ID NO: 17390 - DNA, 36 bp, Artificial Sequence
  Synthetic oligonucleotide
gacctcagcccaagtcttagatcaatgcacccgtta

SEQ ID NO: 17391 - DNA, 35 bp, Artificial Sequence
  Synthetic oligonucleotide
tcactgtcccttcatcactgttccaactggttggc

SEQ ID NO: 17392 - DNA, 35 bp, Artificial Sequence
  Synthetic oligonucleotide
gcacacctgtcttcatctagatcactttctacacg

SEQ ID NO: 17393 - DNA, 35 bp, Artificial Sequence
  Synthetic oligonucleotide
accccaggttcgctgtcatcagttactcccctctg

SEQ ID NO: 17394 - DNA, 36 bp, Artificial Sequence
  Synthetic oligonucleotide
atcgccggtcgccattcaccaggtattttgtctcaa

SEQ ID NO: 17395 - DNA, 38 bp, Artificial Sequence
  Synthetic oligonucleotide
tacgaactgtatgacccaagctcccagtcctctactga

SEQ ID NO: 17396 - DNA, 37 bp, Artificial Sequence
  Synthetic oligonucleotide
gtgaaacacggcgaaaaaacgggtatgggagctgtga

SEQ ID NO: 17397 - DNA, 37 bp, Artificial Sequence
  Synthetic oligonucleotide
gtcaacgacgaatgtcaacccctcgcatactctttga

SEQ ID NO: 17398 - DNA, 35 bp, Artificial Sequence
  Synthetic oligonucleotide
aacactccccgcgaacacggtacaacctactgaac

SEQ ID NO: 17399 - DNA, 35 bp, Artificial Sequence
  Synthetic oligonucleotide
gcacagggccaccactcacgcttccatctcgtcgt

SEQ ID NO: 17400 - DNA, 35 bp, Artificial Sequence
  Synthetic oligonucleotide
tcctcggtccccggccatcttgactatcttgtcga

SEQ ID NO: 17401 - DNA, 37 bp, Artificial Sequence
  Synthetic oligonucleotide
tttgcccccgtcctgcctttagcgtcccatgcggtga

SEQ ID NO: 17402 - DNA, 35 bp, Artificial Sequence
  Synthetic oligonucleotide
acccacgccacgaaatcatataatccgtcttatcc

SEQ ID NO: 17403 - DNA, 36 bp, Artificial Sequence
  Synthetic oligonucleotide
gagctgtgggatcgaagtgcgggtgggagggcgaaa

SEQ ID NO: 17404 - DNA, 35 bp, Artificial Sequence
  Synthetic oligonucleotide
tcactccccgaagttgccagaacagaaatttcctc

SEQ ID NO: 17405 - DNA, 35 bp, Artificial Sequence
  Synthetic oligonucleotide
acatacctcaagtgctcatcagtcgcaatcactat

SEQ ID NO: 17406 - DNA, 36 bp, Artificial Sequence
  Synthetic oligonucleotide
gagtcacaccgctgccgtgtttgccgaccctgtcca

SEQ ID NO: 17407 - DNA, 36 bp, Artificial Sequence
  Synthetic oligonucleotide
gagggcgagggctagggggatagggtgttggtgcga

SEQ ID NO: 17408 - DNA, 35 bp, Artificial Sequence
  Synthetic oligonucleotide
taatagccgcagcaactcgaactctttgcgccacc

SEQ ID NO: 17409 - DNA, 35 bp, Artificial Sequence
  Synthetic oligonucleotide
gatgcgcatcaatcctccgtttcaacatcgtcccg

SEQ ID NO: 17410 - DNA, 35 bp, Artificial Sequence
  Synthetic oligonucleotide
taagggtagggaaagatcttaggaggttaagggtg

SEQ ID NO: 17411 - DNA, 35 bp, Artificial Sequence
  Synthetic oligonucleotide
accccctgcatttatgcgcaaggttaactaccttt

SEQ ID NO: 17412 - DNA, 35 bp, Artificial Sequence
  Synthetic oligonucleotide
ttcccccaaacgtccggttcgttactttgcttacc

SEQ ID NO: 17413 - DNA, 34 bp, Artificial Sequence
  Synthetic oligonucleotide
aagacacgtgcccccccccttcctggtttagttt

SEQ ID NO: 17414 - DNA, 36 bp, Artificial Sequence
  Synthetic oligonucleotide
gtcgtgtcccatcaatgacccgtgcgtcatcaacca

SEQ ID NO: 17415 - DNA, 35 bp, Artificial Sequence
  Synthetic oligonucleotide
accatcccccgcgatatagggcaaatactaccgca

SEQ ID NO: 17416 - DNA, 37 bp, Artificial Sequence
  Synthetic oligonucleotide
agcactggcgtcacctgcctaccacaccaacttctga

SEQ ID NO: 17417 - DNA, 35 bp, Artificial Sequence
  Synthetic oligonucleotide
tttgggagtggtgaaatgggataggggtaaggaga

SEQ ID NO: 17418 - DNA, 36 bp, Artificial Sequence
  Synthetic oligonucleotide
tcctcctctgccgtgcgagcttacttgacatcacga

SEQ ID NO: 17419 - DNA, 35 bp, Artificial Sequence
  Synthetic oligonucleotide
aatgacaatggggagggtgcgtggggggttcgagg

SEQ ID NO: 17420 - DNA, 35 bp, Artificial Sequence
  Synthetic oligonucleotide
tcgagcgttcatccgcgcctctacccgttttgtct

SEQ ID NO: 17421 - DNA, 35 bp, Artificial Sequence
  Synthetic oligonucleotide
tctagcaccgtggtggttctgtcggtttccctgtt

SEQ ID NO: 17422 - DNA, 36 bp, Artificial Sequence
  Synthetic oligonucleotide
aacccccccgcccttccaggtctcaccagtttttaa

SEQ ID NO: 17423 - DNA, 37 bp, Artificial Sequence
  Synthetic oligonucleotide
agttccatccgccggtggcataaacacaccacgacga

SEQ ID NO: 17424 - DNA, 38 bp, Artificial Sequence
  Synthetic oligonucleotide
gcgtgtcggggtgagaggggatagggcggctcggttga

SEQ ID NO: 17425 - DNA, 35 bp, Artificial Sequence
  Synthetic oligonucleotide
ttattccgcgcccgagctttctgccacattattta

SEQ ID NO: 17426 - DNA, 35 bp, Artificial Sequence
  Synthetic oligonucleotide
ctcgacacctgtcccggttttgccacccacttctg

SEQ ID NO: 17427 - DNA, 35 bp, Artificial Sequence
  Synthetic oligonucleotide
ttcgtggccgtctcttctttcttcatcaacgctgt

SEQ ID NO: 17428 - DNA, 35 bp, Artificial Sequence
  Synthetic oligonucleotide
tcagctcccactgcgccgtcctcgtgaactgcctt

SEQ ID NO: 17429 - DNA, 36 bp, Artificial Sequence
  Synthetic oligonucleotide
tccagagacgtcctgcctgtagccccgccgcctaaa

SEQ ID NO: 17430 - DNA, 35 bp, Artificial Sequence
  Synthetic oligonucleotide
gcgctgggccgttattgctcctctctctcgccgca

SEQ ID NO: 17431 - DNA, 35 bp, Artificial Sequence
  Synthetic oligonucleotide
gtatgcaaccgcctggcatagttgccactaccctc

SEQ ID NO: 17432 - DNA, 35 bp, Artificial Sequence
  Synthetic oligonucleotide
acccgttatatccgacctattgtatgtcgttcctc

SEQ ID NO: 17433 - DNA, 35 bp, Artificial Sequence
  Synthetic oligonucleotide
gccgctccgactctcttggtccactcgcatttcat

SEQ ID NO: 17434 - DNA, 38 bp, Artificial Sequence
  Synthetic oligonucleotide
gaaccatccaagcttggcctcaaagaatcattctttga

SEQ ID NO: 17435 - DNA, 35 bp, Artificial Sequence
  Synthetic oligonucleotide
tagaacgccgacggcacttggcttttgctacttcc

SEQ ID NO: 17436 - DNA, 35 bp, Artificial Sequence
  Synthetic oligonucleotide
tagaactgccaccccgttccacttctgcgagaatt

SEQ ID NO: 17437 - DNA, 36 bp, Artificial Sequence
  Synthetic oligonucleotide
tccaccccggcccactagccactgaacggagtaatt

SEQ ID NO: 17438 - DNA, 35 bp, Artificial Sequence
  Synthetic oligonucleotide
gtgccagatcgcctcaccggtcactaattgctttt

SEQ ID NO: 17439 - DNA, 36 bp, Artificial Sequence
  Synthetic oligonucleotide
tcattctgccgcttgccttcgccactcgccgtaaca

SEQ ID NO: 17440 - DNA, 35 bp, Artificial Sequence
  Synthetic oligonucleotide
ggtgagggatgacggcacgaggggaaaatcaggca

SEQ ID NO: 17441 - DNA, 37 bp, Artificial Sequence
  Synthetic oligonucleotide
tcctgtccctctgccccgtgcttactaagtcgcagga

SEQ ID NO: 17442 - DNA, 37 bp, Artificial Sequence
  Synthetic oligonucleotide
gtcctgcgctgccgtgccgctccctgtagttccttga

SEQ ID NO: 17443 - DNA, 35 bp, Artificial Sequence
  Synthetic oligonucleotide
ggtggaatatcacatcgaagggagggggtcacgcg

SEQ ID NO: 17444 - DNA, 35 bp, Artificial Sequence
  Synthetic oligonucleotide
ttgagacctcggtcgtatcaccgcacctcctgttt

SEQ ID NO: 17445 - DNA, 37 bp, Artificial Sequence
  Synthetic oligonucleotide
aagggaggagggtgcagtaggaggaatcggctaacga

SEQ ID NO: 17446 - DNA, 35 bp, Artificial Sequence
  Synthetic oligonucleotide
tcctgcacccccgccttgttgagcccctcctctct

SEQ ID NO: 17447 - DNA, 35 bp, Artificial Sequence
  Synthetic oligonucleotide
acgtgcagtcagaactcgatacctttgcctgtctt

SEQ ID NO: 17448 - DNA, 37 bp, Artificial Sequence
  Synthetic oligonucleotide
gctagaagggaggataggtgggtggggccaggaggga

SEQ ID NO: 17449 - DNA, 36 bp, Artificial Sequence
  Synthetic oligonucleotide
tcccagagagatctggcttgaacctccccaacctta

SEQ ID NO: 17450 - DNA, 35 bp, Artificial Sequence
  Synthetic oligonucleotide
gacatgattgtctcggcattaccgcatcctaccac

SEQ ID NO: 17451 - DNA, 35 bp, Artificial Sequence
  Synthetic oligonucleotide
aaacccactgttactataacgctcacccactggcc

SEQ ID NO: 17452 - DNA, 35 bp, Artificial Sequence
  Synthetic oligonucleotide
tacatgccggaccctgccagcatcccttaacgttc

SEQ ID NO: 17453 - DNA, 36 bp, Artificial Sequence
  Synthetic oligonucleotide
gcaacccgtggattgtaaccgcccatcatgccaaca

SEQ ID NO: 17454 - DNA, 37 bp, Artificial Sequence
  Synthetic oligonucleotide
gtgaaagcctgcctcccatctgaccatgcccctgcga

SEQ ID NO: 17455 - DNA, 37 bp, Artificial Sequence
  Synthetic oligonucleotide
taaatggggggacgccaagggggtgcaggggatggga

SEQ ID NO: 17456 - DNA, 38 bp, Artificial Sequence
  Synthetic oligonucleotide
ttgccacaccgctgttgaccctaagcacctgcacatga

SEQ ID NO: 17457 - DNA, 37 bp, Artificial Sequence
  Synthetic oligonucleotide
tccgtctcctgccacactccttgagtactcctgctga

SEQ ID NO: 17458 - DNA, 36 bp, Artificial Sequence
  Synthetic oligonucleotide
ggaggagggcctgaagaaggtggtgggcataatgta

SEQ ID NO: 17459 - DNA, 32 bp, Artificial Sequence
  Synthetic oligonucleotide
atcccgacacccagttttcctaggctccccgc

SEQ ID NO: 17460 - DNA, 35 bp, Artificial Sequence
  Synthetic oligonucleotide
ggaggggcgaaacggaatatctataggggaggggt

SEQ ID NO: 17461 - DNA, 35 bp, Artificial Sequence
  Synthetic oligonucleotide
agtgctatccacctgcgtaacatcttacctgcttt

SEQ ID NO: 17462 - DNA, 36 bp, Artificial Sequence
  Synthetic oligonucleotide
atcaactccatgctccccgcgcttccttccggtgaa

SEQ ID NO: 17463 - DNA, 37 bp, Artificial Sequence
  Synthetic oligonucleotide
gtgcacacacttatgcattcttccgtcctgaatttga

SEQ ID NO: 17464 - DNA, 38 bp, Artificial Sequence
  Synthetic oligonucleotide
ataccacgcgcccggttcccatcgacggcccactttga

SEQ ID NO: 17465 - DNA, 36 bp, Artificial Sequence
  Synthetic oligonucleotide
tagatcccgccgcacaccacagtactaccctttcta

SEQ ID NO: 17466 - DNA, 35 bp, Artificial Sequence
  Synthetic oligonucleotide
actgatcgctcacacgtttttggctggcctggccc

SEQ ID NO: 17467 - DNA, 35 bp, Artificial Sequence
  Synthetic oligonucleotide
tcagttcgctgccaccgctgatcttggtcttctat

SEQ ID NO: 17468 - DNA, 35 bp, Artificial Sequence
  Synthetic oligonucleotide
ttgatcgcaaggttacattcctacccgtacctttt

SEQ ID NO: 17469 - DNA, 37 bp, Artificial Sequence
  Synthetic oligonucleotide
gatgatacgaaaggtggacggaacgggagcacatgga

SEQ ID NO: 17470 - DNA, 35 bp, Artificial Sequence
  Synthetic oligonucleotide
gagacgctcccgccccgcgccgaccccgagtcctt

SEQ ID NO: 17471 - DNA, 35 bp, Artificial Sequence
  Synthetic oligonucleotide
aacacgaagggggaatggagcaataagggatgctt

SEQ ID NO: 17472 - DNA, 36 bp, Artificial Sequence
  Synthetic oligonucleotide
agaaaggaagggtgggtgagagtaataggggttgaa

SEQ ID NO: 17473 - DNA, 38 bp, Artificial Sequence
  Synthetic oligonucleotide
accgctagccgtcgctccctcatcgctcaaccccgtga

SEQ ID NO: 17474 - DNA, 34 bp, Artificial Sequence
  Synthetic oligonucleotide
gactcccctatcctactatcgacctgccagtacg

SEQ ID NO: 17475 - DNA, 35 bp, Artificial Sequence
  Synthetic oligonucleotide
gcaaccgaccctggtgatttacactaccaatctcg

SEQ ID NO: 17476 - DNA, 36 bp, Artificial Sequence
  Synthetic oligonucleotide
tgctatcccgcactatgcgtcgcattatcttcccaa

SEQ ID NO: 17477 - DNA, 37 bp, Artificial Sequence
  Synthetic oligonucleotide
gtacccgccacttggtccgccggccaccaccatggga

SEQ ID NO: 17478 - DNA, 36 bp, Artificial Sequence
  Synthetic oligonucleotide
tagtaagggagtctgaggggaggtggaaggagagta

SEQ ID NO: 17479 - DNA, 35 bp, Artificial Sequence
  Synthetic oligonucleotide
ttgacaccctgtcaatacttattgtaacttcgttt

SEQ ID NO: 17480 - DNA, 35 bp, Artificial Sequence
  Synthetic oligonucleotide
agccacagtgcccagcagcctttccccttctttag

SEQ ID NO: 17481 - DNA, 35 bp, Artificial Sequence
  Synthetic oligonucleotide
ttgatcaggcgcatccctgcaatcctaccactcca

SEQ ID NO: 17482 - DNA, 37 bp, Artificial Sequence
  Synthetic oligonucleotide
gcaccatactgctctactatgtacgtacctttgcgga

SEQ ID NO: 17483 - DNA, 38 bp, Artificial Sequence
  Synthetic oligonucleotide
gatccctgcccactctctgcatcaggccataaatatga

SEQ ID NO: 17484 - DNA, 35 bp, Artificial Sequence
  Synthetic oligonucleotide
ggtcccccccccgtgtaaaccatctgtagctttag

SEQ ID NO: 17485 - DNA, 35 bp, Artificial Sequence
  Synthetic oligonucleotide
atgcgcactgttcaactttatcctgctggttctat

SEQ ID NO: 17486 - DNA, 35 bp, Artificial Sequence
  Synthetic oligonucleotide
acacactccccaccatgagattttaggtagttaca

SEQ ID NO: 17487 - DNA, 35 bp, Artificial Sequence
  Synthetic oligonucleotide
gcaccatcaccctcttacatgacctgtatatcagg

SEQ ID NO: 17488 - DNA, 35 bp, Artificial Sequence
  Synthetic oligonucleotide
tgcacacgcccaatttattcatacgttcgtcccat

SEQ ID NO: 17489 - DNA, 35 bp, Artificial Sequence
  Synthetic oligonucleotide
cactgatccactatgtcctccctgaaatcctgagt

SEQ ID NO: 17490 - DNA, 35 bp, Artificial Sequence
  Synthetic oligonucleotide
gcgaacggggcatccgtccacatacacttgcaatt

SEQ ID NO: 17491 - DNA, 37 bp, Artificial Sequence
  Synthetic oligonucleotide
gatcctcgattcaaacatactgccttccttccggtga

SEQ ID NO: 17492 - DNA, 35 bp, Artificial Sequence
  Synthetic oligonucleotide
gaacacacgaataggacctgtttacgccattttcc

SEQ ID NO: 17493 - DNA, 35 bp, Artificial Sequence
  Synthetic oligonucleotide
tgccatgtaagccacgcttcgtaattttaggcctc

SEQ ID NO: 17494 - DNA, 35 bp, Artificial Sequence
  Synthetic oligonucleotide
atcgccctgagcaagtttttttaccctgtttttca

SEQ ID NO: 17495 - DNA, 37 bp, Artificial Sequence
  Synthetic oligonucleotide
acccacgatcgcccgcccatgtcgtcaagcattacga

SEQ ID NO: 17496 - DNA, 35 bp, Artificial Sequence
  Synthetic oligonucleotide
ttacccctgaccgatgactgcccataaccctgata

SEQ ID NO: 17497 - DNA, 35 bp, Artificial Sequence
  Synthetic oligonucleotide
tcatcgggcgcctcccgacccttaaccttttttag

SEQ ID NO: 17498 - DNA, 35 bp, Artificial Sequence
  Synthetic oligonucleotide
aaccaaggcggtattcccgttctgttacactctct

SEQ ID NO: 17499 - DNA, 36 bp, Artificial Sequence
  Synthetic oligonucleotide
tcccgccgccaaccctatacatgcaatactgcgtca

SEQ ID NO: 17500 - DNA, 37 bp, Artificial Sequence
  Synthetic oligonucleotide
acagtccgaccccctatctgtgccgaccctcttggga

SEQ ID NO: 17501 - DNA, 38 bp, Artificial Sequence
  Synthetic oligonucleotide
gcctcatcggtcccttggcctctgcacctcaaccttga

SEQ ID NO: 17502 - DNA, 35 bp, Artificial Sequence
  Synthetic oligonucleotide
gacatcgcactcgctgtttgtttattttctacttc

SEQ ID NO: 17503 - DNA, 35 bp, Artificial Sequence
  Synthetic oligonucleotide
atggaagcaccggaaaggggatatagggagtgaag

SEQ ID NO: 17504 - DNA, 35 bp, Artificial Sequence
  Synthetic oligonucleotide
agtgcatcaaacgcgcctcgagtccaccgttctct

SEQ ID NO: 17505 - DNA, 36 bp, Artificial Sequence
  Synthetic oligonucleotide
tacgtccctcaccgttgcccttcataagttgaccga

SEQ ID NO: 17506 - DNA, 36 bp, Artificial Sequence
  Synthetic oligonucleotide
gccctagccaccctcaccacaccttcgagagaagga

SEQ ID NO: 17507 - DNA, 38 bp, Artificial Sequence
  Synthetic oligonucleotide
atcgctgcaggtcgtatatcttatcctgtgccctttga

SEQ ID NO: 17508 - DNA, 36 bp, Artificial Sequence
  Synthetic oligonucleotide
acagacacacattgattttcattatgcccgccttta

SEQ ID NO: 17509 - DNA, 35 bp, Artificial Sequence
  Synthetic oligonucleotide
gacacctcctatcgacccactgcacgtactctacc

SEQ ID NO: 17510 - DNA, 35 bp, Artificial Sequence
  Synthetic oligonucleotide
gcatggataccgcgctgaaccaagaccactggcct

SEQ ID NO: 17511 - DNA, 35 bp, Artificial Sequence
  Synthetic oligonucleotide
ttgactgcacgcacatactcagcgttacttcccac

SEQ ID NO: 17512 - DNA, 35 bp, Artificial Sequence
  Synthetic oligonucleotide
tcccatcgcccggtcacgttcaaaggaaactcgcc

SEQ ID NO: 17513 - DNA, 35 bp, Artificial Sequence
  Synthetic oligonucleotide
gccactcgaatagccggtaggtatcctgttccgtc

SEQ ID NO: 17514 - DNA, 35 bp, Artificial Sequence
  Synthetic oligonucleotide
aaggtctacccgggccgtccctcccatcgctctcg

SEQ ID NO: 17515 - DNA, 35 bp, Artificial Sequence
  Synthetic oligonucleotide
ttattctccacccctgcccgtagaacgtatgttcg

SEQ ID NO: 17516 - DNA, 35 bp, Artificial Sequence
  Synthetic oligonucleotide
tgtccgtccaacgaaccgattggccacctattact

SEQ ID NO: 17517 - DNA, 37 bp, Artificial Sequence
  Synthetic oligonucleotide
gcctgcctatcattcgcgtcaccccactgtcgtccga

SEQ ID NO: 17518 - DNA, 37 bp, Artificial Sequence
  Synthetic oligonucleotide
ttggcccctgcgctcctgtttcgattctatgctttga

SEQ ID NO: 17519 - DNA, 38 bp, Artificial Sequence
  Synthetic oligonucleotide
gactccaccattgtacttgccccagctcacaggtttga

SEQ ID NO: 17520 - DNA, 36 bp, Artificial Sequence
  Synthetic oligonucleotide
actcactgcccctaaacgtgctctcaatgttctgaa

SEQ ID NO: 17521 - DNA, 37 bp, Artificial Sequence
  Synthetic oligonucleotide
gttgcgagcgcacatctgactctacccatcgcccaga

SEQ ID NO: 17522 - DNA, 37 bp, Artificial Sequence
  Synthetic oligonucleotide
gcgcacttcttcacccatctcgcatagtgccactgga

SEQ ID NO: 17523 - DNA, 38 bp, Artificial Sequence
  Synthetic oligonucleotide
tccaattcgcacaaggctctattatgtcccgttcttga

SEQ ID NO: 17524 - DNA, 36 bp, Artificial Sequence
  Synthetic oligonucleotide
gtccacctgtcatctccgagttcggctaactcgcta

SEQ ID NO: 17525 - DNA, 35 bp, Artificial Sequence
  Synthetic oligonucleotide
aacgtgactcatcgcgttcatactatgcccaatcc

SEQ ID NO: 17526 - DNA, 35 bp, Artificial Sequence
  Synthetic oligonucleotide
aacgccgcaggtagttttccacacccaccgtatcg

SEQ ID NO: 17527 - DNA, 35 bp, Artificial Sequence
  Synthetic oligonucleotide
gaccagagcactgcactaatgacctaccttggcat

SEQ ID NO: 17528 - DNA, 35 bp, Artificial Sequence
  Synthetic oligonucleotide
agaccgtaggtccatggtgatttctcacgtgctct

SEQ ID NO: 17529 - DNA, 36 bp, Artificial Sequence
  Synthetic oligonucleotide
gctgcacccccgtcgttcccgccgagcatatcccca

SEQ ID NO: 17530 - DNA, 37 bp, Artificial Sequence
  Synthetic oligonucleotide
tctgactgaccctgcctcgcttcaacgaccctcccga

SEQ ID NO: 17531 - DNA, 37 bp, Artificial Sequence
  Synthetic oligonucleotide
gtagagcgaggtgaacgggcgaattggaggaggggga

SEQ ID NO: 17532 - DNA, 36 bp, Artificial Sequence
  Synthetic oligonucleotide
aacacctcaacagtttaaacaagccactctcgcata

SEQ ID NO: 17533 - DNA, 35 bp, Artificial Sequence
  Synthetic oligonucleotide
tgccctctatagctggctccatttccttgtcctgc

SEQ ID NO: 17534 - DNA, 35 bp, Artificial Sequence
  Synthetic oligonucleotide
acccgacacaccccttcgcgagccctcgtatgcag

SEQ ID NO: 17535 - DNA, 35 bp, Artificial Sequence
  Synthetic oligonucleotide
gtacatctgtgtggtacccctatcagccactccct

SEQ ID NO: 17536 - DNA, 36 bp, Artificial Sequence
  Synthetic oligonucleotide
gtgacgagacggtggggtagggaaacgcgaggacga

SEQ ID NO: 17537 - DNA, 37 bp, Artificial Sequence
  Synthetic oligonucleotide
tccggagtaggcgaaggggaagggatcattggtggga

SEQ ID NO: 17538 - DNA, 38 bp, Artificial Sequence
  Synthetic oligonucleotide
tacacgctccaatcttcgtgcatccacgccatacctga

SEQ ID NO: 17539 - DNA, 38 bp, Artificial Sequence
  Synthetic oligonucleotide
tcacatgcccacgcacatacgagcctccttgtacttga

SEQ ID NO: 17540 - DNA, 35 bp, Artificial Sequence
  Synthetic oligonucleotide
gaccaccccccgccatgtcataacatccattatcc

SEQ ID NO: 17541 - DNA, 35 bp, Artificial Sequence
  Synthetic oligonucleotide
tccatccccagaggtatccttccccgcggcactgc

SEQ ID NO: 17542 - DNA, 35 bp, Artificial Sequence
  Synthetic oligonucleotide
gtttcgcgttcacagtcgatccctgcccccccatg

SEQ ID NO: 17543 - DNA, 35 bp, Artificial Sequence
  Synthetic oligonucleotide
tccaaccgctgcccactcgcgccatgatgcccctg

SEQ ID NO: 17544 - DNA, 36 bp, Artificial Sequence
  Synthetic oligonucleotide
tatccaaacgccctctatgtctcgtctttcttggga

SEQ ID NO: 17545 - DNA, 35 bp, Artificial Sequence
  Synthetic oligonucleotide
taggcccatttctcctgcctggtttgatcctgtga

SEQ ID NO: 17546 - DNA, 37 bp, Artificial Sequence
  Synthetic oligonucleotide
tccgccgctgagctgccgctatcccctcgatctttga

SEQ ID NO: 17547 - DNA, 35 bp, Artificial Sequence
  Synthetic oligonucleotide
gtccgacccatcgcccaaaccgaacagcccatctg

SEQ ID NO: 17548 - DNA, 35 bp, Artificial Sequence
  Synthetic oligonucleotide
acgcccaatgagcccgctcaggtactttgccctat

SEQ ID NO: 17549 - DNA, 36 bp, Artificial Sequence
  Synthetic oligonucleotide
gatgctctcaggggtccgctccactcctttatggca

SEQ ID NO: 17550 - DNA, 38 bp, Artificial Sequence
  Synthetic oligonucleotide
tccacctgctgtggagcgggccgtccttttttacctga

SEQ ID NO: 17551 - DNA, 37 bp, Artificial Sequence
  Synthetic oligonucleotide
accccccaccgctgttaggattactctcctcccgtga

SEQ ID NO: 17552 - DNA, 35 bp, Artificial Sequence
  Synthetic oligonucleotide
ttacaactttgcccgccctagcctgtgctacccat

SEQ ID NO: 17553 - DNA, 35 bp, Artificial Sequence
  Synthetic oligonucleotide
tttcccgccgctcttacgggcctagaatcttgtct

SEQ ID NO: 17554 - DNA, 35 bp, Artificial Sequence
  Synthetic oligonucleotide
gcatgttccatttttcccccctagccacggtccca

SEQ ID NO: 17555 - DNA, 38 bp, Artificial Sequence
  Synthetic oligonucleotide
atgccaccctatctatgcctccgggagatccttactga

SEQ ID NO: 17556 - DNA, 37 bp, Artificial Sequence
  Synthetic oligonucleotide
tttgcaccccactcatagtagtaagccacctatttga

SEQ ID NO: 17557 - DNA, 35 bp, Artificial Sequence
  Synthetic oligonucleotide
ttagggaaaggggtgatggggcgttgtcgaagggg

SEQ ID NO: 17558 - DNA, 36 bp, Artificial Sequence
  Synthetic oligonucleotide
tttatcgcccctcgccccccatacctgggcccgaca

SEQ ID NO: 17559 - DNA, 36 bp, Artificial Sequence
  Synthetic oligonucleotide
gcgccgcaatgtggccgcccatcctcccaaaacgga

SEQ ID NO: 17560 - DNA, 38 bp, Artificial Sequence
  Synthetic oligonucleotide
acttccgcacctgaccgcttaaagttcgtgacccatga

SEQ ID NO: 17561 - DNA, 38 bp, Artificial Sequence
  Synthetic oligonucleotide
acccagccacagcggcgttttgcgtcctacctgcgtga

SEQ ID NO: 17562 - DNA, 35 bp, Artificial Sequence
  Synthetic oligonucleotide
tcatcagcccttctctcgaacctgacctaccagcc

SEQ ID NO: 17563 - DNA, 35 bp, Artificial Sequence
  Synthetic oligonucleotide
ttaacacgcacctgtttcttcctctctttacccgg

SEQ ID NO: 17564 - DNA, 35 bp, Artificial Sequence
  Synthetic oligonucleotide
tcatgcgtgggccacccgctgccacttgctttttt

SEQ ID NO: 17565 - DNA, 36 bp, Artificial Sequence
  Synthetic oligonucleotide
gcccaccgtttgctcgccgcagggccaatttcctaa

SEQ ID NO: 17566 - DNA, 37 bp, Artificial Sequence
  Synthetic oligonucleotide
tcagaccacgtctcacattaccgacctcattacgcga

SEQ ID NO: 17567 - DNA, 36 bp, Artificial Sequence
  Synthetic oligonucleotide
tctgtaccgcctctcacttctgttcacagccacgga

SEQ ID NO: 17568 - DNA, 37 bp, Artificial Sequence
  Synthetic oligonucleotide
tgaaacgtgcgatcgttcgcgccttccttcatcttga

SEQ ID NO: 17569 - DNA, 35 bp, Artificial Sequence
  Synthetic oligonucleotide
taccggagccaccatcttgaacttctagaactctc

SEQ ID NO: 17570 - DNA, 35 bp, Artificial Sequence
  Synthetic oligonucleotide
acccggcacacactctgtaccgcacttggatcgct

SEQ ID NO: 17571 - DNA, 35 bp, Artificial Sequence
  Synthetic oligonucleotide
acgaacgcacgctgcacgctccatcaaacttccaa

SEQ ID NO: 17572 - DNA, 37 bp, Artificial Sequence
  Synthetic oligonucleotide
agcacaaaaaggggtaaggttaacgtacggggtagga

SEQ ID NO: 17573 - DNA, 35 bp, Artificial Sequence
  Synthetic oligonucleotide
gaccactgcccttggtaccgtaagtacaccaccgc

SEQ ID NO: 17574 - DNA, 35 bp, Artificial Sequence
  Synthetic oligonucleotide
taagtcccgtgggcccttgttatgttctgttgttc

SEQ ID NO: 17575 - DNA, 35 bp, Artificial Sequence
  Synthetic oligonucleotide
gaatcagggaagggattgagggagaagtggaaggg

SEQ ID NO: 17576 - DNA, 36 bp, Artificial Sequence
  Synthetic oligonucleotide
ggacagtccacatagccgttccacctagcatactca

SEQ ID NO: 17577 - DNA, 37 bp, Artificial Sequence
  Synthetic oligonucleotide
atgactacggcgaatccctgcctgcctcatccaccga

SEQ ID NO: 17578 - DNA, 37 bp, Artificial Sequence
  Synthetic oligonucleotide
aggagcacatctggtcgacctcatcccgttcaactga

SEQ ID NO: 17579 - DNA, 35 bp, Artificial Sequence
  Synthetic oligonucleotide
gccacgtatccgccgcaatctgagctccgatttac

SEQ ID NO: 17580 - DNA, 35 bp, Artificial Sequence
  Synthetic oligonucleotide
aagtggaggtgggaattagtcccagggaatcaagg

SEQ ID NO: 17581 - DNA, 35 bp, Artificial Sequence
  Synthetic oligonucleotide
attggcctcagtaactccaccccgggtcgacacca

SEQ ID NO: 17582 - DNA, 37 bp, Artificial Sequence
  Synthetic oligonucleotide
gtacccacctagccctttacgtccccgaccgtaaaga

SEQ ID NO: 17583 - DNA, 38 bp, Artificial Sequence
  Synthetic oligonucleotide
acctgctgtacgctgcgatacttccccgtccctcgtga

SEQ ID NO: 17584 - DNA, 38 bp, Artificial Sequence
  Synthetic oligonucleotide
aaggactgcatggggacgcaaaaaagcgggaggattga

SEQ ID NO: 17585 - DNA, 35 bp, Artificial Sequence
  Synthetic oligonucleotide
atgtgtgacatctgcattgttcagtccttcttcgc

SEQ ID NO: 17586 - DNA, 36 bp, Artificial Sequence
  Synthetic oligonucleotide
gtcaacatccgtgtggctcaatcgtggcccattcat

SEQ ID NO: 17587 - DNA, 38 bp, Artificial Sequence
  Synthetic oligonucleotide
gagggaggggatggatgcaaaggaaatgggaccccgga

SEQ ID NO: 17588 - DNA, 35 bp, Artificial Sequence
  Synthetic oligonucleotide
gagtgtggaagggggggcacggaagcatgagaagg

SEQ ID NO: 17589 - DNA, 36 bp, Artificial Sequence
  Synthetic oligonucleotide
tacactcccgcccccttgccacaccacatgtaaaga

SEQ ID NO: 17590 - DNA, 38 bp, Artificial Sequence
  Synthetic oligonucleotide
acaccatagtgtgccctctcgttcgcctctcgccgtga

SEQ ID NO: 17591 - DNA, 35 bp, Artificial Sequence
  Synthetic oligonucleotide
gaacacctcaaagcaatcgacgctcacgaacccta

SEQ ID NO: 17592 - DNA, 35 bp, Artificial Sequence
  Synthetic oligonucleotide
tcagtaacctccgggacggtttgcacactttatct

SEQ ID NO: 17593 - DNA, 35 bp, Artificial Sequence
  Synthetic oligonucleotide
actcccatcacacgcgcgtggttcacgtctctagt

SEQ ID NO: 17594 - DNA, 37 bp, Artificial Sequence
  Synthetic oligonucleotide
acgctgttcccctgttctcgcacccctttggcgccga

SEQ ID NO: 17595 - DNA, 35 bp, Artificial Sequence
  Synthetic oligonucleotide
gcactcacctactccaggtaaccatcttggtcact

SEQ ID NO: 17596 - DNA, 36 bp, Artificial Sequence
  Synthetic oligonucleotide
gacggaaacgagcggggaagggttggattatgggaa

SEQ ID NO: 17597 - DNA, 38 bp, Artificial Sequence
  Synthetic oligonucleotide
gactggtccttcgtgccgattagccctccatatactga

SEQ ID NO: 17598 - DNA, 35 bp, Artificial Sequence
  Synthetic oligonucleotide
gctagcattaggatccgcaacctcgccgcccgccc

SEQ ID NO: 17599 - DNA, 35 bp, Artificial Sequence
  Synthetic oligonucleotide
accagcaccgtacgcccgcgccacggcgatctccc

SEQ ID NO: 17600 - DNA, 35 bp, Artificial Sequence
  Synthetic oligonucleotide
ttcgacgccccccaagcctacggaagttctgcccg

SEQ ID NO: 17601 - DNA, 35 bp, Artificial Sequence
  Synthetic oligonucleotide
gtgacaggtggggggggacgggaggtcacgctggg

SEQ ID NO: 17602 - DNA, 35 bp, Artificial Sequence
  Synthetic oligonucleotide
gatgaaacgagggcggggggagtaggggaaggaca

SEQ ID NO: 17603 - DNA, 35 bp, Artificial Sequence
  Synthetic oligonucleotide
gctgtagcagcctccctatgccacgtaaactgcca

SEQ ID NO: 17604 - DNA, 36 bp, Artificial Sequence
  Synthetic oligonucleotide
acccccagtcagtgggttctatgtttccccggctca

SEQ ID NO: 17605 - DNA, 37 bp, Artificial Sequence
  Synthetic oligonucleotide
tctagtccccctcacctgtccctgcgtgactcttaga

SEQ ID NO: 17606 - DNA, 35 bp, Artificial Sequence
  Synthetic oligonucleotide
gaccaggggaatagggatggaatgcatacggggga

SEQ ID NO: 17607 - DNA, 37 bp, Artificial Sequence
  Synthetic oligonucleotide
tccaccctgccgtcgaccctttcgtgtcagcaattga

SEQ ID NO: 17608 - DNA, 35 bp, Artificial Sequence
  Synthetic oligonucleotide
tccccctccctacacagccgcatctccgggagaac

SEQ ID NO: 17609 - DNA, 35 bp, Artificial Sequence
  Synthetic oligonucleotide
taccccgacaccttatcgccactgcctgatctgga

SEQ ID NO: 17610 - DNA, 35 bp, Artificial Sequence
  Synthetic oligonucleotide
gaccgctccgtgtcctcacattacatgtctatgcc

SEQ ID NO: 17611 - DNA, 35 bp, Artificial Sequence
  Synthetic oligonucleotide
tgcgctgtgtgcccacgcccctgcccggtccatgc

SEQ ID NO: 17612 - DNA, 35 bp, Artificial Sequence
  Synthetic oligonucleotide
atctcgcccccggacttattataatgatcaacatg

SEQ ID NO: 17613 - DNA, 35 bp, Artificial Sequence
  Synthetic oligonucleotide
gtgccacgtcctcgattcttgttatcattgtcgct

SEQ ID NO: 17614 - DNA, 36 bp, Artificial Sequence
  Synthetic oligonucleotide
gagccaccacgaactgcattcgaatcatcccttaaa

SEQ ID NO: 17615 - DNA, 36 bp, Artificial Sequence
  Synthetic oligonucleotide
ttctcgacgccccacattgctctgttcatttctaca

SEQ ID NO: 17616 - DNA, 36 bp, Artificial Sequence
  Synthetic oligonucleotide
tctggaccacgcactaccttatgcgactaacaccca

SEQ ID NO: 17617 - DNA, 38 bp, Artificial Sequence
  Synthetic oligonucleotide
accccactctctaagccacttccgtctcaccgccgtga

SEQ ID NO: 17618 - DNA, 37 bp, Artificial Sequence
  Synthetic oligonucleotide
acacgacgtcttatacccttcgtcgtccaatccttga

SEQ ID NO: 17619 - DNA, 36 bp, Artificial Sequence
  Synthetic oligonucleotide
ggactatgctcagcccctgttaattttgctctggta

SEQ ID NO: 17620 - DNA, 35 bp, Artificial Sequence
  Synthetic oligonucleotide
acccatgtaggccctgatactccttggtgtccacc

SEQ ID NO: 17621 - DNA, 35 bp, Artificial Sequence
  Synthetic oligonucleotide
tgaacccgatagccgcccgtgtcgacccaccgccc

SEQ ID NO: 17622 - DNA, 35 bp, Artificial Sequence
  Synthetic oligonucleotide
cccagacaccatgtctatccctacacaccaacaca

SEQ ID NO: 17623 - DNA, 36 bp, Artificial Sequence
  Synthetic oligonucleotide
ttgcaaaccgcttcccctgcacactcacatggcaca

SEQ ID NO: 17624 - DNA, 35 bp, Artificial Sequence
  Synthetic oligonucleotide
tagtgcatggtggggagggcgatagaaaattagga

SEQ ID NO: 17625 - DNA, 38 bp, Artificial Sequence
  Synthetic oligonucleotide
gcccactcgcttccgtcccagcccacacctccacgtga

SEQ ID NO: 17626 - DNA, 37 bp, Artificial Sequence
  Synthetic oligonucleotide
tccacgccttctctaatacacgtgccgttccttttga

SEQ ID NO: 17627 - DNA, 35 bp, Artificial Sequence
  Synthetic oligonucleotide
agtctaagcagcaccactgtttgcggcctcttccc

SEQ ID NO: 17628 - DNA, 38 bp, Artificial Sequence
  Synthetic oligonucleotide
taccggggacgggagggagggggagcccagaaccgtga

SEQ ID NO: 17629 - DNA, 35 bp, Artificial Sequence
  Synthetic oligonucleotide
attctaggccgagcgctgcaagttcctccgctaac

SEQ ID NO: 17630 - DNA, 35 bp, Artificial Sequence
  Synthetic oligonucleotide
atccaatgcccgacttttgctccattgcaccgccc

SEQ ID NO: 17631 - DNA, 35 bp, Artificial Sequence
  Synthetic oligonucleotide
tacgtagggaacccaggtacttgccccgccctccc

SEQ ID NO: 17632 - DNA, 34 bp, Artificial Sequence
  Synthetic oligonucleotide
acgccgtatgcacaagtttatttggcgccctccc

SEQ ID NO: 17633 - DNA, 34 bp, Artificial Sequence
  Synthetic oligonucleotide
acatacgcttagccttgtagtttgtctactcctc

SEQ ID NO: 17634 - DNA, 35 bp, Artificial Sequence
  Synthetic oligonucleotide
tgcctgctcgttccctcttccgcagtcacctcccg

SEQ ID NO: 17635 - DNA, 35 bp, Artificial Sequence
  Synthetic oligonucleotide
atcagcacaccacggcgccctcctcatgtctccgg

SEQ ID NO: 17636 - DNA, 35 bp, Artificial Sequence
  Synthetic oligonucleotide
atcgagtgccgaggagaagggaatgtgctttgtgt

SEQ ID NO: 17637 - DNA, 36 bp, Artificial Sequence
  Synthetic oligonucleotide
tgtgtctccatcgtctctaactggcacatcccctca

SEQ ID NO: 17638 - DNA, 37 bp, Artificial Sequence
  Synthetic oligonucleotide
actgacgaggggccaaaagggttgtaaggggggatga

SEQ ID NO: 17639 - DNA, 38 bp, Artificial Sequence
  Synthetic oligonucleotide
gaagccaccagcccctatatacacaccgccacagttga

SEQ ID NO: 17640 - DNA, 36 bp, Artificial Sequence
  Synthetic oligonucleotide
tctgcccggacctctctcctacaccctgtgtgacga

SEQ ID NO: 17641 - DNA, 37 bp, Artificial Sequence
  Synthetic oligonucleotide
aaagtggggagtacgggatacggtgggatttggtgga

SEQ ID NO: 17642 - DNA, 35 bp, Artificial Sequence
  Synthetic oligonucleotide
aagtaagggtagtagtggggagggacgtatttgtg

SEQ ID NO: 17643 - DNA, 36 bp, Artificial Sequence
  Synthetic oligonucleotide
gacaccatttagccatccgcacctcccatcgtgcaa

SEQ ID NO: 17644 - DNA, 37 bp, Artificial Sequence
  Synthetic oligonucleotide
tgtgtggggcaagccatgcaagggggaggaagagaga

SEQ ID NO: 17645 - DNA, 37 bp, Artificial Sequence
  Synthetic oligonucleotide
gacgaggaccgtgggggaggaaaagcattgtatacga

SEQ ID NO: 17646 - DNA, 36 bp, Artificial Sequence
  Synthetic oligonucleotide
gacccccgtgaaaacacctaactcggccttgaccga

SEQ ID NO: 17647 - DNA, 35 bp, Artificial Sequence
  Synthetic oligonucleotide
ttcgacgccacgtcatccggccacacctatcgtcg

SEQ ID NO: 17648 - DNA, 35 bp, Artificial Sequence
  Synthetic oligonucleotide
tgatgacgcccctgccaatttttaaggtctcacaa

SEQ ID NO: 17649 - DNA, 37 bp, Artificial Sequence
  Synthetic oligonucleotide
tgtataccaaccgtcatccggcgtgctccccccccga

SEQ ID NO: 17650 - DNA, 37 bp, Artificial Sequence
  Synthetic oligonucleotide
gttcatccacaggccgtaccctccctccgcctcgcga

SEQ ID NO: 17651 - DNA, 35 bp, Artificial Sequence
  Synthetic oligonucleotide
gtcgccaccggccagactatctccacccggtgcac

SEQ ID NO: 17652 - DNA, 35 bp, Artificial Sequence
  Synthetic oligonucleotide
acatttgccgccaaccctatccatttaagtgggcc

SEQ ID NO: 17653 - DNA, 35 bp, Artificial Sequence
  Synthetic oligonucleotide
accacacgacattcggctgacgacgaattattatc

SEQ ID NO: 17654 - DNA, 36 bp, Artificial Sequence
  Synthetic oligonucleotide
gaccacggaccgctggtcctttacttccgtgactca

SEQ ID NO: 17655 - DNA, 37 bp, Artificial Sequence
  Synthetic oligonucleotide
aacatggggggttaaattgggtggcaaaggcacggga

SEQ ID NO: 17656 - DNA, 38 bp, Artificial Sequence
  Synthetic oligonucleotide
gccagaccctcagcctcactaagcgcatccccgggtga

SEQ ID NO: 17657 - DNA, 38 bp, Artificial Sequence
  Synthetic oligonucleotide
tcaccacccccactcatctgtcctcctgtacttgttga

SEQ ID NO: 17658 - DNA, 35 bp, Artificial Sequence
  Synthetic oligonucleotide
gagaccggccggactcccactagattgcccaccac

SEQ ID NO: 17659 - DNA, 35 bp, Artificial Sequence
  Synthetic oligonucleotide
tatttcacaactgcctcccgatcgtcgccacaacc

SEQ ID NO: 17660 - DNA, 35 bp, Artificial Sequence
  Synthetic oligonucleotide
ttttcccgcctccatcaccatgccttctgaacatc

SEQ ID NO: 17661 - DNA, 35 bp, Artificial Sequence
  Synthetic oligonucleotide
gaacgacgctacctattatcggctggtcccttttc

SEQ ID NO: 17662 - DNA, 35 bp, Artificial Sequence
  Synthetic oligonucleotide
gagaaggtggtagagtggtgggcagggtgattcgg

SEQ ID NO: 17663 - DNA, 35 bp, Artificial Sequence
  Synthetic oligonucleotide
ggcacgtcataagcctccagccatcgttttccagt

SEQ ID NO: 17664 - DNA, 35 bp, Artificial Sequence
  Synthetic oligonucleotide
tccatgctgccccttatcggtctttctgttgacgt

SEQ ID NO: 17665 - DNA, 35 bp, Artificial Sequence
  Synthetic oligonucleotide
tggaacgccgcatcattcctcctgcgtctaccgca

SEQ ID NO: 17666 - DNA, 36 bp, Artificial Sequence
  Synthetic oligonucleotide
gtttgcgccgcccttatctctggtctagtttgatca

SEQ ID NO: 17667 - DNA, 37 bp, Artificial Sequence
  Synthetic oligonucleotide
ttgacaccctccgcacatgtcccctgtcatcccacga

SEQ ID NO: 17668 - DNA, 35 bp, Artificial Sequence
  Synthetic oligonucleotide
tgtgacacgtgctgctctacctaaactaggcttcc

SEQ ID NO: 17669 - DNA, 35 bp, Artificial Sequence
  Synthetic oligonucleotide
taccatgcgctaagcactaagccttaccttgcctt

SEQ ID NO: 17670 - DNA, 37 bp, Artificial Sequence
  Synthetic oligonucleotide
aactccaccttcacactacagtcatggccgtactgga

SEQ ID NO: 17671 - DNA, 36 bp, Artificial Sequence
  Synthetic oligonucleotide
tcgcacatcgcttccacccctcacgtatgaccgata

SEQ ID NO: 17672 - DNA, 35 bp, Artificial Sequence
  Synthetic oligonucleotide
tacccgcttaggccgtccttcacatctcgctgtta

SEQ ID NO: 17673 - DNA, 36 bp, Artificial Sequence
  Synthetic oligonucleotide
gacctgcctaccttgatttcccgagtgtacttttca

SEQ ID NO: 17674 - DNA, 36 bp, Artificial Sequence
  Synthetic oligonucleotide
atcagtgggggaagcatgttgagtgcggatggggga

SEQ ID NO: 17675 - DNA, 37 bp, Artificial Sequence
  Synthetic oligonucleotide
gaccccgtacactccaccttgagacacacggccctga

SEQ ID NO: 17676 - DNA, 36 bp, Artificial Sequence
  Synthetic oligonucleotide
gcccatgctttccccacctctatgcagtacccgata

SEQ ID NO: 17677 - DNA, 35 bp, Artificial Sequence
  Synthetic oligonucleotide
tcaatggagtggaaaggataagggggttcggagcg

SEQ ID NO: 17678 - DNA, 35 bp, Artificial Sequence
  Synthetic oligonucleotide
gcgatgcttggcgtcccccgcgcaccttagtactt

SEQ ID NO: 17679 - DNA, 36 bp, Artificial Sequence
  Synthetic oligonucleotide
tagcccggccggtaaagggagggaggaatggtcgaa

SEQ ID NO: 17680 - DNA, 37 bp, Artificial Sequence
  Synthetic oligonucleotide
tccagtcgtacccattgttataccggcccccattcga

SEQ ID NO: 17681 - DNA, 37 bp, Artificial Sequence
  Synthetic oligonucleotide
acatcacgctcccgtttctgtcttggtcctcactgga

SEQ ID NO: 17682 - DNA, 38 bp, Artificial Sequence
  Synthetic oligonucleotide
gaggaccctgatgctcagcgctatcacatgttccctga

SEQ ID NO: 17683 - DNA, 38 bp, Artificial Sequence
  Synthetic oligonucleotide
tcctactcgccaatttcgctaccgcatcatctccgtga

SEQ ID NO: 17684 - DNA, 37 bp, Artificial Sequence
  Synthetic oligonucleotide
tccccaactccacatcatgcccgctgtttccagtgta

SEQ ID NO: 17685 - DNA, 35 bp, Artificial Sequence
  Synthetic oligonucleotide
agacccgagcgataaagccgcacctgccctacccc

SEQ ID NO: 17686 - DNA, 36 bp, Artificial Sequence
  Synthetic oligonucleotide
gacccctctcactgacatttgatactctcgtacaca

SEQ ID NO: 17687 - DNA, 37 bp, Artificial Sequence
  Synthetic oligonucleotide
attccaccacaggcactgactctcactcctcgatcga

SEQ ID NO: 17688 - DNA, 37 bp, Artificial Sequence
  Synthetic oligonucleotide
acccactctctggtggtcgttgttcatcctcttgtga

SEQ ID NO: 17689 - DNA, 36 bp, Artificial Sequence
  Synthetic oligonucleotide
acctatcccgcctgaaggccgacatgaactacgcta

SEQ ID NO: 17690 - DNA, 35 bp, Artificial Sequence
  Synthetic oligonucleotide
actgaagggtgtaagtggtggaagggtgttacatg

SEQ ID NO: 17691 - DNA, 35 bp, Artificial Sequence
  Synthetic oligonucleotide
tacaacgcactttcccccgctggcgacaccccgtt

SEQ ID NO: 17692 - DNA, 36 bp, Artificial Sequence
  Synthetic oligonucleotide
accttcacgcagccaattaggatctctccccgtgca

SEQ ID NO: 17693 - DNA, 37 bp, Artificial Sequence
  Synthetic oligonucleotide
accccatcccgacctgtgatacccatccggatcctga

SEQ ID NO: 17694 - DNA, 35 bp, Artificial Sequence
  Synthetic oligonucleotide
ggtggcccctcctccattttattaggttcgtttcc

SEQ ID NO: 17695 - DNA, 36 bp, Artificial Sequence
  Synthetic oligonucleotide
gacatcattcccgcagcctgctggcctattccgtaa

SEQ ID NO: 17696 - DNA, 36 bp, Artificial Sequence
  Synthetic oligonucleotide
tgcaccatccttgcacccttcacgctccgatagcga

SEQ ID NO: 17697 - DNA, 35 bp, Artificial Sequence
  Synthetic oligonucleotide
gcgctgccacgccggtttcaccttccttcttggga

SEQ ID NO: 17698 - DNA, 35 bp, Artificial Sequence
  Synthetic oligonucleotide
atccatccggaccgtgccgcaccctcactatttcc

SEQ ID NO: 17699 - DNA, 35 bp, Artificial Sequence
  Synthetic oligonucleotide
tgccccgtatagctcccgtatggccgtacctactc

SEQ ID NO: 17700 - DNA, 35 bp, Artificial Sequence
  Synthetic oligonucleotide
actatcgcgtcgtcccactttattgccctgttctt

SEQ ID NO: 17701 - DNA, 37 bp, Artificial Sequence
  Synthetic oligonucleotide
ggtcgcatacatgccgtacgcacaccgccctctccga

SEQ ID NO: 17702 - DNA, 38 bp, Artificial Sequence
  Synthetic oligonucleotide
gccctgatcgctctgcaagtacccctcccacactctga

SEQ ID NO: 17703 - DNA, 38 bp, Artificial Sequence
  Synthetic oligonucleotide
tacagccatcccattccctgcgaccatctttcgggtga

SEQ ID NO: 17704 - DNA, 35 bp, Artificial Sequence
  Synthetic oligonucleotide
gacaccttgctttgtacacgtactactgatctctg

SEQ ID NO: 17705 - DNA, 35 bp, Artificial Sequence
  Synthetic oligonucleotide
gctcacctctatgccctgctgacaggtccctcttg

SEQ ID NO: 17706 - DNA, 35 bp, Artificial Sequence
  Synthetic oligonucleotide
tacgctacgtcgttgcgccatcctcatttaatttg

SEQ ID NO: 17707 - DNA, 35 bp, Artificial Sequence
  Synthetic oligonucleotide
gtctaccactaacctttcatagacggaaccacgct

SEQ ID NO: 17708 - DNA, 35 bp, Artificial Sequence
  Synthetic oligonucleotide
tccgcccctgcctattgttcggtcatcgccccatt

SEQ ID NO: 17709 - DNA, 35 bp, Artificial Sequence
  Synthetic oligonucleotide
gactccaccgtcagagcttttccctctagtctctt

SEQ ID NO: 17710 - DNA, 36 bp, Artificial Sequence
  Synthetic oligonucleotide
tcccggtcgaaccgcattgccactgagccctaccga

SEQ ID NO: 17711 - DNA, 35 bp, Artificial Sequence
  Synthetic oligonucleotide
accgccccaccttaccatgaaggttcttgctacac

SEQ ID NO: 17712 - DNA, 35 bp, Artificial Sequence
  Synthetic oligonucleotide
atcgaccctgcactttcaaaattgtcccctttcac

SEQ ID NO: 17713 - DNA, 35 bp, Artificial Sequence
  Synthetic oligonucleotide
gatacatcctgatagttcctagggcctctaatttc

SEQ ID NO: 17714 - DNA, 36 bp, Artificial Sequence
  Synthetic oligonucleotide
ggttgaacacaccacatgccacgcgcgcccttgcca

SEQ ID NO: 17715 - DNA, 37 bp, Artificial Sequence
  Synthetic oligonucleotide
tcacctcacacatagcccactcagaccggtccgaaga

SEQ ID NO: 17716 - DNA, 35 bp, Artificial Sequence
  Synthetic oligonucleotide
tcactcccacatctgttgctttgataagccacaga

SEQ ID NO: 17717 - DNA, 35 bp, Artificial Sequence
  Synthetic oligonucleotide
gatggcaccccgggcctattgtcggtttcccctac

SEQ ID NO: 17718 - DNA, 35 bp, Artificial Sequence
  Synthetic oligonucleotide
gactctccgcgccaatttcttgccagatcgccccc

SEQ ID NO: 17719 - DNA, 36 bp, Artificial Sequence
  Synthetic oligonucleotide
tagccgtaagcgccctctatgcttttcgtacctaca

SEQ ID NO: 17720 - DNA, 36 bp, Artificial Sequence
  Synthetic oligonucleotide
taaccccccctgcccagtacggaccgtggagccata

SEQ ID NO: 17721 - DNA, 35 bp, Artificial Sequence
  Synthetic oligonucleotide
tggatccccgcacatgatccacgaatcttccctac

SEQ ID NO: 17722 - DNA, 35 bp, Artificial Sequence
  Synthetic oligonucleotide
gagtggtgatggtgtgcaagtgagtggtgtgtgtg

SEQ ID NO: 17723 - DNA, 36 bp, Artificial Sequence
  Synthetic oligonucleotide
tctcacttccatctgcccgtgtctgttccctgacta

SEQ ID NO: 17724 - DNA, 35 bp, Artificial Sequence
  Synthetic oligonucleotide
gccaggccccctcatgcttatatggctccattcta

SEQ ID NO: 17725 - DNA, 35 bp, Artificial Sequence
  Synthetic oligonucleotide
agcccccgcctcggtcacatcgagagctgtacttt

SEQ ID NO: 17726 - DNA, 37 bp, Artificial Sequence
  Synthetic oligonucleotide
tccatgccatctgcttcgttccattatgccccgacga

SEQ ID NO: 17727 - DNA, 38 bp, Artificial Sequence
  Synthetic oligonucleotide
aaccacccatcatattcgcaaggactgcaagaccctga

SEQ ID NO: 17728 - DNA, 38 bp, Artificial Sequence
  Synthetic oligonucleotide
tcatcgctgccagaccgccgttatccttgtgcctctga

SEQ ID NO: 17729 - DNA, 35 bp, Artificial Sequence
  Synthetic oligonucleotide
tcacgtcccacgtttcctgcttgtggcatcaacta

SEQ ID NO: 17730 - DNA, 35 bp, Artificial Sequence
  Synthetic oligonucleotide
ttccctcgctgatctctcattgtcatgtcatccta

SEQ ID NO: 17731 - DNA, 35 bp, Artificial Sequence
  Synthetic oligonucleotide
aagggcggtcataagtccccagccgctcccacacc

SEQ ID NO: 17732 - DNA, 35 bp, Artificial Sequence
  Synthetic oligonucleotide
accgccttgaccacgccctatgttacctttgcccc

SEQ ID NO: 17733 - DNA, 35 bp, Artificial Sequence
  Synthetic oligonucleotide
gagcccccgatcggcaaccccgtgccttacacact

SEQ ID NO: 17734 - DNA, 35 bp, Artificial Sequence
  Synthetic oligonucleotide
atcgcaatcaatgttctgtaccctcgttctatcct

SEQ ID NO: 17735 - DNA, 36 bp, Artificial Sequence
  Synthetic oligonucleotide
gaacctccactcctcgatttttatgtacaggcccaa

SEQ ID NO: 17736 - DNA, 38 bp, Artificial Sequence
  Synthetic oligonucleotide
accacacccccgtatatgctctacatgccacaacctga

SEQ ID NO: 17737 - DNA, 33 bp, Artificial Sequence
  Synthetic oligonucleotide
acgatcggttcccatggtcttccagcacatcac

SEQ ID NO: 17738 - DNA, 35 bp, Artificial Sequence
  Synthetic oligonucleotide
tcccacacccaggcggtatatttgcttgtttgtcg

SEQ ID NO: 17739 - DNA, 35 bp, Artificial Sequence
  Synthetic oligonucleotide
attgttcccgctccgccctcgactgccgtattaca

SEQ ID NO: 17740 - DNA, 37 bp, Artificial Sequence
  Synthetic oligonucleotide
gacaaacccttccccgactgagacatgtgcttgcgga

SEQ ID NO: 17741 - DNA, 36 bp, Artificial Sequence
  Synthetic oligonucleotide
tgtccccacccattttaccgtgacagatttcaatga

SEQ ID NO: 17742 - DNA, 37 bp, Artificial Sequence
  Synthetic oligonucleotide
atcaccccccgcccctctccacgaggtcaagtactga

SEQ ID NO: 17743 - DNA, 38 bp, Artificial Sequence
  Synthetic oligonucleotide
ttcacgccacttagcatctaacaccgttcttccgttga

SEQ ID NO: 17744 - DNA, 35 bp, Artificial Sequence
  Synthetic oligonucleotide
accgaagccgctgttgccattgatcagcgcactcc

SEQ ID NO: 17745 - DNA, 35 bp, Artificial Sequence
  Synthetic oligonucleotide
gaaggccgcagacccctattcacgaacttctgatc

SEQ ID NO: 17746 - DNA, 35 bp, Artificial Sequence
  Synthetic oligonucleotide
gttcgtagaccggcaacatatctgacacctctatc

SEQ ID NO: 17747 - DNA, 35 bp, Artificial Sequence
  Synthetic oligonucleotide
gtgaggtggggtgggttctgggaccgtgggtgtgg

SEQ ID NO: 17748 - DNA, 36 bp, Artificial Sequence
  Synthetic oligonucleotide
gctgaccctcccctgtcttttatttggccccgcaca

SEQ ID NO: 17749 - DNA, 36 bp, Artificial Sequence
  Synthetic oligonucleotide
agacatcctccgtccgacgctctatcctcattagga

SEQ ID NO: 17750 - DNA, 37 bp, Artificial Sequence
  Synthetic oligonucleotide
tgcacatccaatgtactgtttgctcccgccctctgga

SEQ ID NO: 17751 - DNA, 36 bp, Artificial Sequence
  Synthetic oligonucleotide
gatgagaaggggcaaggactggcgcgagacggtgga

SEQ ID NO: 17752 - DNA, 35 bp, Artificial Sequence
  Synthetic oligonucleotide
gcctgcataaaacatcatgcccctacgcccgccac

SEQ ID NO: 17753 - DNA, 35 bp, Artificial Sequence
  Synthetic oligonucleotide
tgccacattcgaacgcacaaatattagtttcatgc

SEQ ID NO: 17754 - DNA, 35 bp, Artificial Sequence
  Synthetic oligonucleotide
gtcaaggcagtatctacaccgcccttctagtcgct

SEQ ID NO: 17755 - DNA, 35 bp, Artificial Sequence
  Synthetic oligonucleotide
tcgaggcgaatggtctcgtttcttgttttttgggt

SEQ ID NO: 17756 - DNA, 35 bp, Artificial Sequence
  Synthetic oligonucleotide
ttggtgctctgacctgttctgtctgcccttattgt

SEQ ID NO: 17757 - DNA, 38 bp, Artificial Sequence
  Synthetic oligonucleotide
gcgcaagcacgagaaaggggatagtcgtacgaccatga

SEQ ID NO: 17758 - DNA, 36 bp, Artificial Sequence
  Synthetic oligonucleotide
tgaacgctggtgcaaggccctcgtactcttttctta

SEQ ID NO: 17759 - DNA, 35 bp, Artificial Sequence
  Synthetic oligonucleotide
ttagtccacgccatcccggaccgcccgatcgaacc

SEQ ID NO: 17760 - DNA, 35 bp, Artificial Sequence
  Synthetic oligonucleotide
gtggaaagtggaggtggttcaaggaatgtgacagg

SEQ ID NO: 17761 - DNA, 35 bp, Artificial Sequence
  Synthetic oligonucleotide
ccgggggagggggggtagaaaatacttatctgcgg

SEQ ID NO: 17762 - DNA, 35 bp, Artificial Sequence
  Synthetic oligonucleotide
accacacacagtgctaactgtttcctgagattcat

SEQ ID NO: 17763 - DNA, 36 bp, Artificial Sequence
  Synthetic oligonucleotide
tcacacccgccagacaccctcaacctgtactcgaaa

SEQ ID NO: 17764 - DNA, 37 bp, Artificial Sequence
  Synthetic oligonucleotide
tcgcccctgcttcccatccgaccggataaccacccga

SEQ ID NO: 17765 - DNA, 36 bp, Artificial Sequence
  Synthetic oligonucleotide
accccgttcatgttcccatttgatgtcccttcgata

SEQ ID NO: 17766 - DNA, 35 bp, Artificial Sequence
  Synthetic oligonucleotide
tacttcgtccccaacatgtcatcttaaaaccgtac

SEQ ID NO: 17767 - DNA, 35 bp, Artificial Sequence
  Synthetic oligonucleotide
agtgactcgacaatattctgttcatgtttcccacc

SEQ ID NO: 17768 - DNA, 35 bp, Artificial Sequence
  Synthetic oligonucleotide
ggaggaccaaaccaggtagaacggggggacgaagg

SEQ ID NO: 17769 - DNA, 35 bp, Artificial Sequence
  Synthetic oligonucleotide
tgtcccacagcatgcgccccgcaaacccatcactt

SEQ ID NO: 17770 - DNA, 37 bp, Artificial Sequence
  Synthetic oligonucleotide
aacccgtctccgcctttaccatctccgctttagctga

SEQ ID NO: 17771 - DNA, 38 bp, Artificial Sequence
  Synthetic oligonucleotide
gatgtccccagttcgttaccatgagcgccgtctcgtga

SEQ ID NO: 17772 - DNA, 35 bp, Artificial Sequence
  Synthetic oligonucleotide
ttgcctcacactgtcttacttgccaggttttccta

SEQ ID NO: 17773 - DNA, 35 bp, Artificial Sequence
  Synthetic oligonucleotide
gatgactgtcgccccaattagcccccaacacggta

SEQ ID NO: 17774 - DNA, 35 bp, Artificial Sequence
  Synthetic oligonucleotide
tacgaggacaggcgtattccagggccgtcttcatt

SEQ ID NO: 17775 - DNA, 36 bp, Artificial Sequence
  Synthetic oligonucleotide
gtcgagttcagttctgctctatcttgtctccttgca

SEQ ID NO: 17776 - DNA, 35 bp, Artificial Sequence
  Synthetic oligonucleotide
tgacgcactgcatccaccatgcctttcactttgca

SEQ ID NO: 17777 - DNA, 38 bp, Artificial Sequence
  Synthetic oligonucleotide
gcaacccaccctggaaatggacgccacacaaaccctga

SEQ ID NO: 17778 - DNA, 36 bp, Artificial Sequence
  Synthetic oligonucleotide
ttaccgcgcccagcccatcctgcattttatctgcta

SEQ ID NO: 17779 - DNA, 35 bp, Artificial Sequence
  Synthetic oligonucleotide
gtcatcctcacctgtaccccagcgattgctcgacg

SEQ ID NO: 17780 - DNA, 35 bp, Artificial Sequence
  Synthetic oligonucleotide
taacacgccgaaactggaatagtcctacccttctg

SEQ ID NO: 17781 - DNA, 36 bp, Artificial Sequence
  Synthetic oligonucleotide
aacgcaagcccaacgactcatgaaaccattgctcaa

SEQ ID NO: 17782 - DNA, 35 bp, Artificial Sequence
  Synthetic oligonucleotide
gaatcagtaagctgatctacacgttccccctctca

SEQ ID NO: 17783 - DNA, 37 bp, Artificial Sequence
  Synthetic oligonucleotide
tgagggaggtgtcgcaggactcagaggggcacgggga

SEQ ID NO: 17784 - DNA, 35 bp, Artificial Sequence
  Synthetic oligonucleotide
ttccgcggacctcagcaatttagcttctgcctttc

SEQ ID NO: 17785 - DNA, 35 bp, Artificial Sequence
  Synthetic oligonucleotide
gtaccaccccgtctcccctggtctttcgtcctttg

SEQ ID NO: 17786 - DNA, 35 bp, Artificial Sequence
  Synthetic oligonucleotide
aagtacaagagggaggtgtatggggcgggaggagt

SEQ ID NO: 17787 - DNA, 35 bp, Artificial Sequence
  Synthetic oligonucleotide
atttccgtcccccagttcgtgcctggccccaacca

SEQ ID NO: 17788 - DNA, 36 bp, Artificial Sequence
  Synthetic oligonucleotide
agctactacccccggtcatttgaggccttttcccca

SEQ ID NO: 17789 - DNA, 38 bp, Artificial Sequence
  Synthetic oligonucleotide
actacctcgccccgcctcgatttattatggttacgtga

SEQ ID NO: 17790 - DNA, 35 bp, Artificial Sequence
  Synthetic oligonucleotide
taatcacaccttgcctttctcacgcccaatggggc

SEQ ID NO: 17791 - DNA, 37 bp, Artificial Sequence
  Synthetic oligonucleotide
gccactgccccgacctcgccatcgttgatcatcatga

SEQ ID NO: 17792 - DNA, 36 bp, Artificial Sequence
  Synthetic oligonucleotide
gattacggcgtcatcttcgtttcgtcattcatccta

SEQ ID NO: 17793 - DNA, 35 bp, Artificial Sequence
  Synthetic oligonucleotide
gcgcccctgtcgctatttagctctcacggtcctac

SEQ ID NO: 17794 - DNA, 35 bp, Artificial Sequence
  Synthetic oligonucleotide
aaacggccctcttttgcggacacattccgacctcc

SEQ ID NO: 17795 - DNA, 35 bp, Artificial Sequence
  Synthetic oligonucleotide
gtgctgagcactgccatcgacgacacctcgcctgc

SEQ ID NO: 17796 - DNA, 35 bp, Artificial Sequence
  Synthetic oligonucleotide
gagcccgcagctttcacccacgttggcgtcccttc

SEQ ID NO: 17797 - DNA, 35 bp, Artificial Sequence
  Synthetic oligonucleotide
atccacgtagttacccatgaccgtaccgaccatgt

SEQ ID NO: 17798 - DNA, 35 bp, Artificial Sequence
  Synthetic oligonucleotide
tgccgagccgcccacatctgccatctctccccaca

SEQ ID NO: 17799 - DNA, 35 bp, Artificial Sequence
  Synthetic oligonucleotide
accccccttgccataggtgcccgtaatactcagca

SEQ ID NO: 17800 - DNA, 37 bp, Artificial Sequence
  Synthetic oligonucleotide
aagctgcctgccatcatcatagctacgccttatccga

SEQ ID NO: 17801 - DNA, 37 bp, Artificial Sequence
  Synthetic oligonucleotide
gacctccacaggcagtcctccttccatcccttcgcga

SEQ ID NO: 17802 - DNA, 37 bp, Artificial Sequence
  Synthetic oligonucleotide
tccaccatctagcacacggacgttcgctactcactga

SEQ ID NO: 17803 - DNA, 38 bp, Artificial Sequence
  Synthetic oligonucleotide
tagggggacggcggggggaacaaaggtgtttgtggtga

SEQ ID NO: 17804 - DNA, 36 bp, Artificial Sequence
  Synthetic oligonucleotide
tccactcacggcatttgcatcctcggccacttacta

SEQ ID NO: 17805 - DNA, 35 bp, Artificial Sequence
  Synthetic oligonucleotide
atgctgctgcacacccatacgtcttttgcgcaccc

SEQ ID NO: 17806 - DNA, 35 bp, Artificial Sequence
  Synthetic oligonucleotide
taatcgtccttgttccgtgtcctccttttactgcg

SEQ ID NO: 17807 - DNA, 35 bp, Artificial Sequence
  Synthetic oligonucleotide
ggtccccccctccgcgtccctcagcgtagttgcct

SEQ ID NO: 17808 - DNA, 36 bp, Artificial Sequence
  Synthetic oligonucleotide
acccatcgcagtctaaattcctcttggccgtgccaa

SEQ ID NO: 17809 - DNA, 36 bp, Artificial Sequence
  Synthetic oligonucleotide
tcatctccgttgctctatagcaggtctctcgtttca

SEQ ID NO: 17810 - DNA, 37 bp, Artificial Sequence
  Synthetic oligonucleotide
gcccgactgtccctctctagctgccattacccagtga

SEQ ID NO: 17811 - DNA, 38 bp, Artificial Sequence
  Synthetic oligonucleotide
tgatccccgcacataccccaaacgcctctctcgcgtga

SEQ ID NO: 17812 - DNA, 35 bp, Artificial Sequence
  Synthetic oligonucleotide
tgagcccaccacgcgttgcaccttaattgaccacc

SEQ ID NO: 17813 - DNA, 35 bp, Artificial Sequence
  Synthetic oligonucleotide
gttgcagctgtccttgtcaattctgctcacccgcc

SEQ ID NO: 17814 - DNA, 35 bp, Artificial Sequence
  Synthetic oligonucleotide
gtgtgcgaaagaccaccgtgccctaattcgtgttc

SEQ ID NO: 17815 - DNA, 35 bp, Artificial Sequence
  Synthetic oligonucleotide
ttcggtggcctactgtctcaattagtctgccctct

SEQ ID NO: 17816 - DNA, 38 bp, Artificial Sequence
  Synthetic oligonucleotide
tggtcctatgaccacgatcgtcgacccacctactctga

SEQ ID NO: 17817 - DNA, 38 bp, Artificial Sequence
  Synthetic oligonucleotide
atacgtcgctccacatcgcctgtccgcccttcttttga

SEQ ID NO: 17818 - DNA, 36 bp, Artificial Sequence
  Synthetic oligonucleotide
tcacacgagtcgccagcaatacacgggcccatccaa

SEQ ID NO: 17819 - DNA, 37 bp, Artificial Sequence
  Synthetic oligonucleotide
gtgaaaggttggggtgtggcggataggaaattggcga

SEQ ID NO: 17820 - DNA, 35 bp, Artificial Sequence
  Synthetic oligonucleotide
gccttcccgctacacatcgcccagtccgtgcagga

SEQ ID NO: 17821 - DNA, 38 bp, Artificial Sequence
  Synthetic oligonucleotide
gatgggacacacgcagcgggggccaagggaatgaatga

SEQ ID NO: 17822 - DNA, 38 bp, Artificial Sequence
  Synthetic oligonucleotide
acacaaaggggtgcaagttctggggggacgaagggtga

SEQ ID NO: 17823 - DNA, 35 bp, Artificial Sequence
  Synthetic oligonucleotide
accacctctacctagccgtagtactgctttccata

SEQ ID NO: 17824 - DNA, 35 bp, Artificial Sequence
  Synthetic oligonucleotide
aagccgtcgctgccacatttttccatttgcccttc

SEQ ID NO: 17825 - DNA, 35 bp, Artificial Sequence
  Synthetic oligonucleotide
atgactgttggacgggaatgggggagtagggcgat

SEQ ID NO: 17826 - DNA, 35 bp, Artificial Sequence
  Synthetic oligonucleotide
actttaacgctcacatgctcttacgtctcatctct

SEQ ID NO: 17827 - DNA, 35 bp, Artificial Sequence
  Synthetic oligonucleotide
acttcacacgcacgatcctcaactctcaacgtatt

SEQ ID NO: 17828 - DNA, 36 bp, Artificial Sequence
  Synthetic oligonucleotide
tccgagacccacatcgcgttgataaaaccgttttca

SEQ ID NO: 17829 - DNA, 35 bp, Artificial Sequence
  Synthetic oligonucleotide
ggatggggtacatggttaggagttaggtggagaga

SEQ ID NO: 17830 - DNA, 37 bp, Artificial Sequence
  Synthetic oligonucleotide
atgagggggggagtggtggggtgtgccctttaacgga

SEQ ID NO: 17831 - DNA, 37 bp, Artificial Sequence
  Synthetic oligonucleotide
actcgaaccacatgacacagctactgccacataatga

SEQ ID NO: 17832 - DNA, 35 bp, Artificial Sequence
  Synthetic oligonucleotide
tacctcgtgccctcttccagttgcaatgccttttg

SEQ ID NO: 17833 - DNA, 35 bp, Artificial Sequence
  Synthetic oligonucleotide
gtttggccccccacagcccctgccatccactataa

SEQ ID NO: 17834 - DNA, 37 bp, Artificial Sequence
  Synthetic oligonucleotide
agtaccactccgagccaccccacggccagttcttcga

SEQ ID NO: 17835 - DNA, 38 bp, Artificial Sequence
  Synthetic oligonucleotide
gccaaggcgctttgctctgttccttctgactactttga

SEQ ID NO: 17836 - DNA, 37 bp, Artificial Sequence
  Synthetic oligonucleotide
ttgcaccctgtccatccgttctctatttacagtttga

SEQ ID NO: 17837 - DNA, 35 bp, Artificial Sequence
  Synthetic oligonucleotide
atcttcacccacaggacaacaatctgacagggata

SEQ ID NO: 17838 - DNA, 35 bp, Artificial Sequence
  Synthetic oligonucleotide
tctcccatcccatccagcaagcgaacgggcttgcc

SEQ ID NO: 17839 - DNA, 34 bp, Artificial Sequence
  Synthetic oligonucleotide
ttcgcgctatctacatcttgaccactcactgttc

SEQ ID NO: 17840 - DNA, 35 bp, Artificial Sequence
  Synthetic oligonucleotide
aatcaccgatagtcccgtgccacaccccgtaccat

SEQ ID NO: 17841 - DNA, 35 bp, Artificial Sequence
  Synthetic oligonucleotide
tagaccccactatactgtatgccacttaactcagt

SEQ ID NO: 17842 - DNA, 35 bp, Artificial Sequence
  Synthetic oligonucleotide
gctgcccttcatccctcgtgcattttgcttgccgt

SEQ ID NO: 17843 - DNA, 37 bp, Artificial Sequence
  Synthetic oligonucleotide
tctgcggcctttcctggttccttccgtgtttccccga

SEQ ID NO: 17844 - DNA, 38 bp, Artificial Sequence
  Synthetic oligonucleotide
aacgggagggtgaggaagtgggcatagggatcggatga

SEQ ID NO: 17845 - DNA, 35 bp, Artificial Sequence
  Synthetic oligonucleotide
tacgcctctccggtcctgtgttgcggttcttctcc

SEQ ID NO: 17846 - DNA, 35 bp, Artificial Sequence
  Synthetic oligonucleotide
gcccatgctcccctcaataatgtgctgtactgtgg

SEQ ID NO: 17847 - DNA, 38 bp, Artificial Sequence
  Synthetic oligonucleotide
tccgaaccacgttcatcgggtgagctattgtttcctga

SEQ ID NO: 17848 - DNA, 38 bp, Artificial Sequence
  Synthetic oligonucleotide
atagccaatgccgctgtatcatctcggctccaccttga

SEQ ID NO: 17849 - DNA, 35 bp, Artificial Sequence
  Synthetic oligonucleotide
tagacccatccaccgcctgctcttgtacctcacat

SEQ ID NO: 17850 - DNA, 35 bp, Artificial Sequence
  Synthetic oligonucleotide
gtctcagcccgcatcatccacgccgggacctttct

SEQ ID NO: 17851 - DNA, 37 bp, Artificial Sequence
  Synthetic oligonucleotide
aagtgctgggagtgggtgggtgtggcgccaggtacga

SEQ ID NO: 17852 - DNA, 38 bp, Artificial Sequence
  Synthetic oligonucleotide
accaccccactagccgccaattggtcacccaggactga

SEQ ID NO: 17853 - DNA, 35 bp, Artificial Sequence
  Synthetic oligonucleotide
gcaccggaaccggcgtagaatacctgcactttccc

SEQ ID NO: 17854 - DNA, 38 bp, Artificial Sequence
  Synthetic oligonucleotide
atgcctctgctcccaccacgtacgttcccatcctgtga

SEQ ID NO: 17855 - DNA, 37 bp, Artificial Sequence
  Synthetic oligonucleotide
gatccctccgactcagtccgtcctcctatatgcttga

SEQ ID NO: 17856 - DNA, 35 bp, Artificial Sequence
  Synthetic oligonucleotide
tgcgtacgatccccttgacgttgttttttgtccgc

SEQ ID NO: 17857 - DNA, 35 bp, Artificial Sequence
  Synthetic oligonucleotide
gttatcccgccttcgccgttgcctactccctgatc

SEQ ID NO: 17858 - DNA, 35 bp, Artificial Sequence
  Synthetic oligonucleotide
ggtgacgctaacccgttgtcctttatctactgtct

SEQ ID NO: 17859 - DNA, 35 bp, Artificial Sequence
  Synthetic oligonucleotide
tagtccacacagcagccacatcgcagcacccccaa

SEQ ID NO: 17860 - DNA, 36 bp, Artificial Sequence
  Synthetic oligonucleotide
atcaccgatcatgctctgtccctgcgtcacagtcca

SEQ ID NO: 17861 - DNA, 37 bp, Artificial Sequence
  Synthetic oligonucleotide
tttgtacgcctgcctatcacatccctttgcactggga

SEQ ID NO: 17862 - DNA, 35 bp, Artificial Sequence
  Synthetic oligonucleotide
gacagagctacgcacgggggaaagaccggggaggg

SEQ ID NO: 17863 - DNA, 35 bp, Artificial Sequence
  Synthetic oligonucleotide
tgatgcctctccttgctacacaggctcctccatgg

SEQ ID NO: 17864 - DNA, 35 bp, Artificial Sequence
  Synthetic oligonucleotide
gccacatcactcagttgcgcagtatcgacccacct

SEQ ID NO: 17865 - DNA, 36 bp, Artificial Sequence
  Synthetic oligonucleotide
gtcgaatccgcatgccactatcactgtacgccgcca

SEQ ID NO: 17866 - DNA, 37 bp, Artificial Sequence
  Synthetic oligonucleotide
acacgcgcacatggctgttgcatccctcatcctgaga

SEQ ID NO: 17867 - DNA, 37 bp, Artificial Sequence
  Synthetic oligonucleotide
gaggacgatgggtggggattatggaagcagaaaacga

SEQ ID NO: 17868 - DNA, 37 bp, Artificial Sequence
  Synthetic oligonucleotide
acaccatgagccaccttgatttaataccgtcacttga

SEQ ID NO: 17869 - DNA, 38 bp, Artificial Sequence
  Synthetic oligonucleotide
tacctgtgccttttgtccgtttcgctgcccctcgttga

SEQ ID NO: 17870 - DNA, 35 bp, Artificial Sequence
  Synthetic oligonucleotide
gcacctcgtaccgcgaccaaacttgctttttatcc

SEQ ID NO: 17871 - DNA, 35 bp, Artificial Sequence
  Synthetic oligonucleotide
gacgtgccctatctgggtccctccattttccacgc

SEQ ID NO: 17872 - DNA, 35 bp, Artificial Sequence
  Synthetic oligonucleotide
accgtaccgctccatgtcccacacaaccgtctcgc

SEQ ID NO: 17873 - DNA, 35 bp, Artificial Sequence
  Synthetic oligonucleotide
gaagggcggctaggggcttgttggggaccgcgggc

SEQ ID NO: 17874 - DNA, 36 bp, Artificial Sequence
  Synthetic oligonucleotide
gtgacgcgctacttacctatcaagcacatacaccaa

SEQ ID NO: 17875 - DNA, 36 bp, Artificial Sequence
  Synthetic oligonucleotide
actcacctccaaggtctagtccacggttttcttgca

SEQ ID NO: 17876 - DNA, 35 bp, Artificial Sequence
  Synthetic oligonucleotide
accatcctcggcctttgctcgcattcgtttcaaac

SEQ ID NO: 17877 - DNA, 35 bp, Artificial Sequence
  Synthetic oligonucleotide
gaagcggagccggtccattctcggtatctgtcctc

SEQ ID NO: 17878 - DNA, 35 bp, Artificial Sequence
  Synthetic oligonucleotide
gactcgccacccaatatctcttggtaacagctctg

SEQ ID NO: 17879 - DNA, 37 bp, Artificial Sequence
  Synthetic oligonucleotide
tcgtgacacaccgtgcattttggttgcctttcctcga

SEQ ID NO: 17880 - DNA, 37 bp, Artificial Sequence
  Synthetic oligonucleotide
tgcgatgcccacttacccgctgtccttaaacgttcga

SEQ ID NO: 17881 - DNA, 35 bp, Artificial Sequence
  Synthetic oligonucleotide
atttgcccgaccgttcccactcaaaggcactctgc

SEQ ID NO: 17882 - DNA, 35 bp, Artificial Sequence
  Synthetic oligonucleotide
aacgtcacgccccacgcctcggtgcgtaaccccat

SEQ ID NO: 17883 - DNA, 35 bp, Artificial Sequence
  Synthetic oligonucleotide
tacatatccaccatcaggcgcccccgcctatgcca

SEQ ID NO: 17884 - DNA, 36 bp, Artificial Sequence
  Synthetic oligonucleotide
tgcacccttgaactgccaaaacacgtcacttaagca

SEQ ID NO: 17885 - DNA, 36 bp, Artificial Sequence
  Synthetic oligonucleotide
gtgtgccacggttgtttatgcctcccattttctgca

SEQ ID NO: 17886 - DNA, 38 bp, Artificial Sequence
  Synthetic oligonucleotide
gaagagggcccaggtggtgagtggtgggtgcaaggtga

SEQ ID NO: 17887 - DNA, 35 bp, Artificial Sequence
  Synthetic oligonucleotide
tgcgcccgcccgttgcactgatgaccctgttcgcc

SEQ ID NO: 17888 - DNA, 35 bp, Artificial Sequence
  Synthetic oligonucleotide
agagtcacctcttccctatctgctgtctttatgtc

SEQ ID NO: 17889 - DNA, 35 bp, Artificial Sequence
  Synthetic oligonucleotide
agccaccgtaaagcactatcacaccctctctgatg

SEQ ID NO: 17890 - DNA, 35 bp, Artificial Sequence
  Synthetic oligonucleotide
gcacgcccaagttgctcagacctcctcttccactg

SEQ ID NO: 17891 - DNA, 35 bp, Artificial Sequence
  Synthetic oligonucleotide
gctccacactagtcgaactgcatactcgctctaat

SEQ ID NO: 17892 - DNA, 37 bp, Artificial Sequence
  Synthetic oligonucleotide
accaccctgttgttctgtaggtgaccgccttacccga

SEQ ID NO: 17893 - DNA, 37 bp, Artificial Sequence
  Synthetic oligonucleotide
gacacatgtacgatcgtcctcctccacttctgtgcga

SEQ ID NO: 17894 - DNA, 37 bp, Artificial Sequence
  Synthetic oligonucleotide
tagttccccctccattcgtttatactcgagatctgga

SEQ ID NO: 17895 - DNA, 37 bp, Artificial Sequence
  Synthetic oligonucleotide
gtgaagccccccctgcattgcccgacatcgtattgga

SEQ ID NO: 17896 - DNA, 34 bp, Artificial Sequence
  Synthetic oligonucleotide
atactcccccccccactccctcacgtctgctcat

SEQ ID NO: 17897 - DNA, 35 bp, Artificial Sequence
  Synthetic oligonucleotide
agattggagaggtgggtgaaaaggaggcggacgaa

SEQ ID NO: 17898 - DNA, 35 bp, Artificial Sequence
  Synthetic oligonucleotide
tatgcccgccgtcgacttttctgatgcaactccga

SEQ ID NO: 17899 - DNA, 35 bp, Artificial Sequence
  Synthetic oligonucleotide
ggagagtgtggaaggggtgctgaggtgggtcggga

SEQ ID NO: 17900 - DNA, 35 bp, Artificial Sequence
  Synthetic oligonucleotide
gccatcccgcaacactcgcctactctagcccgcac

SEQ ID NO: 17901 - DNA, 35 bp, Artificial Sequence
  Synthetic oligonucleotide
atgtgcccccatagtacgacgcaccttactccgat

SEQ ID NO: 17902 - DNA, 35 bp, Artificial Sequence
  Synthetic oligonucleotide
agccaacctcatggtgcacccgacttccatcttct

SEQ ID NO: 17903 - DNA, 37 bp, Artificial Sequence
  Synthetic oligonucleotide
acgtaacgccgtcctggatagccctccactccttcga

SEQ ID NO: 17904 - DNA, 36 bp, Artificial Sequence
  Synthetic oligonucleotide
gttaagggtgggggtggcggtgggataggcgtggga

SEQ ID NO: 17905 - DNA, 36 bp, Artificial Sequence
  Synthetic oligonucleotide
ttccgcccttctttcggccatacgggttccattcta

SEQ ID NO: 17906 - DNA, 35 bp, Artificial Sequence
  Synthetic oligonucleotide
accgccccgttggtagaccgttcccctgtgcctgc

SEQ ID NO: 17907 - DNA, 37 bp, Artificial Sequence
  Synthetic oligonucleotide
gacggaggggtagagataaaatcataggcacacagga

SEQ ID NO: 17908 - DNA, 35 bp, Artificial Sequence
  Synthetic oligonucleotide
actccagccttcgtgcggctttcctccccatatac

SEQ ID NO: 17909 - DNA, 35 bp, Artificial Sequence
  Synthetic oligonucleotide
tcaccttacgcccgctcgccggtgaactgtccctc

SEQ ID NO: 17910 - DNA, 36 bp, Artificial Sequence
  Synthetic oligonucleotide
tgttgcactagcctcttcctccgccaccgtgtcaca

SEQ ID NO: 17911 - DNA, 36 bp, Artificial Sequence
  Synthetic oligonucleotide
acaggactgcctctaccaatttatgcaccgtagcca

SEQ ID NO: 17912 - DNA, 38 bp, Artificial Sequence
  Synthetic oligonucleotide
ggacaagagggtggagggaacaaggagggggcatctga

SEQ ID NO: 17913 - DNA, 38 bp, Artificial Sequence
  Synthetic oligonucleotide
aagaggaaaccggaatagggcaaggggaacgtaagtga

SEQ ID NO: 17914 - DNA, 37 bp, Artificial Sequence
  Synthetic oligonucleotide
aagtcaccacgcggccggccccactcccttgctttga

SEQ ID NO: 17915 - DNA, 35 bp, Artificial Sequence
  Synthetic oligonucleotide
gtcgcgacacgagtaccccgcctatcttgacgcct

SEQ ID NO: 17916 - DNA, 36 bp, Artificial Sequence
  Synthetic oligonucleotide
tacgtggccacacctctatatggttcttttcgaaca

SEQ ID NO: 17917 - DNA, 36 bp, Artificial Sequence
  Synthetic oligonucleotide
tcaaccaccctgaacagcagtttctgcgactctcca

SEQ ID NO: 17918 - DNA, 36 bp, Artificial Sequence
  Synthetic oligonucleotide
tacacgcatgcttgttgatgcgtgtgttgtttttga

SEQ ID NO: 17919 - DNA, 34 bp, Artificial Sequence
  Synthetic oligonucleotide
tcactgctggtccccttatttctcctgtcctaca

SEQ ID NO: 17920 - DNA, 37 bp, Artificial Sequence
  Synthetic oligonucleotide
tgacaatccttgtcgccgtctttcatgcctgcttcga

SEQ ID NO: 17921 - DNA, 37 bp, Artificial Sequence
  Synthetic oligonucleotide
ttcgccccttcctcctgtgtgccatcacccatttcga

SEQ ID NO: 17922 - DNA, 35 bp, Artificial Sequence
  Synthetic oligonucleotide
ggtctagccagcgctaactattgaccgccctcccc

SEQ ID NO: 17923 - DNA, 35 bp, Artificial Sequence
  Synthetic oligonucleotide
tccgcgttcggttggagcgtcccatcctgcctccc

SEQ ID NO: 17924 - DNA, 35 bp, Artificial Sequence
  Synthetic oligonucleotide
gaccagatagggaagggggagggtgagcggtcccg

SEQ ID NO: 17925 - DNA, 35 bp, Artificial Sequence
  Synthetic oligonucleotide
gctccctacactgagcaattattaccgccttcctg

SEQ ID NO: 17926 - DNA, 35 bp, Artificial Sequence
  Synthetic oligonucleotide
tccctctgccggtgaaactcgctgtcttattcgtt

SEQ ID NO: 17927 - DNA, 34 bp, Artificial Sequence
  Synthetic oligonucleotide
tgctgccgcccgacatctctgagtgccctatcaa

SEQ ID NO: 17928 - DNA, 36 bp, Artificial Sequence
  Synthetic oligonucleotide
tgacacgaagcgggtttttcgtgggttgggtgggaa

SEQ ID NO: 17929 - DNA, 35 bp, Artificial Sequence
  Synthetic oligonucleotide
tgaccagggcccagcctcgacgcccgtccttccca

SEQ ID NO: 17930 - DNA, 37 bp, Artificial Sequence
  Synthetic oligonucleotide
acctcccgctggactgctccccgtacagtacttaaga

SEQ ID NO: 17931 - DNA, 36 bp, Artificial Sequence
  Synthetic oligonucleotide
acgacgggggaaatgcgaagtgagggatggaatgga

SEQ ID NO: 17932 - DNA, 37 bp, Artificial Sequence
  Synthetic oligonucleotide
tatggggtggtgggtttgaaaggggggccggatatga

SEQ ID NO: 17933 - DNA, 35 bp, Artificial Sequence
  Synthetic oligonucleotide
tgcctcatgttcatggattgctacccacccactgc

SEQ ID NO: 17934 - DNA, 35 bp, Artificial Sequence
  Synthetic oligonucleotide
acctcagtccggtttgagcctgacgtgcctctttc

SEQ ID NO: 17935 - DNA, 35 bp, Artificial Sequence
  Synthetic oligonucleotide
tctcaagcccatgaacgccgccctttccgatacgt

SEQ ID NO: 17936 - DNA, 37 bp, Artificial Sequence
  Synthetic oligonucleotide
acacgccctccgcagcacgcgctttttttggttacga

SEQ ID NO: 17937 - DNA, 37 bp, Artificial Sequence
  Synthetic oligonucleotide
gccccgactcggcttggactcgtgaccccttccctga

SEQ ID NO: 17938 - DNA, 38 bp, Artificial Sequence
  Synthetic oligonucleotide
aattgcggcaccactcacactcttccctgcgctgttga

SEQ ID NO: 17939 - DNA, 35 bp, Artificial Sequence
  Synthetic oligonucleotide
actgctgtgccgtcaccttctcgtaccaaccggac

SEQ ID NO: 17940 - DNA, 35 bp, Artificial Sequence
  Synthetic oligonucleotide
tgtctcgtacgccctgccagttctgaaaccatttc

SEQ ID NO: 17941 - DNA, 35 bp, Artificial Sequence
  Synthetic oligonucleotide
aatgtcacccgcctcaaaagatcgtctcctcctgg

SEQ ID NO: 17942 - DNA, 35 bp, Artificial Sequence
  Synthetic oligonucleotide
tccccgcctcttgtgaaccggtaacacgcaccata

SEQ ID NO: 17943 - DNA, 35 bp, Artificial Sequence
  Synthetic oligonucleotide
actttatcccctgcctgcccgatctggggtcaccc

SEQ ID NO: 17944 - DNA, 35 bp, Artificial Sequence
  Synthetic oligonucleotide
acagccacggcacacccgcacatgcttactcttat

SEQ ID NO: 17945 - DNA, 35 bp, Artificial Sequence
  Synthetic oligonucleotide
taatacacagcccgctctcccatgcactcgctagt

SEQ ID NO: 17946 - DNA, 37 bp, Artificial Sequence
  Synthetic oligonucleotide
ggacctgaccaactacttatcccagctccccaggaga

SEQ ID NO: 17947 - DNA, 37 bp, Artificial Sequence
  Synthetic oligonucleotide
tcacacctccgaccttctccgactgaagactagccga

SEQ ID NO: 17948 - DNA, 37 bp, Artificial Sequence
  Synthetic oligonucleotide
gttgtaccacctcactcacgttgtatcttgccctgga

SEQ ID NO: 17949 - DNA, 38 bp, Artificial Sequence
  Synthetic oligonucleotide
tgcacatcacatccggtccgttacaagcctccaaatga

SEQ ID NO: 17950 - DNA, 35 bp, Artificial Sequence
  Synthetic oligonucleotide
atgatcctcgctagctacaataaagccacgcccac

SEQ ID NO: 17951 - DNA, 35 bp, Artificial Sequence
  Synthetic oligonucleotide
tctagaccctctgcgcctcatagtaaccgtttcca

SEQ ID NO: 17952 - DNA, 37 bp, Artificial Sequence
  Synthetic oligonucleotide
acccacctcactgagcactcgccataacgagctacga

SEQ ID NO: 17953 - DNA, 38 bp, Artificial Sequence
  Synthetic oligonucleotide
tgcccaccgttctgtccccacaccgttgtccttcgtga

SEQ ID NO: 17954 - DNA, 38 bp, Artificial Sequence
  Synthetic oligonucleotide
gagcacccatgattgcccatactgcctcttgtctgtga

SEQ ID NO: 17955 - DNA, 35 bp, Artificial Sequence
  Synthetic oligonucleotide
tgtaatcctcgcccctctgatcttatttgcgccta

SEQ ID NO: 17956 - DNA, 35 bp, Artificial Sequence
  Synthetic oligonucleotide
tgaccgtctccgacctccatcctcagttcacccct

SEQ ID NO: 17957 - DNA, 37 bp, Artificial Sequence
  Synthetic oligonucleotide
ttacacctagcatcgtatgctcacacacccgccccga

SEQ ID NO: 17958 - DNA, 37 bp, Artificial Sequence
  Synthetic oligonucleotide
gactgccggcctcaactggtttccttctactccggga

SEQ ID NO: 17959 - DNA, 35 bp, Artificial Sequence
  Synthetic oligonucleotide
ttagctacccaccagtccagttgcccccccgccgc

SEQ ID NO: 17960 - DNA, 35 bp, Artificial Sequence
  Synthetic oligonucleotide
atcatctctatgcattcctgtgacttgcttcgctc

SEQ ID NO: 17961 - DNA, 35 bp, Artificial Sequence
  Synthetic oligonucleotide
ttacgcctcacatcctcgggtatttccactctatt

SEQ ID NO: 17962 - DNA, 37 bp, Artificial Sequence
  Synthetic oligonucleotide
agtgacgaggagagggcataacgggggttggagaaga

SEQ ID NO: 17963 - DNA, 35 bp, Artificial Sequence
  Synthetic oligonucleotide
gctggcaaggggaacggtgggaacttgggcgggga

SEQ ID NO: 17964 - DNA, 37 bp, Artificial Sequence
  Synthetic oligonucleotide
acgcgcctcattagcctcgatgccacgttgcccctga

SEQ ID NO: 17965 - DNA, 37 bp, Artificial Sequence
  Synthetic oligonucleotide
aaacacccacagttggaactaacaccacccgtcctga

SEQ ID NO: 17966 - DNA, 36 bp, Artificial Sequence
  Synthetic oligonucleotide
gctcccctcgcggttgcctgccctttcctggtgcta

SEQ ID NO: 17967 - DNA, 35 bp, Artificial Sequence
  Synthetic oligonucleotide
tctgatcctccccatgaaccgtgacgtgttttaca

SEQ ID NO: 17968 - DNA, 36 bp, Artificial Sequence
  Synthetic oligonucleotide
tcacatccccctgatagccgtaggtaactattacca

SEQ ID NO: 17969 - DNA, 35 bp, Artificial Sequence
  Synthetic oligonucleotide
aagtgcatacaacatggccgtgatttctcctccca

SEQ ID NO: 17970 - DNA, 35 bp, Artificial Sequence
  Synthetic oligonucleotide
ttgacccgcccgaatgcctcgccaggtgccgttca

SEQ ID NO: 17971 - DNA, 38 bp, Artificial Sequence
  Synthetic oligonucleotide
tccacccgctggcctcgcctttgtttttgcctctgtga

SEQ ID NO: 17972 - DNA, 35 bp, Artificial Sequence
  Synthetic oligonucleotide
acacacctactggttctggaatccgagtactacta

SEQ ID NO: 17973 - DNA, 36 bp, Artificial Sequence
  Synthetic oligonucleotide
tgggaggtcagtccatctgctaatcacgcacccgta

SEQ ID NO: 17974 - DNA, 35 bp, Artificial Sequence
  Synthetic oligonucleotide
gggctcagccccgccgttgcgcacccgctccttac

SEQ ID NO: 17975 - DNA, 35 bp, Artificial Sequence
  Synthetic oligonucleotide
acatgcccccctgccccgctacggttagcccatcc

SEQ ID NO: 17976 - DNA, 35 bp, Artificial Sequence
  Synthetic oligonucleotide
tacatcgcggctggtccctttaatctagtccctgc

SEQ ID NO: 17977 - DNA, 37 bp, Artificial Sequence
  Synthetic oligonucleotide
gtctgtccgggggtgtggtgggtgggaggagtggaga

SEQ ID NO: 17978 - DNA, 38 bp, Artificial Sequence
  Synthetic oligonucleotide
ttgcccgcctcttgacgtgctctactgcctttccctga

SEQ ID NO: 17979 - DNA, 35 bp, Artificial Sequence
  Synthetic oligonucleotide
ccacgtgcccttctgccgtactatttgtcccacgt

SEQ ID NO: 17980 - DNA, 35 bp, Artificial Sequence
  Synthetic oligonucleotide
tcgtgacctctcatccatgtatctcgcattcctgt

SEQ ID NO: 17981 - DNA, 36 bp, Artificial Sequence
  Synthetic oligonucleotide
agcacacggtacacagcgcacctgcccctccgccga

SEQ ID NO: 17982 - DNA, 36 bp, Artificial Sequence
  Synthetic oligonucleotide
gatccaagcggtccagagggcggaagggggtggggg

SEQ ID NO: 17983 - DNA, 35 bp, Artificial Sequence
  Synthetic oligonucleotide
tcaacgcgatccggcttggcgtttccatcctcttg

SEQ ID NO: 17984 - DNA, 35 bp, Artificial Sequence
  Synthetic oligonucleotide
tcatacgccgaccaacggttccacaaccctttcct

SEQ ID NO: 17985 - DNA, 37 bp, Artificial Sequence
  Synthetic oligonucleotide
gcccctaccctcaaacgagaagcactacatttctaga

SEQ ID NO: 17986 - DNA, 38 bp, Artificial Sequence
  Synthetic oligonucleotide
tcgccccagctggccttgtagcctccttcgccccatga

SEQ ID NO: 17987 - DNA, 35 bp, Artificial Sequence
  Synthetic oligonucleotide
ggaacaatcccttcagcccccgcccgatcctcgta

SEQ ID NO: 17988 - DNA, 35 bp, Artificial Sequence
  Synthetic oligonucleotide
tgtcgccccggtcctttataacccctcctgctctc

SEQ ID NO: 17989 - DNA, 35 bp, Artificial Sequence
  Synthetic oligonucleotide
ttgtccgggacggcgggaaagtaggtttgggtggg

SEQ ID NO: 17990 - DNA, 35 bp, Artificial Sequence
  Synthetic oligonucleotide
tccctcatctctgccgttccttgacatcagttggt

SEQ ID NO: 17991 - DNA, 35 bp, Artificial Sequence
  Synthetic oligonucleotide
accacacacacatcgcgttgaagtcctcgacctgt

SEQ ID NO: 17992 - DNA, 36 bp, Artificial Sequence
  Synthetic oligonucleotide
gtcggtcttggccgtgactttccgccacccttccca

SEQ ID NO: 17993 - DNA, 36 bp, Artificial Sequence
  Synthetic oligonucleotide
tacgcttaccactggccacggtactccttccattca

SEQ ID NO: 17994 - DNA, 37 bp, Artificial Sequence
  Synthetic oligonucleotide
gatgcgccggttgacctattggtggggggtggggtga

SEQ ID NO: 17995 - DNA, 35 bp, Artificial Sequence
  Synthetic oligonucleotide
tccccaagccccctgccagtactggaattcagttc

SEQ ID NO: 17996 - DNA, 35 bp, Artificial Sequence
  Synthetic oligonucleotide
ccggccgtccctaaccgactcccctgcggcacccg

SEQ ID NO: 17997 - DNA, 36 bp, Artificial Sequence
  Synthetic oligonucleotide
ggtccgctgaccggttttgacccatcctccttccaa

SEQ ID NO: 17998 - DNA, 38 bp, Artificial Sequence
  Synthetic oligonucleotide
tccatcaacacactgagcaatatcgttacagtccatga

SEQ ID NO: 17999 - DNA, 38 bp, Artificial Sequence
  Synthetic oligonucleotide
atgcaccgcccggaaccatgcctcccaacgtatcatga

SEQ ID NO: 18000 - DNA, 35 bp, Artificial Sequence
  Synthetic oligonucleotide
tgagccctcaccattcttatttactgcttcccccc

SEQ ID NO: 18001 - DNA, 35 bp, Artificial Sequence
  Synthetic oligonucleotide
agctcaaccggcaggtcttgtttcgtctctggtcc

SEQ ID NO: 18002 - DNA, 35 bp, Artificial Sequence
  Synthetic oligonucleotide
ttataggcccgcgctgcagcacattcattcctttc

SEQ ID NO: 18003 - DNA, 37 bp, Artificial Sequence
  Synthetic oligonucleotide
ggagggaagttatagggggcctggggggatcgaggga

SEQ ID NO: 18004 - DNA, 29 bp, Artificial Sequence
  Synthetic oligonucleotide
gacgctccccaaccgccgtacaattcgta

SEQ ID NO: 18005 - DNA, 35 bp, Artificial Sequence
  Synthetic oligonucleotide
tatccgctgtagtggcgtcatcactcttatccatc

SEQ ID NO: 18006 - DNA, 35 bp, Artificial Sequence
  Synthetic oligonucleotide
gcacaccccggctccctcttaatcggcttcttaca

SEQ ID NO: 18007 - DNA, 37 bp, Artificial Sequence
  Synthetic oligonucleotide
gggaggtgtggaggaggcaaacggcaaggagggagga

SEQ ID NO: 18008 - DNA, 35 bp, Artificial Sequence
  Synthetic oligonucleotide
tcacctagaccgcactgaaccaacaacctttttgt

SEQ ID NO: 18009 - DNA, 36 bp, Artificial Sequence
  Synthetic oligonucleotide
tactcaccggcggacgaacaaggcctacccccacaa

SEQ ID NO: 18010 - DNA, 36 bp, Artificial Sequence
  Synthetic oligonucleotide
gtgccaccccgggacctggactgacccaatcatgca

SEQ ID NO: 18011 - DNA, 35 bp, Artificial Sequence
  Synthetic oligonucleotide
gagtgtcgtgcttaccatcatatcctgctctcgta

SEQ ID NO: 18012 - DNA, 36 bp, Artificial Sequence
  Synthetic oligonucleotide
gccgatcgcaggcctcttttttatacagtcctctta

SEQ ID NO: 18013 - DNA, 35 bp, Artificial Sequence
  Synthetic oligonucleotide
gtgctgcctctgtccggcttactggttcgtttgtc

SEQ ID NO: 18014 - DNA, 35 bp, Artificial Sequence
  Synthetic oligonucleotide
gtgtcagctccggtccgcaacaacacgtctatact

SEQ ID NO: 18015 - DNA, 35 bp, Artificial Sequence
  Synthetic oligonucleotide
accatgccctgccaacccgccattgcctaaaagct

SEQ ID NO: 18016 - DNA, 36 bp, Artificial Sequence
  Synthetic oligonucleotide
gcccaatcggcgccctatccacctctccgtggcgca

SEQ ID NO: 18017 - DNA, 37 bp, Artificial Sequence
  Synthetic oligonucleotide
gactggtctgccgtatccacacttctgttccccgtga

SEQ ID NO: 18018 - DNA, 37 bp, Artificial Sequence
  Synthetic oligonucleotide
gcaccggtgatcacccccactcacgccctcccgttga

SEQ ID NO: 18019 - DNA, 36 bp, Artificial Sequence
  Synthetic oligonucleotide
gactcctgttgccatatacaccgctgttctctttga

SEQ ID NO: 18020 - DNA, 35 bp, Artificial Sequence
  Synthetic oligonucleotide
gccgggacgtacgccttgcccccacccttgtatcg

SEQ ID NO: 18021 - DNA, 36 bp, Artificial Sequence
  Synthetic oligonucleotide
gaccggcgatctcgatcatgctgctccgtccgttca

SEQ ID NO: 18022 - DNA, 37 bp, Artificial Sequence
  Synthetic oligonucleotide
gaaggcccccccagcccgtcacccttgttcgtgtgga

SEQ ID NO: 18023 - DNA, 36 bp, Artificial Sequence
  Synthetic oligonucleotide
tctcagccactctgcggaacgcacgcatctatccta

SEQ ID NO: 18024 - DNA, 35 bp, Artificial Sequence
  Synthetic oligonucleotide
gagtagggaagggtggggttagaagctgggacctc

SEQ ID NO: 18025 - DNA, 38 bp, Artificial Sequence
  Synthetic oligonucleotide
ggggggggaggtacgggatagggaacgctcacctgtga

SEQ ID NO: 18026 - DNA, 37 bp, Artificial Sequence
  Synthetic oligonucleotide
actccccccacagactatgactatgaatgacgtttga

SEQ ID NO: 18027 - DNA, 35 bp, Artificial Sequence
  Synthetic oligonucleotide
gccagactaacctccgcgataaagtcatccccctc

SEQ ID NO: 18028 - DNA, 35 bp, Artificial Sequence
  Synthetic oligonucleotide
gaagagggcgggggatttgatcgtaggtggtggtg

SEQ ID NO: 18029 - DNA, 35 bp, Artificial Sequence
  Synthetic oligonucleotide
ggaatccacgctgctgacgcctccggctcccccga

SEQ ID NO: 18030 - DNA, 36 bp, Artificial Sequence
  Synthetic oligonucleotide
actcgcattgggggggaggaacgtagtacggtggga

SEQ ID NO: 18031 - DNA, 38 bp, Artificial Sequence
  Synthetic oligonucleotide
taagcgcggggggaggaaggtgggaatacttgctatga

SEQ ID NO: 18032 - DNA, 38 bp, Artificial Sequence
  Synthetic oligonucleotide
acacctgtgccttccatgcttcaagcaaccgatcttga

SEQ ID NO: 18033 - DNA, 35 bp, Artificial Sequence
  Synthetic oligonucleotide
atcaagccctacgacacattgccttttccgatgcc

SEQ ID NO: 18034 - DNA, 36 bp, Artificial Sequence
  Synthetic oligonucleotide
tctgcctcctgcttatctatcgacctcgcccgccaa

SEQ ID NO: 18035 - DNA, 36 bp, Artificial Sequence
  Synthetic oligonucleotide
ggaccttcctcagttttcttcatgattgcccttaca

SEQ ID NO: 18036 - DNA, 38 bp, Artificial Sequence
  Synthetic oligonucleotide
tgttaccgatccctctgcgccaagtgcgccgccattga

SEQ ID NO: 18037 - DNA, 35 bp, Artificial Sequence
  Synthetic oligonucleotide
gatgcggcccatttcagcatctcgtctctacccgc

SEQ ID NO: 18038 - DNA, 35 bp, Artificial Sequence
  Synthetic oligonucleotide
ggttcccccgcacacgcccatgtctcagtgtcttc

SEQ ID NO: 18039 - DNA, 35 bp, Artificial Sequence
  Synthetic oligonucleotide
attcagcctcacatggccccaattactagtcccct

SEQ ID NO: 18040 - DNA, 38 bp, Artificial Sequence
  Synthetic oligonucleotide
gcaacaatgcccccactaccttccccccctcggggtga

SEQ ID NO: 18041 - DNA, 38 bp, Artificial Sequence
  Synthetic oligonucleotide
gtgaacgtacacgcgggtatcccatcctcttgttttga

SEQ ID NO: 18042 - DNA, 35 bp, Artificial Sequence
  Synthetic oligonucleotide
ggacacagccctattgacatatcgcgcaatgcctc

SEQ ID NO: 18043 - DNA, 35 bp, Artificial Sequence
  Synthetic oligonucleotide
gcctatgacgctttctgtatttctgtttcctgctt

SEQ ID NO: 18044 - DNA, 36 bp, Artificial Sequence
  Synthetic oligonucleotide
taagtgacgccacctgccttgattcgttttatcaca

SEQ ID NO: 18045 - DNA, 37 bp, Artificial Sequence
  Synthetic oligonucleotide
aaaccgtaaaggggagtagagaggaagggatcgagga

SEQ ID NO: 18046 - DNA, 36 bp, Artificial Sequence
  Synthetic oligonucleotide
gccaccgacaccctctctacctttcagtgcgattga

SEQ ID NO: 18047 - DNA, 38 bp, Artificial Sequence
  Synthetic oligonucleotide
acatccatcgcctgttcgcggcatcaaccctaccttga

SEQ ID NO: 18048 - DNA, 35 bp, Artificial Sequence
  Synthetic oligonucleotide
agtacggcacaggtagccttcaaccggcccttccc

SEQ ID NO: 18049 - DNA, 35 bp, Artificial Sequence
  Synthetic oligonucleotide
tacaccactgtcagtctccccttccaagcccggcc

SEQ ID NO: 18050 - DNA, 32 bp, Artificial Sequence
  Synthetic oligonucleotide
gtggcccatgagcccttcccaccttctatgaa

SEQ ID NO: 18051 - DNA, 36 bp, Artificial Sequence
  Synthetic oligonucleotide
tagcccatttacccacagcattgctactcctccgga

SEQ ID NO: 18052 - DNA, 37 bp, Artificial Sequence
  Synthetic oligonucleotide
gagccagccctattcgtaaccttctgtcctactctga

SEQ ID NO: 18053 - DNA, 37 bp, Artificial Sequence
  Synthetic oligonucleotide
gaggtcaccgacggggcagcatatagggaggggttga

SEQ ID NO: 18054 - DNA, 36 bp, Artificial Sequence
  Synthetic oligonucleotide
ttgtcaccccccttattcgcagataaatctgtcgta

SEQ ID NO: 18055 - DNA, 35 bp, Artificial Sequence
  Synthetic oligonucleotide
ggatcatcctttggaacctcctctgcctttgctgc

SEQ ID NO: 18056 - DNA, 35 bp, Artificial Sequence
  Synthetic oligonucleotide
tgaccacggacttctctctgatctactggttccat

SEQ ID NO: 18057 - DNA, 35 bp, Artificial Sequence
  Synthetic oligonucleotide
gaccgatctccctcacacgtatattccgcgtgtat

SEQ ID NO: 18058 - DNA, 36 bp, Artificial Sequence
  Synthetic oligonucleotide
aaagcaagccacttgcccattttacctccctcgcga

SEQ ID NO: 18059 - DNA, 35 bp, Artificial Sequence
  Synthetic oligonucleotide
atcccccggctaaacatgctccttcaacttgcgcc

SEQ ID NO: 18060 - DNA, 35 bp, Artificial Sequence
  Synthetic oligonucleotide
tcgtgtatgcctcgctcctccggtcttcgtttgcc

SEQ ID NO: 18061 - DNA, 35 bp, Artificial Sequence
  Synthetic oligonucleotide
tccctggccaccccatccttgatatcgtacacgag

SEQ ID NO: 18062 - DNA, 35 bp, Artificial Sequence
  Synthetic oligonucleotide
actaccatgcacgccatgcccacattccataaacg

SEQ ID NO: 18063 - DNA, 35 bp, Artificial Sequence
  Synthetic oligonucleotide
gtgctactctcattatggctcaccttctcatccgt

SEQ ID NO: 18064 - DNA, 35 bp, Artificial Sequence
  Synthetic oligonucleotide
tcgacccatgatcctcacgtgattgctccacttaa

SEQ ID NO: 18065 - DNA, 38 bp, Artificial Sequence
  Synthetic oligonucleotide
gacgctcacattggcaaatcatctagctgaaaccctga

SEQ ID NO: 18066 - DNA, 38 bp, Artificial Sequence
  Synthetic oligonucleotide
gcgcaccgctcgcctactaccgcacctcgccttgttga

SEQ ID NO: 18067 - DNA, 36 bp, Artificial Sequence
  Synthetic oligonucleotide
gtacattcgcagataccctccatttgctacatttga

SEQ ID NO: 18068 - DNA, 35 bp, Artificial Sequence
  Synthetic oligonucleotide
gtccccccttcccctcggcatgtgaacacctacta

SEQ ID NO: 18069 - DNA, 35 bp, Artificial Sequence
  Synthetic oligonucleotide
gagcgtccatcctgctacgtttcccgcgtctctgc

SEQ ID NO: 18070 - DNA, 35 bp, Artificial Sequence
  Synthetic oligonucleotide
tacgcaagcccattaaagcgcaagacccgccctct

SEQ ID NO: 18071 - DNA, 35 bp, Artificial Sequence
  Synthetic oligonucleotide
actgcacctctaaaccctacgctctgcttacgctt

SEQ ID NO: 18072 - DNA, 35 bp, Artificial Sequence
  Synthetic oligonucleotide
gtcaaccatgccctatgttttgccaccaatccaaa

SEQ ID NO: 18073 - DNA, 35 bp, Artificial Sequence
  Synthetic oligonucleotide
gagcaactgaaccaccgaggcgcccactgtcccaa

SEQ ID NO: 18074 - DNA, 36 bp, Artificial Sequence
  Synthetic oligonucleotide
gccaagtctcgtgccttctatacctttctgtcgcaa

SEQ ID NO: 18075 - DNA, 35 bp, Artificial Sequence
  Synthetic oligonucleotide
ttgcggccctacactgcgaccgaagctccttccca

SEQ ID NO: 18076 - DNA, 36 bp, Artificial Sequence
  Synthetic oligonucleotide
gcccgcactgaacgttccgccatgcccccagaagca

SEQ ID NO: 18077 - DNA, 38 bp, Artificial Sequence
  Synthetic oligonucleotide
tcattccatcctcggcaagcgcgtacgccacggcttga

SEQ ID NO: 18078 - DNA, 36 bp, Artificial Sequence
  Synthetic oligonucleotide
accctcgcatctctctccgttatcatgccagtcgta

SEQ ID NO: 18079 - DNA, 35 bp, Artificial Sequence
  Synthetic oligonucleotide
tgtatacaccgccattagccccgcaattccattac

SEQ ID NO: 18080 - DNA, 35 bp, Artificial Sequence
  Synthetic oligonucleotide
caacacccccgagctatttccttcaccgtgccctg

SEQ ID NO: 18081 - DNA, 35 bp, Artificial Sequence
  Synthetic oligonucleotide
gcgaacgtcctcccactgaagccgaacatacaaca

SEQ ID NO: 18082 - DNA, 38 bp, Artificial Sequence
  Synthetic oligonucleotide
gacgcccaagctgctactgccttctacactcttggtga

SEQ ID NO: 18083 - DNA, 38 bp, Artificial Sequence
  Synthetic oligonucleotide
aaacgatggaacgggaaaagggagataagcccatgtga

SEQ ID NO: 18084 - DNA, 35 bp, Artificial Sequence
  Synthetic oligonucleotide
tcacccgcccgagatgcccagtcagcattacgacc

SEQ ID NO: 18085 - DNA, 35 bp, Artificial Sequence
  Synthetic oligonucleotide
aaccctccccagtcactagtcgcggtgctgccccc

SEQ ID NO: 18086 - DNA, 35 bp, Artificial Sequence
  Synthetic oligonucleotide
atccgtccacttcgcggtgtcacgccagtcccctt

SEQ ID NO: 18087 - DNA, 36 bp, Artificial Sequence
  Synthetic oligonucleotide
aacgggagatgagggatggggcacaaggaatggcaa

SEQ ID NO: 18088 - DNA, 36 bp, Artificial Sequence
  Synthetic oligonucleotide
gacacaggcctctaatcattgttgcgtgcgctgcaa

SEQ ID NO: 18089 - DNA, 36 bp, Artificial Sequence
  Synthetic oligonucleotide
taacacgtccgctcacctacgttcttggcgttctca

SEQ ID NO: 18090 - DNA, 36 bp, Artificial Sequence
  Synthetic oligonucleotide
agcgtgccgcccttcacatcacacgtgcatcacccc

SEQ ID NO: 18091 - DNA, 35 bp, Artificial Sequence
  Synthetic oligonucleotide
aatacctccgtagcattcggctactgttacttccc

SEQ ID NO: 18092 - DNA, 35 bp, Artificial Sequence
  Synthetic oligonucleotide
tggaaccgctataggtctcctgtctttctgcctgc

SEQ ID NO: 18093 - DNA, 35 bp, Artificial Sequence
  Synthetic oligonucleotide
tacgtgcaaacccgccctagcgccatgacttaatc

SEQ ID NO: 18094 - DNA, 35 bp, Artificial Sequence
  Synthetic oligonucleotide
gccacactgctcgaagcttcttgcctcattgaact

SEQ ID NO: 18095 - DNA, 36 bp, Artificial Sequence
  Synthetic oligonucleotide
tgtgcctcatcttcacgcgaatgctcacgccacaca

SEQ ID NO: 18096 - DNA, 35 bp, Artificial Sequence
  Synthetic oligonucleotide
gactgctgcgggctgggggaggaaaaaggtggcca

SEQ ID NO: 18097 - DNA, 35 bp, Artificial Sequence
  Synthetic oligonucleotide
tgaggggggatggagggcgtcaagatacaacggga

SEQ ID NO: 18098 - DNA, 35 bp, Artificial Sequence
  Synthetic oligonucleotide
acgctcacccgacgccttgtcatccgttgcctaac

SEQ ID NO: 18099 - DNA, 36 bp, Artificial Sequence
  Synthetic oligonucleotide
actagcactgctgacttatcgcctgttctttgctaa

SEQ ID NO: 18100 - DNA, 35 bp, Artificial Sequence
  Synthetic oligonucleotide
tcgcatgcatgtgacgccagctccgttccttctca

SEQ ID NO: 18101 - DNA, 38 bp, Artificial Sequence
  Synthetic oligonucleotide
ttgcaaacgcgctgtccattcgccctgtttctcattga

SEQ ID NO: 18102 - DNA, 35 bp, Artificial Sequence
  Synthetic oligonucleotide
aagcccgctgaccttgccaaatattcattaccatc

SEQ ID NO: 18103 - DNA, 35 bp, Artificial Sequence
  Synthetic oligonucleotide
gcaacccccgattaatgccccctgtccggtctggt

SEQ ID NO: 18104 - DNA, 35 bp, Artificial Sequence
  Synthetic oligonucleotide
ggaaaaccacaactgggggcggaacggataaattt

SEQ ID NO: 18105 - DNA, 34 bp, Artificial Sequence
  Synthetic oligonucleotide
atgcgcacgctgaacaccccggcgaccgatcaca

SEQ ID NO: 18106 - DNA, 36 bp, Artificial Sequence
  Synthetic oligonucleotide
tagccaatcggacgcggagggaggatgagggtggga

SEQ ID NO: 18107 - DNA, 36 bp, Artificial Sequence
  Synthetic oligonucleotide
tactactccacacatacgccagcctttcgaccctga

SEQ ID NO: 18108 - DNA, 35 bp, Artificial Sequence
  Synthetic oligonucleotide
tgagcgccgcgcaacaccgagcttctccttttcct

SEQ ID NO: 18109 - DNA, 35 bp, Artificial Sequence
  Synthetic oligonucleotide
tcttcgtcgcctccctatgttactccaaccgttct

SEQ ID NO: 18110 - DNA, 36 bp, Artificial Sequence
  Synthetic oligonucleotide
ttccccgcacctcccatgcgcgtctctaacctgaaa

SEQ ID NO: 18111 - DNA, 38 bp, Artificial Sequence
  Synthetic oligonucleotide
tccacatcaggccgagggtctatcgctgccccctttga

SEQ ID NO: 18112 - DNA, 38 bp, Artificial Sequence
  Synthetic oligonucleotide
acccacacacgtagctgatcgtggccacatctctttga

SEQ ID NO: 18113 - DNA, 35 bp, Artificial Sequence
  Synthetic oligonucleotide
taaccgcactgcatatgcctcttctgtgcagttac

SEQ ID NO: 18114 - DNA, 35 bp, Artificial Sequence
  Synthetic oligonucleotide
tcaccctcggtcgctctgccatccctcatactggc

SEQ ID NO: 18115 - DNA, 35 bp, Artificial Sequence
  Synthetic oligonucleotide
tttccgccaccgccgccctgcgaactgcagttatt

SEQ ID NO: 18116 - DNA, 35 bp, Artificial Sequence
  Synthetic oligonucleotide
gaagaccgacccctgtaccagctaacatttcttac

SEQ ID NO: 18117 - DNA, 35 bp, Artificial Sequence
  Synthetic oligonucleotide
tcagccttactgcggattggatcttccccccctgc

SEQ ID NO: 18118 - DNA, 35 bp, Artificial Sequence
  Synthetic oligonucleotide
aattgaccgcccttgaagtgcaaccaacgcttctc

SEQ ID NO: 18119 - DNA, 35 bp, Artificial Sequence
  Synthetic oligonucleotide
gcgaaactcgcctcccctgaccatcttagaatatg

SEQ ID NO: 18120 - DNA, 35 bp, Artificial Sequence
  Synthetic oligonucleotide
agacctccgcacactgagccttcaccggggacctt

SEQ ID NO: 18121 - DNA, 37 bp, Artificial Sequence
  Synthetic oligonucleotide
ttacgtccactgcaccggtgatttcactccccctaga

SEQ ID NO: 18122 - DNA, 38 bp, Artificial Sequence
  Synthetic oligonucleotide
aacgattggccgaacacgtagaccaccgccctaaatga

SEQ ID NO: 18123 - DNA, 35 bp, Artificial Sequence
  Synthetic oligonucleotide
ttcctccgaacgcaattccctggtcttcagactac

SEQ ID NO: 18124 - DNA, 35 bp, Artificial Sequence
  Synthetic oligonucleotide
ttctcacactcgcacaccccagacatgccggagcg

SEQ ID NO: 18125 - DNA, 34 bp, Artificial Sequence
  Synthetic oligonucleotide
aagatcccaccgtcagccttcccaacccctcagt

SEQ ID NO: 18126 - DNA, 37 bp, Artificial Sequence
  Synthetic oligonucleotide
gccatcctgacgccctagcttggactcgactcttcga

SEQ ID NO: 18127 - DNA, 38 bp, Artificial Sequence
  Synthetic oligonucleotide
tgacccccgcctccgattcttctaatgataacatatga

SEQ ID NO: 18128 - DNA, 35 bp, Artificial Sequence
  Synthetic oligonucleotide
acaagcggctcaccgtttttcacgccgtccactcc

SEQ ID NO: 18129 - DNA, 36 bp, Artificial Sequence
  Synthetic oligonucleotide
tgactgaagaccccccgttcccttgtaccgccccag

SEQ ID NO: 18130 - DNA, 38 bp, Artificial Sequence
  Synthetic oligonucleotide
gtcgaacgcacaaacttttaaacgctacatccacctga

SEQ ID NO: 18131 - DNA, 38 bp, Artificial Sequence
  Synthetic oligonucleotide
gcgcctgcctaccgtgttcattttgccctccccgctga

SEQ ID NO: 18132 - DNA, 35 bp, Artificial Sequence
  Synthetic oligonucleotide
gcccgccacgccgcttgactgactagcagtgatac

SEQ ID NO: 18133 - DNA, 35 bp, Artificial Sequence
  Synthetic oligonucleotide
gatgcgagtgtgtggccgccgtttgtatttcctcc

SEQ ID NO: 18134 - DNA, 35 bp, Artificial Sequence
  Synthetic oligonucleotide
gtagactgccagggggggatggctggggcggtgtc

SEQ ID NO: 18135 - DNA, 35 bp, Artificial Sequence
  Synthetic oligonucleotide
gtgaagccacgccgcggtctttctccgacaccttg

SEQ ID NO: 18136 - DNA, 35 bp, Artificial Sequence
  Synthetic oligonucleotide
tcatgtccccgccaccctctgtagcgcttcgtatt

SEQ ID NO: 18137 - DNA, 36 bp, Artificial Sequence
  Synthetic oligonucleotide
ttccaccgcagttcacaccgtccgaaaacctgcgca

SEQ ID NO: 18138 - DNA, 35 bp, Artificial Sequence
  Synthetic oligonucleotide
actacctgcgctcactacgagtgcccacctgctta

SEQ ID NO: 18139 - DNA, 35 bp, Artificial Sequence
  Synthetic oligonucleotide
tagcaccgtacgaacgtaccatcgctgatcccgtc

SEQ ID NO: 18140 - DNA, 35 bp, Artificial Sequence
  Synthetic oligonucleotide
aacatccgttacctgtacctatcacctcgtacccg

SEQ ID NO: 18141 - DNA, 35 bp, Artificial Sequence
  Synthetic oligonucleotide
tcatccgacggcctcgtgttgcccttatgttacct

SEQ ID NO: 18142 - DNA, 38 bp, Artificial Sequence
  Synthetic oligonucleotide
acccatctcacataccgcactcaatccgccgggactga

SEQ ID NO: 18143 - DNA, 38 bp, Artificial Sequence
  Synthetic oligonucleotide
ggaccagaatcagtgctttcacacacctgccatactga

SEQ ID NO: 18144 - DNA, 36 bp, Artificial Sequence
  Synthetic oligonucleotide
atgcacctcgctatctgaaccgctttgtcatctcta

SEQ ID NO: 18145 - DNA, 35 bp, Artificial Sequence
  Synthetic oligonucleotide
tgcctccacaagctaatgttactcaccgccacttg

SEQ ID NO: 18146 - DNA, 35 bp, Artificial Sequence
  Synthetic oligonucleotide
tccagctggcccactcgttgtcccagcttccttgt

SEQ ID NO: 18147 - DNA, 36 bp, Artificial Sequence
  Synthetic oligonucleotide
aattaccatccgatcgcacgtgacactcgttccaaa

SEQ ID NO: 18148 - DNA, 36 bp, Artificial Sequence
  Synthetic oligonucleotide
cccattgacactgtcttcccgatttgggacctccaa

SEQ ID NO: 18149 - DNA, 35 bp, Artificial Sequence
  Synthetic oligonucleotide
gtctccgcccgttcactctctgactcaacaggcca

SEQ ID NO: 18150 - DNA, 36 bp, Artificial Sequence
  Synthetic oligonucleotide
ggaaagacggggaaggtgggtggtaattgcgtttca

SEQ ID NO: 18151 - DNA, 36 bp, Artificial Sequence
  Synthetic oligonucleotide
gacctcgtctgaagttcctttcctccacctgcacga

SEQ ID NO: 18152 - DNA, 37 bp, Artificial Sequence
  Synthetic oligonucleotide
acgagtgtcggctcgggcactgcaccatcactatcga

SEQ ID NO: 18153 - DNA, 38 bp, Artificial Sequence
  Synthetic oligonucleotide
ttgaccacgcgctcccgtttctccctcatacgcactga

SEQ ID NO: 18154 - DNA, 38 bp, Artificial Sequence
  Synthetic oligonucleotide
tgccggcccccagtgtttccgaatttcccctcctgtga

SEQ ID NO: 18155 - DNA, 35 bp, Artificial Sequence
  Synthetic oligonucleotide
acccaacatatcacattgttcatttctagttttac

SEQ ID NO: 18156 - DNA, 35 bp, Artificial Sequence
  Synthetic oligonucleotide
gaagaagtggtgggtaagggtatcgcgggggcgga

SEQ ID NO: 18157 - DNA, 38 bp, Artificial Sequence
  Synthetic oligonucleotide
tcacgaccacccgtttgttcagtgcccgccctcaatga

SEQ ID NO: 18158 - DNA, 38 bp, Artificial Sequence
  Synthetic oligonucleotide
atgcaacccacccgctccatctacgagacgatccatga

SEQ ID NO: 18159 - DNA, 37 bp, Artificial Sequence
  Synthetic oligonucleotide
accaccatggaaacgcacccactgtacagtctcctga

SEQ ID NO: 18160 - DNA, 38 bp, Artificial Sequence
  Synthetic oligonucleotide
gagggggccaaaagagaaggagagttggggagggttga

SEQ ID NO: 18161 - DNA, 35 bp, Artificial Sequence
  Synthetic oligonucleotide
acacacgtaagtccatcggttatcctcagcctacc

SEQ ID NO: 18162 - DNA, 35 bp, Artificial Sequence
  Synthetic oligonucleotide
gttcccccgaagtaagtgcccttcaacatcgatcc

SEQ ID NO: 18163 - DNA, 35 bp, Artificial Sequence
  Synthetic oligonucleotide
gtcgtactccattgctattctgccagacctgactc

SEQ ID NO: 18164 - DNA, 35 bp, Artificial Sequence
  Synthetic oligonucleotide
taggatcccctccaccccattttctgacacgcaag

SEQ ID NO: 18165 - DNA, 35 bp, Artificial Sequence
  Synthetic oligonucleotide
tgtccagggcgtgtttttctgggttgttcatactg

SEQ ID NO: 18166 - DNA, 35 bp, Artificial Sequence
  Synthetic oligonucleotide
tgtgtgcccgggcctaggactgtttcttgtttgct

SEQ ID NO: 18167 - DNA, 35 bp, Artificial Sequence
  Synthetic oligonucleotide
ttaatgcaccgcattgcacctcgtattcatcccaa

SEQ ID NO: 18168 - DNA, 35 bp, Artificial Sequence
  Synthetic oligonucleotide
agactcgccgtctcatcgtcactcattaccacgcc

SEQ ID NO: 18169 - DNA, 35 bp, Artificial Sequence
  Synthetic oligonucleotide
gccgacatccccgtagactttagccattgtctttc

SEQ ID NO: 18170 - DNA, 35 bp, Artificial Sequence
  Synthetic oligonucleotide
acgcgggtcctctctgcatcattgttaacttccat

SEQ ID NO: 18171 - DNA, 35 bp, Artificial Sequence
  Synthetic oligonucleotide
gacatccctcagaacccctgctcccgggcacatca

SEQ ID NO: 18172 - DNA, 38 bp, Artificial Sequence
  Synthetic oligonucleotide
taacttgccaccaccgaaatttgaccggtgtcaaatga

SEQ ID NO: 18173 - DNA, 35 bp, Artificial Sequence
  Synthetic oligonucleotide
atgacttacccactgagcggtatatcacacacgcc

SEQ ID NO: 18174 - DNA, 35 bp, Artificial Sequence
  Synthetic oligonucleotide
tcctgccacacggacccatttccacaaggcgcctg

SEQ ID NO: 18175 - DNA, 35 bp, Artificial Sequence
  Synthetic oligonucleotide
tccacgcactccgggcccaaagctcttccggtccc

SEQ ID NO: 18176 - DNA, 35 bp, Artificial Sequence
  Synthetic oligonucleotide
acgccacacctcatgttctttgttcttttggacgg

SEQ ID NO: 18177 - DNA, 36 bp, Artificial Sequence
  Synthetic oligonucleotide
aagcctcccgccaaattacgctactggcactaacca

SEQ ID NO: 18178 - DNA, 38 bp, Artificial Sequence
  Synthetic oligonucleotide
acttaacctgcctggaggagccacacccattccactga

SEQ ID NO: 18179 - DNA, 38 bp, Artificial Sequence
  Synthetic oligonucleotide
tacactgcacgtaccgttgcccttctgttgccacctga

SEQ ID NO: 18180 - DNA, 38 bp, Artificial Sequence
  Synthetic oligonucleotide
tgcgtgctcatttccgttcaaccactcccgtcacctga

SEQ ID NO: 18181 - DNA, 35 bp, Artificial Sequence
  Synthetic oligonucleotide
tgaaccactctccacccctgcttactccgacacac

SEQ ID NO: 18182 - DNA, 35 bp, Artificial Sequence
  Synthetic oligonucleotide
gactcccaacggtttacagggcccatcctgctgac

SEQ ID NO: 18183 - DNA, 35 bp, Artificial Sequence
  Synthetic oligonucleotide
gaggtcgctttccacactggccatcgctcattaca

SEQ ID NO: 18184 - DNA, 35 bp, Artificial Sequence
  Synthetic oligonucleotide
tccatcgcctatcccgtccattttcaaatatgcca

SEQ ID NO: 18185 - DNA, 37 bp, Artificial Sequence
  Synthetic oligonucleotide
tcagtggtggagggctgataggacgctcaagcgggga

SEQ ID NO: 18186 - DNA, 35 bp, Artificial Sequence
  Synthetic oligonucleotide
gcctagggcgctgattcctccagtcacatctacac

SEQ ID NO: 18187 - DNA, 35 bp, Artificial Sequence
  Synthetic oligonucleotide
gttacaccgacattctggcccatacctataccgac

SEQ ID NO: 18188 - DNA, 35 bp, Artificial Sequence
  Synthetic oligonucleotide
tccccacgcccctcgtccaccttaggctctccgac

SEQ ID NO: 18189 - DNA, 35 bp, Artificial Sequence
  Synthetic oligonucleotide
ccacctggggccaccttccgcggtcagctttctcc

SEQ ID NO: 18190 - DNA, 35 bp, Artificial Sequence
  Synthetic oligonucleotide
gccccgtctcggttcgttacattccacggcgttcc

SEQ ID NO: 18191 - DNA, 35 bp, Artificial Sequence
  Synthetic oligonucleotide
gcttgacgaccgaattagcttgttccccctttagc

SEQ ID NO: 18192 - DNA, 35 bp, Artificial Sequence
  Synthetic oligonucleotide
tccggactactcatcattcgagcccgtatctgttc

SEQ ID NO: 18193 - DNA, 36 bp, Artificial Sequence
  Synthetic oligonucleotide
acatccggtgctggcagccctcctcagcttcctaca

SEQ ID NO: 18194 - DNA, 38 bp, Artificial Sequence
  Synthetic oligonucleotide
acgatcaccgctcaccattccaacgggcccactcttga

SEQ ID NO: 18195 - DNA, 36 bp, Artificial Sequence
  Synthetic oligonucleotide
gccccaactgcccgtttcgtactgacatatctgcta

SEQ ID NO: 18196 - DNA, 35 bp, Artificial Sequence
  Synthetic oligonucleotide
gagccccttgatcctgccagagaatcgtccccttc

SEQ ID NO: 18197 - DNA, 35 bp, Artificial Sequence
  Synthetic oligonucleotide
attccacctgcctagttgcgccttctgatatccct

SEQ ID NO: 18198 - DNA, 36 bp, Artificial Sequence
  Synthetic oligonucleotide
gggggctgggggaaggggtcgactaacgaagggcca

SEQ ID NO: 18199 - DNA, 36 bp, Artificial Sequence
  Synthetic oligonucleotide
gaccagccttttttagtcgtaatttgctcccctgta

SEQ ID NO: 18200 - DNA, 35 bp, Artificial Sequence
  Synthetic oligonucleotide
tcccccgcctcgctttgactctactgtgattagtg

SEQ ID NO: 18201 - DNA, 35 bp, Artificial Sequence
  Synthetic oligonucleotide
acaatctgacccgcttgtagagtctttccttcact

SEQ ID NO: 18202 - DNA, 35 bp, Artificial Sequence
  Synthetic oligonucleotide
tccatactgtgagcacgccataactgcctctgcct

SEQ ID NO: 18203 - DNA, 35 bp, Artificial Sequence
  Synthetic oligonucleotide
tgtacagcccgcttgttcgtcgcttccatcttgct

SEQ ID NO: 18204 - DNA, 35 bp, Artificial Sequence
  Synthetic oligonucleotide
tgcacccgcatggccatttcccgcccctcaaacgt

SEQ ID NO: 18205 - DNA, 35 bp, Artificial Sequence
  Synthetic oligonucleotide
acacaaccctgctatagtatgcaccattgtctctt

SEQ ID NO: 18206 - DNA, 36 bp, Artificial Sequence
  Synthetic oligonucleotide
acgcaatgctccagctctgtcctcctgcgtatcgca

SEQ ID NO: 18207 - DNA, 35 bp, Artificial Sequence
  Synthetic oligonucleotide
taccagcccactcttgttcgcatcggtacaactca

SEQ ID NO: 18208 - DNA, 38 bp, Artificial Sequence
  Synthetic oligonucleotide
gcatgggtgggtggggaagacgggttgatcgcgtttga

SEQ ID NO: 18209 - DNA, 35 bp, Artificial Sequence
  Synthetic oligonucleotide
tgcaaacactgctccccacgcccataacttacgcc

SEQ ID NO: 18210 - DNA, 35 bp, Artificial Sequence
  Synthetic oligonucleotide
agatttccccgtacacctcccgcgatcctgttgcc

SEQ ID NO: 18211 - DNA, 35 bp, Artificial Sequence
  Synthetic oligonucleotide
tccaccccggccaaatacgaagttacgtgcctaaa

SEQ ID NO: 18212 - DNA, 35 bp, Artificial Sequence
  Synthetic oligonucleotide
tgtactcaccaacgtggcatttttactcccaccga

SEQ ID NO: 18213 - DNA, 37 bp, Artificial Sequence
  Synthetic oligonucleotide
gactgcccgcccggccgtctaccattccatgctccga

SEQ ID NO: 18214 - DNA, 35 bp, Artificial Sequence
  Synthetic oligonucleotide
tgtcacctcaaccctctttaccgactgactggcga

SEQ ID NO: 18215 - DNA, 37 bp, Artificial Sequence
  Synthetic oligonucleotide
gtggacactacccgatttgattacacacttgacctga

SEQ ID NO: 18216 - DNA, 38 bp, Artificial Sequence
  Synthetic oligonucleotide
agggcgggtgggatgggatatagttgactgaggcttga

SEQ ID NO: 18217 - DNA, 35 bp, Artificial Sequence
  Synthetic oligonucleotide
ctacgcaccacgcccctctctttgttccaggcgac

SEQ ID NO: 18218 - DNA, 35 bp, Artificial Sequence
  Synthetic oligonucleotide
gccgctcatcctcttcatcgcgggatatcactctc

SEQ ID NO: 18219 - DNA, 35 bp, Artificial Sequence
  Synthetic oligonucleotide
acgcgcggcctctcctgctgcgtcaacccatcttc

SEQ ID NO: 18220 - DNA, 35 bp, Artificial Sequence
  Synthetic oligonucleotide
gacgtacatccgagtatcagcccgatcccccatct

SEQ ID NO: 18221 - DNA, 35 bp, Artificial Sequence
  Synthetic oligonucleotide
acatcctacccgggcccccgacttgacaccaaggt

SEQ ID NO: 18222 - DNA, 38 bp, Artificial Sequence
  Synthetic oligonucleotide
gtgacgaacgccaaactcactgcccgctacattgctga

SEQ ID NO: 18223 - DNA, 38 bp, Artificial Sequence
  Synthetic oligonucleotide
aacacccccgcccagtcggcatacacgcccctagttga

SEQ ID NO: 18224 - DNA, 35 bp, Artificial Sequence
  Synthetic oligonucleotide
agccccgcatatccttaccccggccgattacatgg

SEQ ID NO: 18225 - DNA, 36 bp, Artificial Sequence
  Synthetic oligonucleotide
gaaggtggtaggagggggtggataatttcaggagaa

SEQ ID NO: 18226 - DNA, 36 bp, Artificial Sequence
  Synthetic oligonucleotide
tcgaggcacattcagctgcgaccctcctctctacca

SEQ ID NO: 18227 - DNA, 37 bp, Artificial Sequence
  Synthetic oligonucleotide
tatccatcgccgactgccttcaatgatagcttcccga

SEQ ID NO: 18228 - DNA, 35 bp, Artificial Sequence
  Synthetic oligonucleotide
gaccgctgcagaacccatttggtaggccgtatctc

SEQ ID NO: 18229 - DNA, 35 bp, Artificial Sequence
  Synthetic oligonucleotide
tcccgctgtatccatcttgtgccatgcctgtgttc

SEQ ID NO: 18230 - DNA, 35 bp, Artificial Sequence
  Synthetic oligonucleotide
ggtgacgatggggtgttggaaaaggggattcgttg

SEQ ID NO: 18231 - DNA, 35 bp, Artificial Sequence
  Synthetic oligonucleotide
acattgccgccccaacatttctgaggccggacctt

SEQ ID NO: 18232 - DNA, 37 bp, Artificial Sequence
  Synthetic oligonucleotide
tccatccctccgcacctcaccctgggcggtcccctga

SEQ ID NO: 18233 - DNA, 35 bp, Artificial Sequence
  Synthetic oligonucleotide
gtcacggtcgctctcgcaattgcaccctaatatcc

SEQ ID NO: 18234 - DNA, 36 bp, Artificial Sequence
  Synthetic oligonucleotide
gcgcacatgttccgcgctttccatgtcctgcctcca

SEQ ID NO: 18235 - DNA, 37 bp, Artificial Sequence
  Synthetic oligonucleotide
ttaggcccactcgcaagcacgacaccgcactcctaga

SEQ ID NO: 18236 - DNA, 38 bp, Artificial Sequence
  Synthetic oligonucleotide
accactccggccctgtactatagagttctttcctctga

SEQ ID NO: 18237 - DNA, 35 bp, Artificial Sequence
  Synthetic oligonucleotide
ttgacgtgggctgaactttttttttcctatgcatc

SEQ ID NO: 18238 - DNA, 35 bp, Artificial Sequence
  Synthetic oligonucleotide
gttctgtccccagccgaggacacgctgtcccccct

SEQ ID NO: 18239 - DNA, 35 bp, Artificial Sequence
  Synthetic oligonucleotide
tacctgggccagccgacgcatcacttgacctctct

SEQ ID NO: 18240 - DNA, 36 bp, Artificial Sequence
  Synthetic oligonucleotide
gcatatcacagcccccaagcatctccctcgggcaca

SEQ ID NO: 18241 - DNA, 36 bp, Artificial Sequence
  Synthetic oligonucleotide
gatcgaacgtgttcccgccattgccgtactccccca

SEQ ID NO: 18242 - DNA, 38 bp, Artificial Sequence
  Synthetic oligonucleotide
tctcccgcacccccaccagtaagcaaccatgtaccgca

SEQ ID NO: 18243 - DNA, 36 bp, Artificial Sequence
  Synthetic oligonucleotide
gagacactcccacaaggtttatccactctgacatca

SEQ ID NO: 18244 - DNA, 38 bp, Artificial Sequence
  Synthetic oligonucleotide
tcaacacactgttcccttagcataccggtcctccgtga

SEQ ID NO: 18245 - DNA, 36 bp, Artificial Sequence
  Synthetic oligonucleotide
aagcctgtcaggtcaatgttcttcccgcgccgccta

SEQ ID NO: 18246 - DNA, 35 bp, Artificial Sequence
  Synthetic oligonucleotide
atgtaccgctgccatccaacccacttagtatctac

SEQ ID NO: 18247 - DNA, 35 bp, Artificial Sequence
  Synthetic oligonucleotide
gatgtgcgctctactattccatgtccaccgcttgc

SEQ ID NO: 18248 - DNA, 35 bp, Artificial Sequence
  Synthetic oligonucleotide
tatcactgacggtaagctgtacttcgccgctttat

SEQ ID NO: 18249 - DNA, 35 bp, Artificial Sequence
  Synthetic oligonucleotide
agtacccgaccatttgttgtcctgttatgttacct

SEQ ID NO: 18250 - DNA, 36 bp, Artificial Sequence
  Synthetic oligonucleotide
gtgccaagcatcctcgtcccgaccatggaactccca

SEQ ID NO: 18251 - DNA, 35 bp, Artificial Sequence
  Synthetic oligonucleotide
aaccaaccgatgctgagggcctctttacatcttca

SEQ ID NO: 18252 - DNA, 37 bp, Artificial Sequence
  Synthetic oligonucleotide
tttacatcacgcctcacacctgccaacgtctcgcaga

SEQ ID NO: 18253 - DNA, 37 bp, Artificial Sequence
  Synthetic oligonucleotide
atttgcgcgtcacatctgccttttcctccgctctgga

SEQ ID NO: 18254 - DNA, 38 bp, Artificial Sequence
  Synthetic oligonucleotide
gcggagggaatgggaggggcggaactggagtcacttga

SEQ ID NO: 18255 - DNA, 35 bp, Artificial Sequence
  Synthetic oligonucleotide
atccctctgccctccttagtagcatgtgcactata

SEQ ID NO: 18256 - DNA, 35 bp, Artificial Sequence
  Synthetic oligonucleotide
actcgcctcggctgatcccctgctcaaccacccat

SEQ ID NO: 18257 - DNA, 35 bp, Artificial Sequence
  Synthetic oligonucleotide
ggagacgcccaccttctgccgtttgccattcattt

SEQ ID NO: 18258 - DNA, 36 bp, Artificial Sequence
  Synthetic oligonucleotide
aacgaccgagtcccctttatggcctgctctttctca

SEQ ID NO: 18259 - DNA, 36 bp, Artificial Sequence
  Synthetic oligonucleotide
tgcccttctccgcttgacgttgttaaaaccctctga

SEQ ID NO: 18260 - DNA, 37 bp, Artificial Sequence
  Synthetic oligonucleotide
gacacaccgtgacgtgcttgttatggccccttcttga

SEQ ID NO: 18261 - DNA, 35 bp, Artificial Sequence
  Synthetic oligonucleotide
atcacctggcgctctatcatagttggaacataact

SEQ ID NO: 18262 - DNA, 35 bp, Artificial Sequence
  Synthetic oligonucleotide
tccatgccggggcgcattcctctgccaatccaaat

SEQ ID NO: 18263 - DNA, 36 bp, Artificial Sequence
  Synthetic oligonucleotide
gagagcctcaccccatggtcttaatttccgtagtca

SEQ ID NO: 18264 - DNA, 37 bp, Artificial Sequence
  Synthetic oligonucleotide
tgtggggggggaaccaggggagtcgtaggggtacgga

SEQ ID NO: 18265 - DNA, 38 bp, Artificial Sequence
  Synthetic oligonucleotide
gtggcgtcggattcctttctgcacacactcccgcctga

SEQ ID NO: 18266 - DNA, 35 bp, Artificial Sequence
  Synthetic oligonucleotide
gacgagtgtgcccctgttttgcctatccatactac

SEQ ID NO: 18267 - DNA, 35 bp, Artificial Sequence
  Synthetic oligonucleotide
ttcacctcctacttgtgcccagccctcattatcgg

SEQ ID NO: 18268 - DNA, 35 bp, Artificial Sequence
  Synthetic oligonucleotide
tacaacgtagcgcctcaggttttctgttccgttct

SEQ ID NO: 18269 - DNA, 35 bp, Artificial Sequence
  Synthetic oligonucleotide
tccgccacaccattcggttttttgatgattttttt

SEQ ID NO: 18270 - DNA, 35 bp, Artificial Sequence
  Synthetic oligonucleotide
atgcaccgcccggtacatctccgccgctttttaaa

SEQ ID NO: 18271 - DNA, 38 bp, Artificial Sequence
  Synthetic oligonucleotide
tacgtcgccgttccgcataacctcttcgtgcctcctga

SEQ ID NO: 18272 - DNA, 36 bp, Artificial Sequence
  Synthetic oligonucleotide
tccaacccgacacacatcgtcctgttcaccacacta

SEQ ID NO: 18273 - DNA, 35 bp, Artificial Sequence
  Synthetic oligonucleotide
ggagaaccccgcaccctatatggctgcattaccac

SEQ ID NO: 18274 - DNA, 35 bp, Artificial Sequence
  Synthetic oligonucleotide
tgcttacccattatgttcccgccctgacagacccc

SEQ ID NO: 18275 - DNA, 35 bp, Artificial Sequence
  Synthetic oligonucleotide
atcaggagaaatagggcgagaggggaaaggcaacg

SEQ ID NO: 18276 - DNA, 36 bp, Artificial Sequence
  Synthetic oligonucleotide
gacgccgacagtgactatttccacctatccacagca

SEQ ID NO: 18277 - DNA, 36 bp, Artificial Sequence
  Synthetic oligonucleotide
agcgctgccactccggcctttatctcgcctcccgca

SEQ ID NO: 18278 - DNA, 37 bp, Artificial Sequence
  Synthetic oligonucleotide
gtctcaccaccacatgctttatatataagcctaccga

SEQ ID NO: 18279 - DNA, 38 bp, Artificial Sequence
  Synthetic oligonucleotide
tgcgacgttcaacggtactaacctcgcgtccctgctga

SEQ ID NO: 18280 - DNA, 35 bp, Artificial Sequence
  Synthetic oligonucleotide
ttagctcgcacgtctggcacactccatcataccat

SEQ ID NO: 18281 - DNA, 34 bp, Artificial Sequence
  Synthetic oligonucleotide
gacacgtcgccctcactgaaagtcccatgccatt

SEQ ID NO: 18282 - DNA, 35 bp, Artificial Sequence
  Synthetic oligonucleotide
acgtgagccagccccgctcgtcactcttctccgta

SEQ ID NO: 18283 - DNA, 35 bp, Artificial Sequence
  Synthetic oligonucleotide
actcattccagccccgcaggtacctctctccgagc

SEQ ID NO: 18284 - DNA, 35 bp, Artificial Sequence
  Synthetic oligonucleotide
gttgccgatgccatttcctcgcttgttgttttgtc

SEQ ID NO: 18285 - DNA, 35 bp, Artificial Sequence
  Synthetic oligonucleotide
tcacaccacatgacccgggccgcctcgatccgctg

SEQ ID NO: 18286 - DNA, 35 bp, Artificial Sequence
  Synthetic oligonucleotide
ttcgcttgcctctcatcatcgtccagcccatttat

SEQ ID NO: 18287 - DNA, 35 bp, Artificial Sequence
  Synthetic oligonucleotide
tgtaccctgtcggactgggcccacgactctactaa

SEQ ID NO: 18288 - DNA, 35 bp, Artificial Sequence
  Synthetic oligonucleotide
atgttccatgggcatttcgtctccctgtgatgcca

SEQ ID NO: 18289 - DNA, 35 bp, Artificial Sequence
  Synthetic oligonucleotide
gacaaccaagctccaccaatctgatacacgaggca

SEQ ID NO: 18290 - DNA, 35 bp, Artificial Sequence
  Synthetic oligonucleotide
atcaccgtgcgacaacccagtccccttgcttatca

SEQ ID NO: 18291 - DNA, 36 bp, Artificial Sequence
  Synthetic oligonucleotide
gagggggacgaccacgtatcatgcttgtttttttca

SEQ ID NO: 18292 - DNA, 33 bp, Artificial Sequence
  Synthetic oligonucleotide
gacaacgcgagatcccactttccaaccggccga

SEQ ID NO: 18293 - DNA, 37 bp, Artificial Sequence
  Synthetic oligonucleotide
gccacacagcccgccggttgaccagcccctcctctga

SEQ ID NO: 18294 - DNA, 37 bp, Artificial Sequence
  Synthetic oligonucleotide
gagggagtaggacggaggggagtaaggtgtgtggtga

SEQ ID NO: 18295 - DNA, 33 bp, Artificial Sequence
  Synthetic oligonucleotide
tcaccaccctgttcgcttgactacccacattta

SEQ ID NO: 18296 - DNA, 36 bp, Artificial Sequence
  Synthetic oligonucleotide
acgtgcgccagtgcttactgccgacttgaaccaccc

SEQ ID NO: 18297 - DNA, 35 bp, Artificial Sequence
  Synthetic oligonucleotide
tattcccattggatcctgtttagcgatactgtcgc

SEQ ID NO: 18298 - DNA, 35 bp, Artificial Sequence
  Synthetic oligonucleotide
gcccatcgcgccccctcgcgtcccgagtccgcttt

SEQ ID NO: 18299 - DNA, 37 bp, Artificial Sequence
  Synthetic oligonucleotide
gatgacctctcactagtgatacttaccctgtacttga

SEQ ID NO: 18300 - DNA, 36 bp, Artificial Sequence
  Synthetic oligonucleotide
ggaccacctctgcttaaatgccaccacttaggagta

SEQ ID NO: 18301 - DNA, 36 bp, Artificial Sequence
  Synthetic oligonucleotide
tttagcctgccactcccattagttgacctgaaatta

SEQ ID NO: 18302 - DNA, 35 bp, Artificial Sequence
  Synthetic oligonucleotide
taagtgagggaacgataggccgggggaagatcaag

SEQ ID NO: 18303 - DNA, 35 bp, Artificial Sequence
  Synthetic oligonucleotide
tgcccatggtggagttctatcgcgttatgtcttct

SEQ ID NO: 18304 - DNA, 37 bp, Artificial Sequence
  Synthetic oligonucleotide
gcatccttccctgtcgttcggaccgctatattcctga

SEQ ID NO: 18305 - DNA, 38 bp, Artificial Sequence
  Synthetic oligonucleotide
gtcacgggcatgtaggggtcggggagaatggtgcgtga

SEQ ID NO: 18306 - DNA, 35 bp, Artificial Sequence
  Synthetic oligonucleotide
ccgacgtagacttagccctgccaacctcaaaaagc

SEQ ID NO: 18307 - DNA, 35 bp, Artificial Sequence
  Synthetic oligonucleotide
gcccatctaagttcccccacgcccgccttctacgc

SEQ ID NO: 18308 - DNA, 35 bp, Artificial Sequence
  Synthetic oligonucleotide
gcactccgcagccgatcctcctcatgcgcctttgg

SEQ ID NO: 18309 - DNA, 35 bp, Artificial Sequence
  Synthetic oligonucleotide
gtgtgggggtgggagttgcgaagcaggaggggcct

SEQ ID NO: 18310 - DNA, 33 bp, Artificial Sequence
  Synthetic oligonucleotide
ttcccccccggtttgtgccccaaagccatacga

SEQ ID NO: 18311 - DNA, 37 bp, Artificial Sequence
  Synthetic oligonucleotide
gtacgccactatttgcctcccatctagtcacgcctga

SEQ ID NO: 18312 - DNA, 38 bp, Artificial Sequence
  Synthetic oligonucleotide
tcctaacgccggttactcgcctccgcgcactctattga

SEQ ID NO: 18313 - DNA, 35 bp, Artificial Sequence
  Synthetic oligonucleotide
gacacaggttcgcagcacaataccgtcacacactc

SEQ ID NO: 18314 - DNA, 35 bp, Artificial Sequence
  Synthetic oligonucleotide
gtacccttcacactgtcccaggcaatctagccccg

SEQ ID NO: 18315 - DNA, 36 bp, Artificial Sequence
  Synthetic oligonucleotide
ttactactgccacaatcctgatccccggccaacaca

SEQ ID NO: 18316 - DNA, 38 bp, Artificial Sequence
  Synthetic oligonucleotide
attgagccctcaccgttccttcctgccaatgccattga

SEQ ID NO: 18317 - DNA, 35 bp, Artificial Sequence
  Synthetic oligonucleotide
gtacgctcggctgaccattcgcacaactcatatac

SEQ ID NO: 18318 - DNA, 35 bp, Artificial Sequence
  Synthetic oligonucleotide
gctgctcccggcatcctgaccgacggcccctttac

SEQ ID NO: 18319 - DNA, 35 bp, Artificial Sequence
  Synthetic oligonucleotide
gcactcgtacacaccaccgcctaccctagtctaag

SEQ ID NO: 18320 - DNA, 35 bp, Artificial Sequence
  Synthetic oligonucleotide
tctaacaccgcgttacatcccccaagctccctggt

SEQ ID NO: 18321 - DNA, 35 bp, Artificial Sequence
  Synthetic oligonucleotide
aatgactgcgagctgcggtccatccaaattacctt

SEQ ID NO: 18322 - DNA, 35 bp, Artificial Sequence
  Synthetic oligonucleotide
tcgtggctcgtgtcctgtatttacctcccctgctt

SEQ ID NO: 18323 - DNA, 35 bp, Artificial Sequence
  Synthetic oligonucleotide
gtggtcccgatcgcacattccttcccacgttgaaa

SEQ ID NO: 18324 - DNA, 35 bp, Artificial Sequence
  Synthetic oligonucleotide
gattaggcctccgagcgtttaggccacctttcaca

SEQ ID NO: 18325 - DNA, 35 bp, Artificial Sequence
  Synthetic oligonucleotide
gatacctggtttatcgtgaatggttgcctaccccc

SEQ ID NO: 18326 - DNA, 35 bp, Artificial Sequence
  Synthetic oligonucleotide
tcttccgaacaccctgttactgccctgtgactatc

SEQ ID NO: 18327 - DNA, 35 bp, Artificial Sequence
  Synthetic oligonucleotide
taacgtcccccgcaagcttttgggtttttcttatt

SEQ ID NO: 18328 - DNA, 35 bp, Artificial Sequence
  Synthetic oligonucleotide
tcgagtgcccctttgttccaagtcgccccccttag

SEQ ID NO: 18329 - DNA, 35 bp, Artificial Sequence
  Synthetic oligonucleotide
tccaagtccagccctcctccccacgcgatgattcg

SEQ ID NO: 18330 - DNA, 35 bp, Artificial Sequence
  Synthetic oligonucleotide
acacatccctaggtctagttacccgctgttatcca

SEQ ID NO: 18331 - DNA, 38 bp, Artificial Sequence
  Synthetic oligonucleotide
gaccaccaacacacctccgaaagcactctgtcccgtga

SEQ ID NO: 18332 - DNA, 35 bp, Artificial Sequence
  Synthetic oligonucleotide
tgatagagccaatcctcgttagacccaacccgtcc

SEQ ID NO: 18333 - DNA, 35 bp, Artificial Sequence
  Synthetic oligonucleotide
gcacagggcctcgcatctatttagcgctttcaatc

SEQ ID NO: 18334 - DNA, 35 bp, Artificial Sequence
  Synthetic oligonucleotide
gcaagagctagcacatgcctgccaacttctgcctc

SEQ ID NO: 18335 - DNA, 35 bp, Artificial Sequence
  Synthetic oligonucleotide
gacaagatccatagcacccctccacccatgcccgt

SEQ ID NO: 18336 - DNA, 38 bp, Artificial Sequence
  Synthetic oligonucleotide
tcaataccgcctccgttgcaaagaccatccctgcctga

SEQ ID NO: 18337 - DNA, 35 bp, Artificial Sequence
  Synthetic oligonucleotide
ttgctacacctgtgagtgcgaacaaaatgcctacc

SEQ ID NO: 18338 - DNA, 35 bp, Artificial Sequence
  Synthetic oligonucleotide
tgagcatgcaacgctgctacctatgtcccactctg

SEQ ID NO: 18339 - DNA, 35 bp, Artificial Sequence
  Synthetic oligonucleotide
tatccgtgttacggatccgctgccctgcctctcct

SEQ ID NO: 18340 - DNA, 35 bp, Artificial Sequence
  Synthetic oligonucleotide
tacgatttccctgccgtgctccttcattcgggtct

SEQ ID NO: 18341 - DNA, 36 bp, Artificial Sequence
  Synthetic oligonucleotide
atcatgactcccggcctcgctgttaacaccacccaa

SEQ ID NO: 18342 - DNA, 37 bp, Artificial Sequence
  Synthetic oligonucleotide
cacccgatgcgcccccgatgtcttcaccccctcccga

SEQ ID NO: 18343 - DNA, 36 bp, Artificial Sequence
  Synthetic oligonucleotide
gctaccacctcgacgcgcacttaatgccatggctta

SEQ ID NO: 18344 - DNA, 35 bp, Artificial Sequence
  Synthetic oligonucleotide
gtcactatccaatgtgtgtgtgtttctgtatatcc

SEQ ID NO: 18345 - DNA, 35 bp, Artificial Sequence
  Synthetic oligonucleotide
gcattccttcgccgacatcgttccagcattctttg

SEQ ID NO: 18346 - DNA, 35 bp, Artificial Sequence
  Synthetic oligonucleotide
ggtcacaaccgcgtgataccgcacactcctttacg

SEQ ID NO: 18347 - DNA, 35 bp, Artificial Sequence
  Synthetic oligonucleotide
atgcggataccggctgcctctctacccacgtacat

SEQ ID NO: 18348 - DNA, 35 bp, Artificial Sequence
  Synthetic oligonucleotide
aaatggaggggtggcaaggggacattgaatgggat

SEQ ID NO: 18349 - DNA, 35 bp, Artificial Sequence
  Synthetic oligonucleotide
atgctgcgcactgtcctctgccttatctgatattt

SEQ ID NO: 18350 - DNA, 35 bp, Artificial Sequence
  Synthetic oligonucleotide
tgtacaacaccctactctgccgcactcgccgcgca

SEQ ID NO: 18351 - DNA, 36 bp, Artificial Sequence
  Synthetic oligonucleotide
gacactatcgccccccaccatcacaagcgcctgtca

SEQ ID NO: 18352 - DNA, 37 bp, Artificial Sequence
  Synthetic oligonucleotide
tagagggcgacccgagggggaagggaggggaaattga

SEQ ID NO: 18353 - DNA, 35 bp, Artificial Sequence
  Synthetic oligonucleotide
tgagagcctgttccggaagcgatctctctcttctc

SEQ ID NO: 18354 - DNA, 35 bp, Artificial Sequence
  Synthetic oligonucleotide
tggaccgcactatcccgttcttctactccctgtag

SEQ ID NO: 18355 - DNA, 35 bp, Artificial Sequence
  Synthetic oligonucleotide
ttccatctgcgagttctcagtcgccctgttcgttt

SEQ ID NO: 18356 - DNA, 36 bp, Artificial Sequence
  Synthetic oligonucleotide
acacgcgcgtgctaactcctcaatatgtacccgtca

SEQ ID NO: 18357 - DNA, 37 bp, Artificial Sequence
  Synthetic oligonucleotide
aacagagcgaggactagcaaaacatgggaagtggaga

SEQ ID NO: 18358 - DNA, 35 bp, Artificial Sequence
  Synthetic oligonucleotide
acgcagacagccgtaaggccacttgttccctgtta

SEQ ID NO: 18359 - DNA, 35 bp, Artificial Sequence
  Synthetic oligonucleotide
taacaactaccgcctactgtcctcgggctatctac

SEQ ID NO: 18360 - DNA, 35 bp, Artificial Sequence
  Synthetic oligonucleotide
ggggggggggaggggcatacaagtcatagaggggg

SEQ ID NO: 18361 - DNA, 35 bp, Artificial Sequence
  Synthetic oligonucleotide
gtactgagtggaatagcggattgggggcaggagtt

SEQ ID NO: 18362 - DNA, 37 bp, Artificial Sequence
  Synthetic oligonucleotide
attggcaccgcacctccagttcatacgccctccgaga

SEQ ID NO: 18363 - DNA, 37 bp, Artificial Sequence
  Synthetic oligonucleotide
tgaacatgggttggggctgagggtgggcggggaacga

SEQ ID NO: 18364 - DNA, 36 bp, Artificial Sequence
  Synthetic oligonucleotide
atcccaaacccccacatcagttggcctcctttagga

SEQ ID NO: 18365 - DNA, 38 bp, Artificial Sequence
  Synthetic oligonucleotide
gatccacgcccacattttctgcaagacgcgtttcctga

SEQ ID NO: 18366 - DNA, 35 bp, Artificial Sequence
  Synthetic oligonucleotide
atgtcaaccatcattgtctcctcgcataccagttt

SEQ ID NO: 18367 - DNA, 37 bp, Artificial Sequence
  Synthetic oligonucleotide
tgtccaacgcaacaacactcgcccacacgccttggga

SEQ ID NO: 18368 - DNA, 35 bp, Artificial Sequence
  Synthetic oligonucleotide
tgaactcagctcctcctcgtccagcagccattctc

SEQ ID NO: 18369 - DNA, 35 bp, Artificial Sequence
  Synthetic oligonucleotide
gccggactggttcactacgcccctatctttttacg

SEQ ID NO: 18370 - DNA, 36 bp, Artificial Sequence
  Synthetic oligonucleotide
acgagtgggtgttggaatgcaattgggagggagaca

SEQ ID NO: 18371 - DNA, 36 bp, Artificial Sequence
  Synthetic oligonucleotide
atactaccggtccaccacttcccgcctttgagacca

SEQ ID NO: 18372 - DNA, 37 bp, Artificial Sequence
  Synthetic oligonucleotide
gcaaaggcaatggccaaggggtggggtgaaaaatgga

SEQ ID NO: 18373 - DNA, 37 bp, Artificial Sequence
  Synthetic oligonucleotide
gccgtcgcccgccgttcactcgagttcttatcatgga

SEQ ID NO: 18374 - DNA, 38 bp, Artificial Sequence
  Synthetic oligonucleotide
gcatcacgcacgaattctgagcatctcctgcaacctga

SEQ ID NO: 18375 - DNA, 35 bp, Artificial Sequence
  Synthetic oligonucleotide
tagtgcggacaccatccgctcaaaactcccttacc

SEQ ID NO: 18376 - DNA, 35 bp, Artificial Sequence
  Synthetic oligonucleotide
tccaccgcactgtgaagccttcaccatacaccgcc

SEQ ID NO: 18377 - DNA, 35 bp, Artificial Sequence
  Synthetic oligonucleotide
tgcacctatccatgcgtgctgttcactagtttggt

SEQ ID NO: 18378 - DNA, 37 bp, Artificial Sequence
  Synthetic oligonucleotide
tcatcgctctgccgaccagccccggactcgggccgca

SEQ ID NO: 18379 - DNA, 35 bp, Artificial Sequence
  Synthetic oligonucleotide
attgccacgatttgcgccccctccggtccgtacgc

SEQ ID NO: 18380 - DNA, 35 bp, Artificial Sequence
  Synthetic oligonucleotide
gaacgagcggaggcattaagggcaagtaggagagg

SEQ ID NO: 18381 - DNA, 36 bp, Artificial Sequence
  Synthetic oligonucleotide
ttgctcacctatcgcacattaggcctaaccttgcca

SEQ ID NO: 18382 - DNA, 36 bp, Artificial Sequence
  Synthetic oligonucleotide
gaccagccagcgccgccccctccacaccgagctcga

SEQ ID NO: 18383 - DNA, 37 bp, Artificial Sequence
  Synthetic oligonucleotide
tgcccctctctatgcaatctccccctgagcacaggga

SEQ ID NO: 18384 - DNA, 38 bp, Artificial Sequence
  Synthetic oligonucleotide
gtccaggccccgttccgttgcacccctcttttagttga

SEQ ID NO: 18385 - DNA, 35 bp, Artificial Sequence
  Synthetic oligonucleotide
aacccgatcgcttgcctcacgcctcacggatatta

SEQ ID NO: 18386 - DNA, 35 bp, Artificial Sequence
  Synthetic oligonucleotide
tcacgatcatgcaccctgtcgttgcccccgtccgc

SEQ ID NO: 18387 - DNA, 35 bp, Artificial Sequence
  Synthetic oligonucleotide
aacctcatcggccgtcaaatcttgcactcccatgg

SEQ ID NO: 18388 - DNA, 35 bp, Artificial Sequence
  Synthetic oligonucleotide
accatcctgtgatctgaactggtcaatcgccctaa

SEQ ID NO: 18389 - DNA, 36 bp, Artificial Sequence
  Synthetic oligonucleotide
tgccttcgccctccgttcatatggtcactgatgtta

SEQ ID NO: 18390 - DNA, 35 bp, Artificial Sequence
  Synthetic oligonucleotide
ggatgggcgaagggtagtggggacggcaggcttta

SEQ ID NO: 18391 - DNA, 35 bp, Artificial Sequence
  Synthetic oligonucleotide
tcaccaagcctgtaatctgccttcccttcggacac

SEQ ID NO: 18392 - DNA, 35 bp, Artificial Sequence
  Synthetic oligonucleotide
accgcctccggaatactgtccttcgcctcgaaatc

SEQ ID NO: 18393 - DNA, 35 bp, Artificial Sequence
  Synthetic oligonucleotide
acttgcacactctgcacttgatggcttgtcttctc

SEQ ID NO: 18394 - DNA, 35 bp, Artificial Sequence
  Synthetic oligonucleotide
gcacccccttatcaccagctccgaccgttgcttcg

SEQ ID NO: 18395 - DNA, 35 bp, Artificial Sequence
  Synthetic oligonucleotide
agcacgccacaggttattttatgtcttactcctct

SEQ ID NO: 18396 - DNA, 34 bp, Artificial Sequence
  Synthetic oligonucleotide
atcgggcgcaccttgcttgaagtgccctcctcaa

SEQ ID NO: 18397 - DNA, 36 bp, Artificial Sequence
  Synthetic oligonucleotide
acaccaccagtcgcgaactacctccagcgagacgca

SEQ ID NO: 18398 - DNA, 37 bp, Artificial Sequence
  Synthetic oligonucleotide
gcgcgagggaatggcgtgggaggcgggaggaaactga

SEQ ID NO: 18399 - DNA, 37 bp, Artificial Sequence
  Synthetic oligonucleotide
tacccctgcacctctgcactccacgatcgccccgtga

SEQ ID NO: 18400 - DNA, 36 bp, Artificial Sequence
  Synthetic oligonucleotide
tgcccaactgccgcatacttcacacagtactgccta

SEQ ID NO: 18401 - DNA, 35 bp, Artificial Sequence
  Synthetic oligonucleotide
tgagagtaccaccctatgcacaatccgtcctggcc

SEQ ID NO: 18402 - DNA, 35 bp, Artificial Sequence
  Synthetic oligonucleotide
aatgcctcgcttatcacacgtagtcatcttatgcc

SEQ ID NO: 18403 - DNA, 35 bp, Artificial Sequence
  Synthetic oligonucleotide
agtcaacgagtgttgcccgccccccttacgctctc

SEQ ID NO: 18404 - DNA, 35 bp, Artificial Sequence
  Synthetic oligonucleotide
ttgcgcctctaccgtgcctttaacgtccctggtat

SEQ ID NO: 18405 - DNA, 35 bp, Artificial Sequence
  Synthetic oligonucleotide
gacgtgtgggcacggtctgggaaattggagtgggt

SEQ ID NO: 18406 - DNA, 35 bp, Artificial Sequence
  Synthetic oligonucleotide
tgaccatcaagcccgccccttacacgtgaactgcg

SEQ ID NO: 18407 - DNA, 35 bp, Artificial Sequence
  Synthetic oligonucleotide
tgcatggcataacagcccgcccactgtcttcatcg

SEQ ID NO: 18408 - DNA, 35 bp, Artificial Sequence
  Synthetic oligonucleotide
gcccatcgacacgtgcgagtttctccgtccatcgt

SEQ ID NO: 18409 - DNA, 37 bp, Artificial Sequence
  Synthetic oligonucleotide
atgtccacccatgttagtccaataccttcccctcgga

SEQ ID NO: 18410 - DNA, 36 bp, Artificial Sequence
  Synthetic oligonucleotide
gatgcgccccgaccgcaccaccagactaccgaagta

SEQ ID NO: 18411 - DNA, 35 bp, Artificial Sequence
  Synthetic oligonucleotide
tccatcccggttcttagacgccgtccaccgctgac

SEQ ID NO: 18412 - DNA, 35 bp, Artificial Sequence
  Synthetic oligonucleotide
tttccacccccgttagggatttatcaagtattccc

SEQ ID NO: 18413 - DNA, 35 bp, Artificial Sequence
  Synthetic oligonucleotide
gccgaagctattcagtgcccatccgctgcccgatc

SEQ ID NO: 18414 - DNA, 35 bp, Artificial Sequence
  Synthetic oligonucleotide
gctatccggagcgccattcgacttatccttcccag

SEQ ID NO: 18415 - DNA, 35 bp, Artificial Sequence
  Synthetic oligonucleotide
ggaggacgaagggccgaaaggggaggcaatgtgcg

SEQ ID NO: 18416 - DNA, 35 bp, Artificial Sequence
  Synthetic oligonucleotide
actgccgaccaatgagtctccccttcctgacttgg

SEQ ID NO: 18417 - DNA, 35 bp, Artificial Sequence
  Synthetic oligonucleotide
gacgctctcgacgccatgacccgtgccctttgtat

SEQ ID NO: 18418 - DNA, 37 bp, Artificial Sequence
  Synthetic oligonucleotide
gttgcacacatccgctataacccatattctgttacga

SEQ ID NO: 18419 - DNA, 35 bp, Artificial Sequence
  Synthetic oligonucleotide
tcaacacgaatcccatccgccgcttccttaccagg

SEQ ID NO: 18420 - DNA, 35 bp, Artificial Sequence
  Synthetic oligonucleotide
tacgttgaacaccccaagcccgcctgcgatcccat

SEQ ID NO: 18421 - DNA, 37 bp, Artificial Sequence
  Synthetic oligonucleotide
actgtgggtggaaggcgtggtgggaggatttcatgga

SEQ ID NO: 18422 - DNA, 37 bp, Artificial Sequence
  Synthetic oligonucleotide
gacacgctacttctgcctccctgtctcccgaccatga

SEQ ID NO: 18423 - DNA, 38 bp, Artificial Sequence
  Synthetic oligonucleotide
gagccccgtcgagcgcgtaattcaccttctttgcttga

SEQ ID NO: 18424 - DNA, 36 bp, Artificial Sequence
  Synthetic oligonucleotide
gccttcccccagtctgtttcatgcgcatgtctacaa

SEQ ID NO: 18425 - DNA, 37 bp, Artificial Sequence
  Synthetic oligonucleotide
aatggtccgcactccgccgcaatgctcctgtaaccga

SEQ ID NO: 18426 - DNA, 38 bp, Artificial Sequence
  Synthetic oligonucleotide
aatgaacccgccctgcatcctcttgcctcactacgtga

SEQ ID NO: 18427 - DNA, 37 bp, Artificial Sequence
  Synthetic oligonucleotide
atcaggtgcgattgggtggggcgggtaggggtcgaga

SEQ ID NO: 18428 - DNA, 35 bp, Artificial Sequence
  Synthetic oligonucleotide
ggtggcaaccacgtattcactcgaacatactcgcc

SEQ ID NO: 18429 - DNA, 35 bp, Artificial Sequence
  Synthetic oligonucleotide
agcgaagcccacgtatccccgcatatatcgcttcc

SEQ ID NO: 18430 - DNA, 35 bp, Artificial Sequence
  Synthetic oligonucleotide
tcaccatccccttgaccagagttattttcctgtgc

SEQ ID NO: 18431 - DNA, 35 bp, Artificial Sequence
  Synthetic oligonucleotide
gcaagcgctgataagtcccttccccctatctgtgg

SEQ ID NO: 18432 - DNA, 35 bp, Artificial Sequence
  Synthetic oligonucleotide
tccaacttcccccgtgacgggtttttgaccgacct

SEQ ID NO: 18433 - DNA, 36 bp, Artificial Sequence
  Synthetic oligonucleotide
gtcgccgtccaacaccatgtcataacgcctcatgaa

SEQ ID NO: 18434 - DNA, 37 bp, Artificial Sequence
  Synthetic oligonucleotide
atgtcctcgctcggccccaatgaaccatctcaccgga

SEQ ID NO: 18435 - DNA, 38 bp, Artificial Sequence
  Synthetic oligonucleotide
gtacccgcccagcatatgccgacgtactgttgccctga

SEQ ID NO: 18436 - DNA, 38 bp, Artificial Sequence
  Synthetic oligonucleotide
acacgtcgcccccttctccatgtaccagccacgtgtga

SEQ ID NO: 18437 - DNA, 35 bp, Artificial Sequence
  Synthetic oligonucleotide
agtgcaccctggcccgcccatacctgatcacctct

SEQ ID NO: 18438 - DNA, 34 bp, Artificial Sequence
  Synthetic oligonucleotide
ttgccatctatgtcgcttctaatcacaccaactt

SEQ ID NO: 18439 - DNA, 35 bp, Artificial Sequence
  Synthetic oligonucleotide
gtatcacccgcctgacccatttttctttaatgtaa

SEQ ID NO: 18440 - DNA, 31 bp, Artificial Sequence
  Synthetic oligonucleotide
ttcccgccccggtccgcctgttctcatccca

SEQ ID NO: 18441 - DNA, 37 bp, Artificial Sequence
  Synthetic oligonucleotide
gaagggggaagagatggtggatgtatgtggtgtgaga

SEQ ID NO: 18442 - DNA, 38 bp, Artificial Sequence
  Synthetic oligonucleotide
gtggaccgctgcattgactagctacaccccgcttttga

SEQ ID NO: 18443 - DNA, 35 bp, Artificial Sequence
  Synthetic oligonucleotide
atacatagtcagagcacccaaacctcttcttccac

SEQ ID NO: 18444 - DNA, 37 bp, Artificial Sequence
  Synthetic oligonucleotide
acatgtgttgtatgtggtgccggtgtggtgggtggga

SEQ ID NO: 18445 - DNA, 38 bp, Artificial Sequence
  Synthetic oligonucleotide
tgttcgccacctcactcctatccaagtctgctagctga

SEQ ID NO: 18446 - DNA, 35 bp, Artificial Sequence
  Synthetic oligonucleotide
atcgtaccccgcccagtggtgctacactttaccgc

SEQ ID NO: 18447 - DNA, 36 bp, Artificial Sequence
  Synthetic oligonucleotide
gggaacaaacgccccccttgtgcaaatgccccccca

SEQ ID NO: 18448 - DNA, 36 bp, Artificial Sequence
  Synthetic oligonucleotide
gcatagcacggctagtcgacgcctacatctccatta

SEQ ID NO: 18449 - DNA, 35 bp, Artificial Sequence
  Synthetic oligonucleotide
agctgagccacgcgggtcgcccactggtcttctct

SEQ ID NO: 18450 - DNA, 37 bp, Artificial Sequence
  Synthetic oligonucleotide
ggtaggtgcggaacggcgggggggaggcgctggttga

SEQ ID NO: 18451 - DNA, 35 bp, Artificial Sequence
  Synthetic oligonucleotide
acctgcccaccaagtacgtccttcgttaaacttac

SEQ ID NO: 18452 - DNA, 35 bp, Artificial Sequence
  Synthetic oligonucleotide
tacgggcgcactctatccctgccagctacttgtcc

SEQ ID NO: 18453 - DNA, 35 bp, Artificial Sequence
  Synthetic oligonucleotide
aactgcaggacccggagggcatgggacggggaggc

SEQ ID NO: 18454 - DNA, 35 bp, Artificial Sequence
  Synthetic oligonucleotide
tacaggcactcgttttgctacccatctcgctcttt

SEQ ID NO: 18455 - DNA, 36 bp, Artificial Sequence
  Synthetic oligonucleotide
tgacggaggtgggaggagctggagccggggaaacca

SEQ ID NO: 18456 - DNA, 37 bp, Artificial Sequence
  Synthetic oligonucleotide
tagaccggccctcgcccgccttcctatgtccgacgga

SEQ ID NO: 18457 - DNA, 36 bp, Artificial Sequence
  Synthetic oligonucleotide
aagacagacacacgcgcctaatcacgcttccacgac

SEQ ID NO: 18458 - DNA, 35 bp, Artificial Sequence
  Synthetic oligonucleotide
atacccaatcgccgccagtgtccgtcatgccgttc

SEQ ID NO: 18459 - DNA, 35 bp, Artificial Sequence
  Synthetic oligonucleotide
tccacagcataactttgcttccacatctcctgttg

SEQ ID NO: 18460 - DNA, 36 bp, Artificial Sequence
  Synthetic oligonucleotide
gccacgacccggatcatcgccactttacgcccaaaa

SEQ ID NO: 18461 - DNA, 35 bp, Artificial Sequence
  Synthetic oligonucleotide
tcaacctaccatgtcgccccgtcctcgctaatcca

SEQ ID NO: 18462 - DNA, 37 bp, Artificial Sequence
  Synthetic oligonucleotide
gatcacctgcagatactgatcacgcactatctaacga

SEQ ID NO: 18463 - DNA, 37 bp, Artificial Sequence
  Synthetic oligonucleotide
tccttgcccctcatattctgaattagcccattggcga

SEQ ID NO: 18464 - DNA, 36 bp, Artificial Sequence
  Synthetic oligonucleotide
gtggtaggtggacggggcaaaattcaggaggtggga

SEQ ID NO: 18465 - DNA, 38 bp, Artificial Sequence
  Synthetic oligonucleotide
gtgacaagcacaaggaaagggcatgaaggatatcgtga

SEQ ID NO: 18466 - DNA, 38 bp, Artificial Sequence
  Synthetic oligonucleotide
tgagtgctgcagtctgtaagtaggggggatcgaggtga

SEQ ID NO: 18467 - DNA, 36 bp, Artificial Sequence
  Synthetic oligonucleotide
gtggccctcacatgaaccgaacaccgcgacccacta

SEQ ID NO: 18468 - DNA, 35 bp, Artificial Sequence
  Synthetic oligonucleotide
gcatcactaccgcggttcaggcgacccttcacccc

SEQ ID NO: 18469 - DNA, 35 bp, Artificial Sequence
  Synthetic oligonucleotide
ttcgctgtatgacctcggcatcctttcccaccttg

SEQ ID NO: 18470 - DNA, 35 bp, Artificial Sequence
  Synthetic oligonucleotide
tgtctgcgtacctaccgctccaccctcggtttcct

SEQ ID NO: 18471 - DNA, 35 bp, Artificial Sequence
  Synthetic oligonucleotide
gccctatcagcccaatggcccaagctctcacatct

SEQ ID NO: 18472 - DNA, 36 bp, Artificial Sequence
  Synthetic oligonucleotide
tacgtggcctccactcgtatgtattcacctttatct

SEQ ID NO: 18473 - DNA, 35 bp, Artificial Sequence
  Synthetic oligonucleotide
gtcgaataacctccattctgtatggcgcccacctt

SEQ ID NO: 18474 - DNA, 36 bp, Artificial Sequence
  Synthetic oligonucleotide
atccgcccacatgtcttcgactttgtatttatgcca

SEQ ID NO: 18475 - DNA, 35 bp, Artificial Sequence
  Synthetic oligonucleotide
aacatccaggcggactgctcccgtgcccgtgatca

SEQ ID NO: 18476 - DNA, 37 bp, Artificial Sequence
  Synthetic oligonucleotide
aacagccacgcccttgtgctccggccctcactcgaga

SEQ ID NO: 18477 - DNA, 37 bp, Artificial Sequence
  Synthetic oligonucleotide
gatgaccgcccgaacctttacggtgacacacaattga

SEQ ID NO: 18478 - DNA, 35 bp, Artificial Sequence
  Synthetic oligonucleotide
accccaccgcatgaccgatcggactgagggtcaac

SEQ ID NO: 18479 - DNA, 35 bp, Artificial Sequence
  Synthetic oligonucleotide
tcccaacggggtttctccgaccctatatgtccctc

SEQ ID NO: 18480 - DNA, 35 bp, Artificial Sequence
  Synthetic oligonucleotide
tgatgctcccgcctgtcacccgttgcatgttggtc

SEQ ID NO: 18481 - DNA, 35 bp, Artificial Sequence
  Synthetic oligonucleotide
tgtaaagggggagaaggagaagtgaggcgctagag

SEQ ID NO: 18482 - DNA, 35 bp, Artificial Sequence
  Synthetic oligonucleotide
agaccccaccgattggcctgcctgcaaaacagtct

SEQ ID NO: 18483 - DNA, 36 bp, Artificial Sequence
  Synthetic oligonucleotide
tcagcgcgcgaccgaccccccgtattcccaccatga

SEQ ID NO: 18484 - DNA, 36 bp, Artificial Sequence
  Synthetic oligonucleotide
gtcaacgcctggcctatattacccggtggcttccta

SEQ ID NO: 18485 - DNA, 36 bp, Artificial Sequence
  Synthetic oligonucleotide
gccggtctcgggggcacacacacaacacggagagta

SEQ ID NO: 18486 - DNA, 35 bp, Artificial Sequence
  Synthetic oligonucleotide
gcgaccccgcccacacccgttacatcaactgttag

SEQ ID NO: 18487 - DNA, 35 bp, Artificial Sequence
  Synthetic oligonucleotide
tgcactgatcgcatgactttaccgcacctagtgat

SEQ ID NO: 18488 - DNA, 36 bp, Artificial Sequence
  Synthetic oligonucleotide
gccacacccggactcctgcgtctatagtacgcctaa

SEQ ID NO: 18489 - DNA, 36 bp, Artificial Sequence
  Synthetic oligonucleotide
tactcgtctacccccactgttgccctcacatgcgca

SEQ ID NO: 18490 - DNA, 37 bp, Artificial Sequence
  Synthetic oligonucleotide
tgtgggctggctcgtgtggggttctggaaggggggga

SEQ ID NO: 18491 - DNA, 35 bp, Artificial Sequence
  Synthetic oligonucleotide
tcatcacatacgatcgttatcgagcttccctacta

SEQ ID NO: 18492 - DNA, 36 bp, Artificial Sequence
  Synthetic oligonucleotide
tcaccacccggagagccacctgagacacgaaggcaa

SEQ ID NO: 18493 - DNA, 37 bp, Artificial Sequence
  Synthetic oligonucleotide
tccagggcgagagggagcgcaggggagggtgggagga

SEQ ID NO: 18494 - DNA, 35 bp, Artificial Sequence
  Synthetic oligonucleotide
tcatgatcccgcttgcactgactgggctttcctct

SEQ ID NO: 18495 - DNA, 35 bp, Artificial Sequence
  Synthetic oligonucleotide
gcaaaaaaacgaagggtgcaatggggagtggtagt

SEQ ID NO: 18496 - DNA, 35 bp, Artificial Sequence
  Synthetic oligonucleotide
gtcccccccgagttcgttgcctgtgtccacgccga

SEQ ID NO: 18497 - DNA, 35 bp, Artificial Sequence
  Synthetic oligonucleotide
actatccctgcaccaacgtcgtttcggagaaatga

SEQ ID NO: 18498 - DNA, 38 bp, Artificial Sequence
  Synthetic oligonucleotide
atcctcatcgcctgttatcgccttccatctgaccatga

SEQ ID NO: 18499 - DNA, 38 bp, Artificial Sequence
  Synthetic oligonucleotide
gcacgttcggaccttctcctagcagctgctactcttga

SEQ ID NO: 18500 - DNA, 36 bp, Artificial Sequence
  Synthetic oligonucleotide
tgttgcgccccgtctccctggcatgcaatttcccca

SEQ ID NO: 18501 - DNA, 37 bp, Artificial Sequence
  Synthetic oligonucleotide
tacaacccccacacagtacatgcgtactccctcggga

SEQ ID NO: 18502 - DNA, 37 bp, Artificial Sequence
  Synthetic oligonucleotide
gggaatgggagtggtggttgagaggtggggctagtga

SEQ ID NO: 18503 - DNA, 37 bp, Artificial Sequence
  Synthetic oligonucleotide
gtgcccaacccgcatcctgttcgtacttcactggtga

SEQ ID NO: 18504 - DNA, 35 bp, Artificial Sequence
  Synthetic oligonucleotide
gctcctgtacgtactatcttatgcgccgaccctta

SEQ ID NO: 18505 - DNA, 35 bp, Artificial Sequence
  Synthetic oligonucleotide
gccttagctcgtcgcctcccgttctggtaaatccc

SEQ ID NO: 18506 - DNA, 35 bp, Artificial Sequence
  Synthetic oligonucleotide
gcgtaaacctgcagtcccctgtattctgtcctctc

SEQ ID NO: 18507 - DNA, 35 bp, Artificial Sequence
  Synthetic oligonucleotide
gccccactctcgttactctgcactgacggccaagg

SEQ ID NO: 18508 - DNA, 37 bp, Artificial Sequence
  Synthetic oligonucleotide
ggaagggggaagggggggctatgggacgtagacgcga

SEQ ID NO: 18509 - DNA, 37 bp, Artificial Sequence
  Synthetic oligonucleotide
tgaaagggggataaggcggtagggggagcaagacgga

SEQ ID NO: 18510 - DNA, 36 bp, Artificial Sequence
  Synthetic oligonucleotide
gcgacaagcagtttttgccccggtgtctccgtcctc

SEQ ID NO: 18511 - DNA, 35 bp, Artificial Sequence
  Synthetic oligonucleotide
tccacgcccaaagttctacgacaccttcacaacgt

SEQ ID NO: 18512 - DNA, 36 bp, Artificial Sequence
  Synthetic oligonucleotide
gatcagccaccgtcccaagtcgaccgacacccgcaa

SEQ ID NO: 18513 - DNA, 36 bp, Artificial Sequence
  Synthetic oligonucleotide
gcattgcctcctcggccggacactcgcttactgcca

SEQ ID NO: 18514 - DNA, 36 bp, Artificial Sequence
  Synthetic oligonucleotide
accgcacacacttttagtgacccgacgcccttttca

SEQ ID NO: 18515 - DNA, 37 bp, Artificial Sequence
  Synthetic oligonucleotide
acccatgcgccagactgccgaaactctctcaccccga

SEQ ID NO: 18516 - DNA, 37 bp, Artificial Sequence
  Synthetic oligonucleotide
ttggtgggggaggacggaaggccggagggtcttggga

SEQ ID NO: 18517 - DNA, 34 bp, Artificial Sequence
  Synthetic oligonucleotide
gtcacccaccgacactttgagcaactcgactagt

SEQ ID NO: 18518 - DNA, 35 bp, Artificial Sequence
  Synthetic oligonucleotide
gcctaccttcccaattggtccctccgagtagttca

SEQ ID NO: 18519 - DNA, 37 bp, Artificial Sequence
  Synthetic oligonucleotide
accgcaaccattccccctactcgagccgtgcgctaga

SEQ ID NO: 18520 - DNA, 38 bp, Artificial Sequence
  Synthetic oligonucleotide
tatcgcgtaccctgatcctccacctactttatggttga

SEQ ID NO: 18521 - DNA, 35 bp, Artificial Sequence
  Synthetic oligonucleotide
gactgcaagtaggttactcttagccatttcatcac

SEQ ID NO: 18522 - DNA, 35 bp, Artificial Sequence
  Synthetic oligonucleotide
atgcacatctggcttacaacttgttccgggttccc

SEQ ID NO: 18523 - DNA, 35 bp, Artificial Sequence
  Synthetic oligonucleotide
aaaccagtcccctcgccacctatgttcgccacgcc

SEQ ID NO: 18524 - DNA, 35 bp, Artificial Sequence
  Synthetic oligonucleotide
attgcatagccgctctcaataaattctgatgcctc

SEQ ID NO: 18525 - DNA, 35 bp, Artificial Sequence
  Synthetic oligonucleotide
agccaccacgaacccgctttcttaggacgccacag

SEQ ID NO: 18526 - DNA, 35 bp, Artificial Sequence
  Synthetic oligonucleotide
atgatccccgccacggcttttgtacgtttgccact

SEQ ID NO: 18527 - DNA, 35 bp, Artificial Sequence
  Synthetic oligonucleotide
aaacgccaaccggggagggagtgtggtggggttaa

SEQ ID NO: 18528 - DNA, 37 bp, Artificial Sequence
  Synthetic oligonucleotide
acaccagtcctgccctgccccacaatgtcaatccaga

SEQ ID NO: 18529 - DNA, 37 bp, Artificial Sequence
  Synthetic oligonucleotide
gagtgaaaaatggggaagggcatggggtcaaacacga

SEQ ID NO: 18530 - DNA, 37 bp, Artificial Sequence
  Synthetic oligonucleotide
acctcgctctcatgcgatcctggacccctccacttga

SEQ ID NO: 18531 - DNA, 36 bp, Artificial Sequence
  Synthetic oligonucleotide
gccattactagccaatatgcatacgcctgtctacta

SEQ ID NO: 18532 - DNA, 34 bp, Artificial Sequence
  Synthetic oligonucleotide
tcatgaaaggggtgggacaaggcaaaagacgaag

SEQ ID NO: 18533 - DNA, 35 bp, Artificial Sequence
  Synthetic oligonucleotide
gaccacctttcctgtcgaactatcatcactggcct

SEQ ID NO: 18534 - DNA, 35 bp, Artificial Sequence
  Synthetic oligonucleotide
gtgtgtgaccacttcgctattgagccttttcacaa

SEQ ID NO: 18535 - DNA, 38 bp, Artificial Sequence
  Synthetic oligonucleotide
tcatcgcagggctgcctactcgatcccactccatctga

SEQ ID NO: 18536 - DNA, 35 bp, Artificial Sequence
  Synthetic oligonucleotide
ttacaaccccaacttttaggacaccgtgcgcacta

SEQ ID NO: 18537 - DNA, 35 bp, Artificial Sequence
  Synthetic oligonucleotide
tcacccgcgaactcgacgcgcatacagccacgacc

SEQ ID NO: 18538 - DNA, 35 bp, Artificial Sequence
  Synthetic oligonucleotide
acgactcatcgtgctcatagccctccttgttttcc

SEQ ID NO: 18539 - DNA, 35 bp, Artificial Sequence
  Synthetic oligonucleotide
tcccctctgccatgaatgatcctatgtttccgttc

SEQ ID NO: 18540 - DNA, 35 bp, Artificial Sequence
  Synthetic oligonucleotide
acccagaccggttgcgcgagccacatcttcccagt

SEQ ID NO: 18541 - DNA, 36 bp, Artificial Sequence
  Synthetic oligonucleotide
tggaggggtggggatagaccaaaacaaaactaaaca

SEQ ID NO: 18542 - DNA, 36 bp, Artificial Sequence
  Synthetic oligonucleotide
gtacctaaccctcgtgatccgttcccaagtccttga

SEQ ID NO: 18543 - DNA, 35 bp, Artificial Sequence
  Synthetic oligonucleotide
gagcccacggccccttagtctcccgatcagtccag

SEQ ID NO: 18544 - DNA, 35 bp, Artificial Sequence
  Synthetic oligonucleotide
tgcataccacacccgtagtctgttcctctttacat

SEQ ID NO: 18545 - DNA, 35 bp, Artificial Sequence
  Synthetic oligonucleotide
tcatgccatccctaactaacgtacttccctgttgt

SEQ ID NO: 18546 - DNA, 36 bp, Artificial Sequence
  Synthetic oligonucleotide
tcagcaggcgctacttgctttcacacacgcttcaca

SEQ ID NO: 18547 - DNA, 36 bp, Artificial Sequence
  Synthetic oligonucleotide
aatcacagggaaaggaggataggggcgagggtcgca

SEQ ID NO: 18548 - DNA, 36 bp, Artificial Sequence
  Synthetic oligonucleotide
gccacccgccgatcggttttcttatttattgcttca

SEQ ID NO: 18549 - DNA, 36 bp, Artificial Sequence
  Synthetic oligonucleotide
tgcccgctctttcgttgccccccttgcctcacagga

SEQ ID NO: 18550 - DNA, 38 bp, Artificial Sequence
  Synthetic oligonucleotide
accataaccccaccctgctgtcgttcgcgaatacgtga

SEQ ID NO: 18551 - DNA, 38 bp, Artificial Sequence
  Synthetic oligonucleotide
agactcgccctcgttacccacccgctagatctgcgtga

SEQ ID NO: 18552 - DNA, 37 bp, Artificial Sequence
  Synthetic oligonucleotide
tttacggcgtcccacctgcgctttactcacacattga

SEQ ID NO: 18553 - DNA, 35 bp, Artificial Sequence
  Synthetic oligonucleotide
acctgtgacatctcgcccgcccatgccacctgata

SEQ ID NO: 18554 - DNA, 35 bp, Artificial Sequence
  Synthetic oligonucleotide
tcgccccagtatcagcaccgccggccccatcgtac

SEQ ID NO: 18555 - DNA, 35 bp, Artificial Sequence
  Synthetic oligonucleotide
taaccgccctcgatccgcacctttatatctactgg

SEQ ID NO: 18556 - DNA, 38 bp, Artificial Sequence
  Synthetic oligonucleotide
tcaactgcgtacggttgctctgttctttcctgccgtga

SEQ ID NO: 18557 - DNA, 35 bp, Artificial Sequence
  Synthetic oligonucleotide
gcaacaggggccacctcatgaacgacctcacctcc

SEQ ID NO: 18558 - DNA, 35 bp, Artificial Sequence
  Synthetic oligonucleotide
atcccgcacagactgacaatacccgcctcccgcgc

SEQ ID NO: 18559 - DNA, 35 bp, Artificial Sequence
  Synthetic oligonucleotide
gcctccacacatgtagaattccctgctctacattc

SEQ ID NO: 18560 - DNA, 35 bp, Artificial Sequence
  Synthetic oligonucleotide
gcacgcgaacgaacattcatctctagccgtacctg

SEQ ID NO: 18561 - DNA, 35 bp, Artificial Sequence
  Synthetic oligonucleotide
gattgggcggtgggaaaaagcccaggggaaagact

SEQ ID NO: 18562 - DNA, 35 bp, Artificial Sequence
  Synthetic oligonucleotide
cctccctcaccggcgggccgccccccactccaggt

SEQ ID NO: 18563 - DNA, 35 bp, Artificial Sequence
  Synthetic oligonucleotide
atcgtgacccgctgttccgatacgatccaccctgt

SEQ ID NO: 18564 - DNA, 35 bp, Artificial Sequence
  Synthetic oligonucleotide
agtagcccccctcaccctccactacgagtatcgtt

SEQ ID NO: 18565 - DNA, 37 bp, Artificial Sequence
  Synthetic oligonucleotide
aaacctgcactctgccggacccattcatctcttgaga

SEQ ID NO: 18566 - DNA, 35 bp, Artificial Sequence
  Synthetic oligonucleotide
gtgggttacaaagggcaaaaagtggtggggataga

SEQ ID NO: 18567 - DNA, 35 bp, Artificial Sequence
  Synthetic oligonucleotide
gcacgccatgcgtaatgtccctgcgccaaactcac

SEQ ID NO: 18568 - DNA, 36 bp, Artificial Sequence
  Synthetic oligonucleotide
gtacgcgcccactgaatatcaggtctcgttcgccca

SEQ ID NO: 18569 - DNA, 35 bp, Artificial Sequence
  Synthetic oligonucleotide
tacccctccgttgtctcttatcttcaattggctca

SEQ ID NO: 18570 - DNA, 36 bp, Artificial Sequence
  Synthetic oligonucleotide
attcacccgcttcgagttaccctcgctccgaccgga

SEQ ID NO: 18571 - DNA, 38 bp, Artificial Sequence
  Synthetic oligonucleotide
tacccaccgcctcgcctacaacatgcagaaattcatga

SEQ ID NO: 18572 - DNA, 36 bp, Artificial Sequence
  Synthetic oligonucleotide
ggtgaacacccccccgtcatgtcctgacccttcacc

SEQ ID NO: 18573 - DNA, 35 bp, Artificial Sequence
  Synthetic oligonucleotide
acacccttgtcttttggttcccgaattgattcatc

SEQ ID NO: 18574 - DNA, 37 bp, Artificial Sequence
  Synthetic oligonucleotide
gaagcacacagagtcaccccatccgcccattagccga

SEQ ID NO: 18575 - DNA, 37 bp, Artificial Sequence
  Synthetic oligonucleotide
gtatgcccacgcgcccgacccttctagcctgttgcga

SEQ ID NO: 18576 - DNA, 38 bp, Artificial Sequence
  Synthetic oligonucleotide
tatgccagcccaaatcccttgccgtcgtcatttcttga

SEQ ID NO: 18577 - DNA, 35 bp, Artificial Sequence
  Synthetic oligonucleotide
gccaccggcacggacattaccaccgcaccttaacc

SEQ ID NO: 18578 - DNA, 35 bp, Artificial Sequence
  Synthetic oligonucleotide
gccgaccatcgtagtacatctttcccccctgcgat

SEQ ID NO: 18579 - DNA, 36 bp, Artificial Sequence
  Synthetic oligonucleotide
gccctcgcaccgtactccctccgagcctttggacaa

SEQ ID NO: 18580 - DNA, 35 bp, Artificial Sequence
  Synthetic oligonucleotide
gcgagacgcacagccataccgcctattttccgtaa

SEQ ID NO: 18581 - DNA, 36 bp, Artificial Sequence
  Synthetic oligonucleotide
tgtgcgggccccgatcctgtttgcgccaccctgcca

SEQ ID NO: 18582 - DNA, 37 bp, Artificial Sequence
  Synthetic oligonucleotide
tcgaagggggtggtggctacaaggtctgatcgaagga

SEQ ID NO: 18583 - DNA, 38 bp, Artificial Sequence
  Synthetic oligonucleotide
gcacctgcctatccgaatgcccgactgtaccaaactga

SEQ ID NO: 18584 - DNA, 35 bp, Artificial Sequence
  Synthetic oligonucleotide
gtcatccccccgcgcctgcgcatccggttctcgtc

SEQ ID NO: 18585 - DNA, 36 bp, Artificial Sequence
  Synthetic oligonucleotide
atgtgccatcgctcggttttttcgcgttcctttcaa

SEQ ID NO: 18586 - DNA, 36 bp, Artificial Sequence
  Synthetic oligonucleotide
ttcacaccatcctccttggttccagtggctcttcca

SEQ ID NO: 18587 - DNA, 37 bp, Artificial Sequence
  Synthetic oligonucleotide
aatgtgccccactcccttactgaacttagagagacga

SEQ ID NO: 18588 - DNA, 35 bp, Artificial Sequence
  Synthetic oligonucleotide
agttcctcacccacccagatcgcatccttggccta

SEQ ID NO: 18589 - DNA, 36 bp, Artificial Sequence
  Synthetic oligonucleotide
gcacccgcaatctgtccgccacccatgcctgcgcta

SEQ ID NO: 18590 - DNA, 32 bp, Artificial Sequence
  Synthetic oligonucleotide
ataccgtccacttgcctcgctacttccctcaa

SEQ ID NO: 18591 - DNA, 35 bp, Artificial Sequence
  Synthetic oligonucleotide
acccatctgctgccctatatcttcggccaaccgca

SEQ ID NO: 18592 - DNA, 35 bp, Artificial Sequence
  Synthetic oligonucleotide
tccctcctagcgcggttactgccctcttgtactca

SEQ ID NO: 18593 - DNA, 37 bp, Artificial Sequence
  Synthetic oligonucleotide
tacctcggagggtgggtagggtaagcaagtatcgaga

SEQ ID NO: 18594 - DNA, 37 bp, Artificial Sequence
  Synthetic oligonucleotide
tgcgcccccagagttattctggttctttttctcacga

SEQ ID NO: 18595 - DNA, 38 bp, Artificial Sequence
  Synthetic oligonucleotide
taaaccgcctcgcccttcacactgttcccgtctcatga

SEQ ID NO: 18596 - DNA, 35 bp, Artificial Sequence
  Synthetic oligonucleotide
gcatgggggcgggtgggcgtacgaggagaggaaac

SEQ ID NO: 18597 - DNA, 35 bp, Artificial Sequence
  Synthetic oligonucleotide
gaccaacccgaggctccccgacatgttattgtccc

SEQ ID NO: 18598 - DNA, 35 bp, Artificial Sequence
  Synthetic oligonucleotide
tcccgctttagcccgccccctcgtagcacccaggc

SEQ ID NO: 18599 - DNA, 35 bp, Artificial Sequence
  Synthetic oligonucleotide
agggacaattgggggatgggggcgggatagtaggg

SEQ ID NO: 18600 - DNA, 36 bp, Artificial Sequence
  Synthetic oligonucleotide
ttgaccctctcgtaccaccgttcttaatcacgctgg

SEQ ID NO: 18601 - DNA, 35 bp, Artificial Sequence
  Synthetic oligonucleotide
gccccgcgcgatcccgtcgttgacgcacttctttt

SEQ ID NO: 18602 - DNA, 36 bp, Artificial Sequence
  Synthetic oligonucleotide
gctgggagttgaaaaattgggtggagcggggggcaa

SEQ ID NO: 18603 - DNA, 36 bp, Artificial Sequence
  Synthetic oligonucleotide
tgccgagcaatgtacacacgcttctccataacccga

SEQ ID NO: 18604 - DNA, 37 bp, Artificial Sequence
  Synthetic oligonucleotide
tgaccatctcagacctcttagccgccttacttcatga

SEQ ID NO: 18605 - DNA, 37 bp, Artificial Sequence
  Synthetic oligonucleotide
gcccactggcaaataactgtaccatccggttctatga

SEQ ID NO: 18606 - DNA, 36 bp, Artificial Sequence
  Synthetic oligonucleotide
gtcgacaactggttaacctggcgttgggccctccac

SEQ ID NO: 18607 - DNA, 35 bp, Artificial Sequence
  Synthetic oligonucleotide
ttgaatcgctacacgttatgttttacctgttcttt

SEQ ID NO: 18608 - DNA, 36 bp, Artificial Sequence
  Synthetic oligonucleotide
ttgcacacgattgactgccgccccctctcccggaaa

SEQ ID NO: 18609 - DNA, 36 bp, Artificial Sequence
  Synthetic oligonucleotide
acgctccgcccaccttcgattcgtgcgtgctcccaa

SEQ ID NO: 18610 - DNA, 38 bp, Artificial Sequence
  Synthetic oligonucleotide
aacatcagtcgcaaggtttcccgtgagtttgcccttca

SEQ ID NO: 18611 - DNA, 37 bp, Artificial Sequence
  Synthetic oligonucleotide
acccacggccattgctaaaaactccctccttcatcga

SEQ ID NO: 18612 - DNA, 37 bp, Artificial Sequence
  Synthetic oligonucleotide
ataacgaaggggtggaatgtgggtgtagctcgctcga

SEQ ID NO: 18613 - DNA, 37 bp, Artificial Sequence
  Synthetic oligonucleotide
atagcgcacctccacggagctgttgccccacccctga

SEQ ID NO: 18614 - DNA, 38 bp, Artificial Sequence
  Synthetic oligonucleotide
aaccgcattcctcacaccccaggcgtctatagccttga

SEQ ID NO: 18615 - DNA, 38 bp, Artificial Sequence
  Synthetic oligonucleotide
tcctatcgcgccccacttgcgtccccagcaaactttga

SEQ ID NO: 18616 - DNA, 35 bp, Artificial Sequence
  Synthetic oligonucleotide
tcgagagtcagtggtcctcgctcacaccctgaacc

SEQ ID NO: 18617 - DNA, 35 bp, Artificial Sequence
  Synthetic oligonucleotide
tgtggagtggaaaaaaggagggtagaatgagaggt

SEQ ID NO: 18618 - DNA, 37 bp, Artificial Sequence
  Synthetic oligonucleotide
acgacccctgccctgacgcaaatcctagtctaaaaga

SEQ ID NO: 18619 - DNA, 38 bp, Artificial Sequence
  Synthetic oligonucleotide
tggacacgtgtcgccgaaatgcctcgttcctcccatga

SEQ ID NO: 18620 - DNA, 37 bp, Artificial Sequence
  Synthetic oligonucleotide
gacctcactgcgctgtccccctcgtatgcacttgtga

SEQ ID NO: 18621 - DNA, 35 bp, Artificial Sequence
  Synthetic oligonucleotide
accgaagccccaagccacgcaggtggatgccgccc

SEQ ID NO: 18622 - DNA, 35 bp, Artificial Sequence
  Synthetic oligonucleotide
tgccatcaggaggctctccatcagcgcgaattccc

SEQ ID NO: 18623 - DNA, 36 bp, Artificial Sequence
  Synthetic oligonucleotide
tccctgtccgacgttctactgcccgcggttccatca

SEQ ID NO: 18624 - DNA, 35 bp, Artificial Sequence
  Synthetic oligonucleotide
acgtgatgccacacacatcgttcatagttctactg

SEQ ID NO: 18625 - DNA, 36 bp, Artificial Sequence
  Synthetic oligonucleotide
gtcacgctaaggctaagcccgtagtttcgttcccca

SEQ ID NO: 18626 - DNA, 37 bp, Artificial Sequence
  Synthetic oligonucleotide
tccacaggagcggggggctaataggcttataggtgga

SEQ ID NO: 18627 - DNA, 37 bp, Artificial Sequence
  Synthetic oligonucleotide
atcaggggttgatggcggttgggggactgggcggtga

SEQ ID NO: 18628 - DNA, 36 bp, Artificial Sequence
  Synthetic oligonucleotide
tgcatcaaccgctccgttaccgatccaccttattga

SEQ ID NO: 18629 - DNA, 35 bp, Artificial Sequence
  Synthetic oligonucleotide
aggacacagccgaggccagtctgcacttcccttac

SEQ ID NO: 18630 - DNA, 35 bp, Artificial Sequence
  Synthetic oligonucleotide
acccaccatcaggacggttcaccaagatctcaatc

SEQ ID NO: 18631 - DNA, 36 bp, Artificial Sequence
  Synthetic oligonucleotide
agtacatccacgccttttcccgtgaaccacttgtaa

SEQ ID NO: 18632 - DNA, 37 bp, Artificial Sequence
  Synthetic oligonucleotide
tcccacgtcctatggtcccatcttggcacactcttga

SEQ ID NO: 18633 - DNA, 35 bp, Artificial Sequence
  Synthetic oligonucleotide
attgcgtgacctccttccgtgagtctgctccaaac

SEQ ID NO: 18634 - DNA, 35 bp, Artificial Sequence
  Synthetic oligonucleotide
atcacatggtgccattctgcctttccgatcctgtg

SEQ ID NO: 18635 - DNA, 35 bp, Artificial Sequence
  Synthetic oligonucleotide
atgcccaggcccctcctatccgatcagaacattca

SEQ ID NO: 18636 - DNA, 37 bp, Artificial Sequence
  Synthetic oligonucleotide
ggaggggggaccagggtagagaaggcagggaaaagga

SEQ ID NO: 18637 - DNA, 34 bp, Artificial Sequence
  Synthetic oligonucleotide
atccctgacctgcggcaattccctcagttcctcc

SEQ ID NO: 18638 - DNA, 35 bp, Artificial Sequence
  Synthetic oligonucleotide
agatccaacccatgcagccctcgggctagtttatc

SEQ ID NO: 18639 - DNA, 35 bp, Artificial Sequence
  Synthetic oligonucleotide
tcttccccgcttggtgcgccgtaacatcatcgccg

SEQ ID NO: 18640 - DNA, 35 bp, Artificial Sequence
  Synthetic oligonucleotide
ggatgccctgatttcctttcaaacacatcatctcg

SEQ ID NO: 18641 - DNA, 35 bp, Artificial Sequence
  Synthetic oligonucleotide
tccccgtcagcacatggttggtcgcctgcccctct

SEQ ID NO: 18642 - DNA, 35 bp, Artificial Sequence
  Synthetic oligonucleotide
tttacagcacagaacccctcttaacggcctccatt

SEQ ID NO: 18643 - DNA, 35 bp, Artificial Sequence
  Synthetic oligonucleotide
gttacacctccaaccagaccaagacttcagtccga

SEQ ID NO: 18644 - DNA, 38 bp, Artificial Sequence
  Synthetic oligonucleotide
tctactcccccctgtcctcgagtacagtctgggtttga

SEQ ID NO: 18645 - DNA, 35 bp, Artificial Sequence
  Synthetic oligonucleotide
accgcgctcactacatctgccattggcacgctacc

SEQ ID NO: 18646 - DNA, 35 bp, Artificial Sequence
  Synthetic oligonucleotide
aatgcactaacttgccgtccttgaccagcccaggc

SEQ ID NO: 18647 - DNA, 36 bp, Artificial Sequence
  Synthetic oligonucleotide
aagtcaccccgccgatgtcgcttccgtcttctaaaa

SEQ ID NO: 18648 - DNA, 38 bp, Artificial Sequence
  Synthetic oligonucleotide
tgagcgtagcaccaccgcctgactttgcaattggttga

SEQ ID NO: 18649 - DNA, 36 bp, Artificial Sequence
  Synthetic oligonucleotide
acctcgcttacaggcgcgcaaagcctacccgctata

SEQ ID NO: 18650 - DNA, 35 bp, Artificial Sequence
  Synthetic oligonucleotide
tgcaaacctcataccattgcccactgtagtcccta

SEQ ID NO: 18651 - DNA, 33 bp, Artificial Sequence
  Synthetic oligonucleotide
gcacgtactttacgcgttactttcgcttcttgc

SEQ ID NO: 18652 - DNA, 35 bp, Artificial Sequence
  Synthetic oligonucleotide
gacacgaaactttggctatccattcggaccccctc

SEQ ID NO: 18653 - DNA, 35 bp, Artificial Sequence
  Synthetic oligonucleotide
gactctgtcaagctggttctctgtcttctcctatt

SEQ ID NO: 18654 - DNA, 37 bp, Artificial Sequence
  Synthetic oligonucleotide
gcgagaaggtcagtggggggccgggtgggttgtagga

SEQ ID NO: 18655 - DNA, 36 bp, Artificial Sequence
  Synthetic oligonucleotide
tacgagtgcactcgcttaattgctaacctgtcccta

SEQ ID NO: 18656 - DNA, 35 bp, Artificial Sequence
  Synthetic oligonucleotide
aacgggacccacccgtctgcaatcccgttcaccac

SEQ ID NO: 18657 - DNA, 35 bp, Artificial Sequence
  Synthetic oligonucleotide
tgaatcgccaacaatatcacaagcgctgcccaacc

SEQ ID NO: 18658 - DNA, 35 bp, Artificial Sequence
  Synthetic oligonucleotide
tcagtggcgttcccgaactgcttaattcgctgtcc

SEQ ID NO: 18659 - DNA, 35 bp, Artificial Sequence
  Synthetic oligonucleotide
gtagggggggggtaacttgtgacatgggtcgggcg

SEQ ID NO: 18660 - DNA, 35 bp, Artificial Sequence
  Synthetic oligonucleotide
tctgacactgcgagcccctcttgttgccttgactg

SEQ ID NO: 18661 - DNA, 36 bp, Artificial Sequence
  Synthetic oligonucleotide
gcatacccacctcgtgctacagccgcgttgtccgca

SEQ ID NO: 18662 - DNA, 37 bp, Artificial Sequence
  Synthetic oligonucleotide
ttcagaggctatccgaagcgggtgggcgggagaggga

SEQ ID NO: 18663 - DNA, 35 bp, Artificial Sequence
  Synthetic oligonucleotide
gacatccgcaccactacgcaaattcaggacgtccc

SEQ ID NO: 18664 - DNA, 35 bp, Artificial Sequence
  Synthetic oligonucleotide
acatactctcctcagacagccctgcggtgccttct

SEQ ID NO: 18665 - DNA, 34 bp, Artificial Sequence
  Synthetic oligonucleotide
acccccaccatcttagcccctatagcacatccga

SEQ ID NO: 18666 - DNA, 38 bp, Artificial Sequence
  Synthetic oligonucleotide
gagcacatcaccatggtttccgttctcattattgctga

SEQ ID NO: 18667 - DNA, 35 bp, Artificial Sequence
  Synthetic oligonucleotide
tcacgaaagccgcccagtccttgtcgcaacattgc

SEQ ID NO: 18668 - DNA, 35 bp, Artificial Sequence
  Synthetic oligonucleotide
caatcagagggaagggggcaaaataggggaggaaa

SEQ ID NO: 18669 - DNA, 36 bp, Artificial Sequence
  Synthetic oligonucleotide
gtctcacctatgccatatgccgcgcctcaccgacga

SEQ ID NO: 18670 - DNA, 36 bp, Artificial Sequence
  Synthetic oligonucleotide
tcatccgatgcgacccgcccccgcctaaagttcata

SEQ ID NO: 18671 - DNA, 35 bp, Artificial Sequence
  Synthetic oligonucleotide
gatccgctcagtgagcccgtcgagctctacccctc

SEQ ID NO: 18672 - DNA, 35 bp, Artificial Sequence
  Synthetic oligonucleotide
tcctgccgcccttattcacaggcgctgacttcttc

SEQ ID NO: 18673 - DNA, 35 bp, Artificial Sequence
  Synthetic oligonucleotide
tgaactcggcgcctacctctcatgcccacgtatcg

SEQ ID NO: 18674 - DNA, 35 bp, Artificial Sequence
  Synthetic oligonucleotide
tccagtcctaacgccaaagacacctcctgctactg

SEQ ID NO: 18675 - DNA, 36 bp, Artificial Sequence
  Synthetic oligonucleotide
gcactcatcgcatttcaaccgtgatctcttgttcca

SEQ ID NO: 18676 - DNA, 37 bp, Artificial Sequence
  Synthetic oligonucleotide
gacatgcgcctcgtcctgttggttgtcacgctcccga

SEQ ID NO: 18677 - DNA, 38 bp, Artificial Sequence
  Synthetic oligonucleotide
tttgcgtgcccgtacccacccagttttcctggccctga

SEQ ID NO: 18678 - DNA, 35 bp, Artificial Sequence
  Synthetic oligonucleotide
tcctggcgcctcctcatacctccccatgcttctga

SEQ ID NO: 18679 - DNA, 35 bp, Artificial Sequence
  Synthetic oligonucleotide
gaacgggagtaggtatactggagggtgggtgacgt

SEQ ID NO: 18680 - DNA, 36 bp, Artificial Sequence
  Synthetic oligonucleotide
ccgccaccccttgcctcaacgtaccacgacgtgcca

SEQ ID NO: 18681 - DNA, 35 bp, Artificial Sequence
  Synthetic oligonucleotide
gtcgcatgacccatacctcatatttgatgcctcca

SEQ ID NO: 18682 - DNA, 37 bp, Artificial Sequence
  Synthetic oligonucleotide
atcctgccctgacatggcgcataccgtttctaccgga

SEQ ID NO: 18683 - DNA, 37 bp, Artificial Sequence
  Synthetic oligonucleotide
atgcgaagtctacttgcacctgtcacctctctccgga

SEQ ID NO: 18684 - DNA, 27 bp, Artificial Sequence
  Synthetic oligonucleotide
accaacctgctacggtcctactactga

SEQ ID NO: 18685 - DNA, 38 bp, Artificial Sequence
  Synthetic oligonucleotide
ggagtaatgggtgggtggtaggggggccactggagtga

SEQ ID NO: 18686 - DNA, 37 bp, Artificial Sequence
  Synthetic oligonucleotide
tcttcaccgagtgcgcgggagggagggagggttgtga

SEQ ID NO: 18687 - DNA, 36 bp, Artificial Sequence
  Synthetic oligonucleotide
atccactgcctcgcttcatgttccactggcgcccta

SEQ ID NO: 18688 - DNA, 35 bp, Artificial Sequence
  Synthetic oligonucleotide
attccacgttacaccgcactgtttgaccttacgcc

SEQ ID NO: 18689 - DNA, 34 bp, Artificial Sequence
  Synthetic oligonucleotide
actcgtcgtatccgtatcttctcgtcctcaggct

SEQ ID NO: 18690 - DNA, 36 bp, Artificial Sequence
  Synthetic oligonucleotide
acgatctaccgtgcaatttgtttcttcgctcatcca

SEQ ID NO: 18691 - DNA, 35 bp, Artificial Sequence
  Synthetic oligonucleotide
gtgggaatggtggtgtaatggtggaatgggcagga

SEQ ID NO: 18692 - DNA, 35 bp, Artificial Sequence
  Synthetic oligonucleotide
ggaacccaacagtcaccgcaccctctcaccagcct

SEQ ID NO: 18693 - DNA, 37 bp, Artificial Sequence
  Synthetic oligonucleotide
ctcacggtggtagatccgcacatgcatcttaacctga

SEQ ID NO: 18694 - DNA, 36 bp, Artificial Sequence
  Synthetic oligonucleotide
agtcaccgcccacactcattttgcaacggcaaccta

SEQ ID NO: 18695 - DNA, 35 bp, Artificial Sequence
  Synthetic oligonucleotide
gacgacctatgccttgccacccgcttaacgccccc

SEQ ID NO: 18696 - DNA, 35 bp, Artificial Sequence
  Synthetic oligonucleotide
gtacccctcaccggcccaggatcattaggatcctc

SEQ ID NO: 18697 - DNA, 35 bp, Artificial Sequence
  Synthetic oligonucleotide
accccgctggccatcatgtctttacacccgtagcg

SEQ ID NO: 18698 - DNA, 35 bp, Artificial Sequence
  Synthetic oligonucleotide
gacacagtggagggagggagcaagaaattgtcagg

SEQ ID NO: 18699 - DNA, 35 bp, Artificial Sequence; identical to SEQ ID NO: 2994
  Synthetic oligonucleotide

SEQ ID NO: 18700 - DNA, 35 bp, Artificial Sequence
  Synthetic oligonucleotide
gcccaaccccattgttagtccaccatgatcagcaa

SEQ ID NO: 18701 - DNA, 37 bp, Artificial Sequence
  Synthetic oligonucleotide
gccaccattacgccggttccttacactcgctgaacga

SEQ ID NO: 18702 - DNA, 37 bp, Artificial Sequence
  Synthetic oligonucleotide
gtagcgcgaggggaaaatggggttcgtggcgagggga

SEQ ID NO: 18703 - DNA, 35 bp, Artificial Sequence
  Synthetic oligonucleotide
tattgtccgcgcactcaggacaagcccatctatcc

SEQ ID NO: 18704 - DNA, 35 bp, Artificial Sequence
  Synthetic oligonucleotide
acgcgacagacgacccattcatattagcaccaggc

SEQ ID NO: 18705 - DNA, 32 bp, Artificial Sequence
  Synthetic oligonucleotide
tttctgccaagcttgagcactaccccttacct

SEQ ID NO: 18706 - DNA, 38 bp, Artificial Sequence
  Synthetic oligonucleotide
tacccatcccaaccgtcaccgcctcttcgcgcgtctga

SEQ ID NO: 18707 - DNA, 38 bp, Artificial Sequence
  Synthetic oligonucleotide
taacagcgcatgcattgtgtcccgcttccttcacttga

SEQ ID NO: 18708 - DNA, 37 bp, Artificial Sequence
  Synthetic oligonucleotide
gacaccgctatattttattaaccttgggcctggttga

SEQ ID NO: 18709 - DNA, 35 bp, Artificial Sequence
  Synthetic oligonucleotide
gcgagaggcctacatacccggggcacccctcccac

SEQ ID NO: 18710 - DNA, 35 bp, Artificial Sequence
  Synthetic oligonucleotide
agtgatcgtcccgggcagtccatcgccctcccgcc

SEQ ID NO: 18711 - DNA, 35 bp, Artificial Sequence
  Synthetic oligonucleotide
gtcccagtctgtcaatccacccgcctccagtccgg

SEQ ID NO: 18712 - DNA, 35 bp, Artificial Sequence
  Synthetic oligonucleotide
atccagcaaagatccggagtgaggggtattagcgg

SEQ ID NO: 18713 - DNA, 35 bp, Artificial Sequence
  Synthetic oligonucleotide
tgtcagagcagtcctggccccaccacgctctttat

SEQ ID NO: 18714 - DNA, 36 bp, Artificial Sequence
  Synthetic oligonucleotide
tcaaccttacgcccgcaccgccgaatactagggaca

SEQ ID NO: 18715 - DNA, 38 bp, Artificial Sequence
  Synthetic oligonucleotide
accagccacacatcccctaatggctcaactgcccatga

SEQ ID NO: 18716 - DNA, 36 bp, Artificial Sequence
  Synthetic oligonucleotide
gatcttgccaacttttacgctctgtaccctgcctta

SEQ ID NO: 18717 - DNA, 35 bp, Artificial Sequence
  Synthetic oligonucleotide
actagcccactcaatcacgtgctttgtttcgcatc

SEQ ID NO: 18718 - DNA, 35 bp, Artificial Sequence
  Synthetic oligonucleotide
acgatggaggggtgggttgggagctctcggggggg

SEQ ID NO: 18719 - DNA, 36 bp, Artificial Sequence
  Synthetic oligonucleotide
accccgcaacccctccctctttctcgtttcgggaaa

SEQ ID NO: 18720 - DNA, 38 bp, Artificial Sequence
  Synthetic oligonucleotide
tccgctcttaggactggtacatccacacttcatcctga

SEQ ID NO: 18721 - DNA, 35 bp, Artificial Sequence
  Synthetic oligonucleotide
gcacacgtttggctcccctatattgtgcactttct

SEQ ID NO: 18722 - DNA, 36 bp, Artificial Sequence
  Synthetic oligonucleotide
gagaacgtcctggccctaaagcttgaccacacccca

SEQ ID NO: 18723 - DNA, 38 bp, Artificial Sequence
  Synthetic oligonucleotide
gtcccacaagcgagatctctcatgcactccatacttga

SEQ ID NO: 18724 - DNA, 35 bp, Artificial Sequence
  Synthetic oligonucleotide
tgtgtgtgtccgtcatctggctagcccgcacctcc

SEQ ID NO: 18725 - DNA, 35 bp, Artificial Sequence
  Synthetic oligonucleotide
ttggcaacactcacaagctttccgtacctcaatcg

SEQ ID NO: 18726 - DNA, 35 bp, Artificial Sequence
  Synthetic oligonucleotide
atgccgagggtcgggttacgggagggtttcgaact

SEQ ID NO: 18727 - DNA, 35 bp, Artificial Sequence
  Synthetic oligonucleotide
tgcaccatccctaacccctgcatagctaacagact

SEQ ID NO: 18728 - DNA, 35 bp, Artificial Sequence
  Synthetic oligonucleotide
tcagacctccccgccctatgtcgcttacgtaataa

SEQ ID NO: 18729 - DNA, 35 bp, Artificial Sequence
  Synthetic oligonucleotide
accattccgcccttcaccagtctactcctctggga

SEQ ID NO: 18730 - DNA, 36 bp, Artificial Sequence
  Synthetic oligonucleotide
tccgtgccacaatccccgccgtccgccttaacctga

SEQ ID NO: 18731 - DNA, 35 bp, Artificial Sequence
  Synthetic oligonucleotide
taatagtgtcggcgctagtctcccgctcccagtcc

SEQ ID NO: 18732 - DNA, 35 bp, Artificial Sequence
  Synthetic oligonucleotide
taaccacattccgcatcaaatttgagacgtctttg

SEQ ID NO: 18733 - DNA, 35 bp, Artificial Sequence
  Synthetic oligonucleotide
tcgtcccacccacgcatgcccgctgctctgtaact

SEQ ID NO: 18734 - DNA, 35 bp, Artificial Sequence
  Synthetic oligonucleotide
acgatgagcacttgcgaaaccctccctcctatggt

SEQ ID NO: 18735 - DNA, 35 bp, Artificial Sequence
  Synthetic oligonucleotide
agctacccgccgttgtcccgctaactagtgctttt

SEQ ID NO: 18736 - DNA, 36 bp, Artificial Sequence
  Synthetic oligonucleotide
aagacgggcgaggagaggctatattagtaacggcaa

SEQ ID NO: 18737 - DNA, 36 bp, Artificial Sequence
  Synthetic oligonucleotide
gtcgcagtgcgtccacggtctagcttacatctcaca

SEQ ID NO: 18738 - DNA, 36 bp, Artificial Sequence
  Synthetic oligonucleotide
gccctgtcaccccattgcatcacgcgaacactgtta

SEQ ID NO: 18739 - DNA, 35 bp, Artificial Sequence
  Synthetic oligonucleotide
atccgaccaagcctgccctcgccgtgaatcttcgc

SEQ ID NO: 18740 - DNA, 35 bp, Artificial Sequence
  Synthetic oligonucleotide
ttagccacccgcgctccgcctttccgtatcctgtc

SEQ ID NO: 18741 - DNA, 35 bp, Artificial Sequence
  Synthetic oligonucleotide
acaggcagtccctcacctccgctcgttgtcactct

SEQ ID NO: 18742 - DNA, 35 bp, Artificial Sequence
  Synthetic oligonucleotide
atacacacagcagcacccgagctcattctccgtct

SEQ ID NO: 18743 - DNA, 35 bp, Artificial Sequence
  Synthetic oligonucleotide
acacgtagatccagtcccctcccgctgcctcacaa

SEQ ID NO: 18744 - DNA, 35 bp, Artificial Sequence
  Synthetic oligonucleotide
agtcacccagtccgaacgccacatctgaacctcaa

SEQ ID NO: 18745 - DNA, 37 bp, Artificial Sequence
  Synthetic oligonucleotide
gtggacacccaacctcgcccatctctaacatgcccga

SEQ ID NO: 18746 - DNA, 37 bp, Artificial Sequence
  Synthetic oligonucleotide
tatccacggcctatgtcctattatccctactactcga

SEQ ID NO: 18747 - DNA, 37 bp, Artificial Sequence
  Synthetic oligonucleotide
tagggtgggggtgagctgaaaaatacggggcggtcga

SEQ ID NO: 18748 - DNA, 36 bp, Artificial Sequence
  Synthetic oligonucleotide
actctgcatccgactgagccatatctccccattcga

SEQ ID NO: 18749 - DNA, 36 bp, Artificial Sequence
  Synthetic oligonucleotide
gacgaccattcgaggttacatctttcgccggtacta

SEQ ID NO: 18750 - DNA, 35 bp, Artificial Sequence
  Synthetic oligonucleotide
gtccaacctcggactccgatccctcctatcgcccc

SEQ ID NO: 18751 - DNA, 35 bp, Artificial Sequence
  Synthetic oligonucleotide
aatatgcattgcctcgccgccaactgcttgatact

SEQ ID NO: 18752 - DNA, 36 bp, Artificial Sequence
  Synthetic oligonucleotide
gctgtcgtcccaaaactgctcaccccactgctggca

SEQ ID NO: 18753 - DNA, 37 bp, Artificial Sequence
  Synthetic oligonucleotide
tgcaagggaatagaggtaaagcgggtgggagtagcga

SEQ ID NO: 18754 - DNA, 30 bp, Artificial Sequence
  Synthetic oligonucleotide
gggatcaccgtgccccactctccaccagga

SEQ ID NO: 18755 - DNA, 38 bp, Artificial Sequence
  Synthetic oligonucleotide
accgcggacgcccatccgttatccatagtctcacttga

SEQ ID NO: 18756 - DNA, 35 bp, Artificial Sequence
  Synthetic oligonucleotide
tgccaacgcgtgctgttgagcgtctgttctatcac

SEQ ID NO: 18757 - DNA, 35 bp, Artificial Sequence
  Synthetic oligonucleotide
tgcgggtgggcagggcaagggtcggcacattggac

SEQ ID NO: 18758 - DNA, 35 bp, Artificial Sequence
  Synthetic oligonucleotide
tcgaactgtacctccatgcctacgttaagtaaacc

SEQ ID NO: 18759 - DNA, 35 bp, Artificial Sequence
  Synthetic oligonucleotide
gaatgcgatcggtcgctcataccacgttctgctcc

SEQ ID NO: 18760 - DNA, 35 bp, Artificial Sequence
  Synthetic oligonucleotide
gacgcggtctcaagtccccagttttctgactcatt

SEQ ID NO: 18761 - DNA, 35 bp, Artificial Sequence
  Synthetic oligonucleotide
accgacgccaataggtacactccatcatgcactca

SEQ ID NO: 18762 - DNA, 37 bp, Artificial Sequence
  Synthetic oligonucleotide
tgagacgccggatctcaacccaccgcaaccctgtaga

SEQ ID NO: 18763 - DNA, 35 bp, Artificial Sequence
  Synthetic oligonucleotide
atggcccactctttagtgactctgctcccccctga

SEQ ID NO: 18764 - DNA, 38 bp, Artificial Sequence
  Synthetic oligonucleotide
ttacccacacccgactggtggctctttgaatttcctga

SEQ ID NO: 18765 - DNA, 37 bp, Artificial Sequence
  Synthetic oligonucleotide
gcgaagggtggaacgggggtgaggttttggccgctga

SEQ ID NO: 18766 - DNA, 35 bp, Artificial Sequence
  Synthetic oligonucleotide
gacaccaccaccgaccacggaccgacaccacgcac

SEQ ID NO: 18767 - DNA, 35 bp, Artificial Sequence
  Synthetic oligonucleotide
ggaaacagccctcgcgccgtcatcatcgctattac

SEQ ID NO: 18768 - DNA, 35 bp, Artificial Sequence
  Synthetic oligonucleotide
atgacaatcaacacctgctactggatacgcaactc

SEQ ID NO: 18769 - DNA, 35 bp, Artificial Sequence
  Synthetic oligonucleotide
ggtgaccatcgttctttccttgtgctgttttgttc

SEQ ID NO: 18770 - DNA, 37 bp, Artificial Sequence
  Synthetic oligonucleotide
gtccgtaccgccccttttgccctcggggccatcccga

SEQ ID NO: 18771 - DNA, 38 bp, Artificial Sequence
  Synthetic oligonucleotide
tctgcaccgactattgtcttctatgcctcttcacatga

SEQ ID NO: 18772 - DNA, 35 bp, Artificial Sequence
  Synthetic oligonucleotide
tacacgcctggctggcctactccgtcttccaacta

SEQ ID NO: 18773 - DNA, 35 bp, Artificial Sequence
  Synthetic oligonucleotide
acacatgtccgtttcgcaaccgcccagaaagcaac

SEQ ID NO: 18774 - DNA, 35 bp, Artificial Sequence
  Synthetic oligonucleotide
tcaactcggtctacccgctgccattgtctgccgcc

SEQ ID NO: 18775 - DNA, 35 bp, Artificial Sequence
  Synthetic oligonucleotide
gcacagcatccattattttctacctaggacttcgc

SEQ ID NO: 18776 - DNA, 35 bp, Artificial Sequence
  Synthetic oligonucleotide
atcaacgtcgtggcctcccgtcctctacaagcatc

SEQ ID NO: 18777 - DNA, 35 bp, Artificial Sequence
  Synthetic oligonucleotide
ttcaccgcctgacattcatttgacgacaacctctc

SEQ ID NO: 18778 - DNA, 35 bp, Artificial Sequence
  Synthetic oligonucleotide
gcgaccagacaagccggtgcgtcctccttcttacg

SEQ ID NO: 18779 - DNA, 35 bp, Artificial Sequence
  Synthetic oligonucleotide
tcattcgctccggttttttgttggctcacattgca

SEQ ID NO: 18780 - DNA, 37 bp, Artificial Sequence
  Synthetic oligonucleotide
tcacaggcacaggtccagtacacccaccgcctattga

SEQ ID NO: 18781 - DNA, 34 bp, Artificial Sequence
  Synthetic oligonucleotide
gaacgccgcacttactaccactttcgctcaccag

SEQ ID NO: 18782 - DNA, 35 bp, Artificial Sequence
  Synthetic oligonucleotide
acctattccccactcgttctgcccgctgttcgcag

SEQ ID NO: 18783 - DNA, 35 bp, Artificial Sequence
  Synthetic oligonucleotide
gtgggcccgcctctcgtccttctgctcccacatca

SEQ ID NO: 18784 - DNA, 37 bp, Artificial Sequence
  Synthetic oligonucleotide
gccaccgaccgaaggtggccgatcacccgtttacgga

SEQ ID NO: 18785 - DNA, 36 bp, Artificial Sequence
  Synthetic oligonucleotide
acaatgggtgggaagtggggttcgggtcgaagtgga

SEQ ID NO: 18786 - DNA, 38 bp, Artificial Sequence
  Synthetic oligonucleotide
ttctagcccgcccacacccacctttgatcacaggatga

SEQ ID NO: 18787 - DNA, 35 bp, Artificial Sequence
  Synthetic oligonucleotide
acctggaagaggcgggagggaatgcatacagggta

SEQ ID NO: 18788 - DNA, 36 bp, Artificial Sequence
  Synthetic oligonucleotide
tcacacgctgtcttgcctgctttttttttgtcgtta

SEQ ID NO: 18789 - DNA, 35 bp, Artificial Sequence
  Synthetic oligonucleotide
gagatcccaccattatcccgctcccgaggtgcgcc

SEQ ID NO: 18790 - DNA, 35 bp, Artificial Sequence
  Synthetic oligonucleotide
tcacgcatatccccgcataccccggtgcctatgcc

SEQ ID NO: 18791 - DNA, 35 bp, Artificial Sequence
  Synthetic oligonucleotide
acaccccgcacgcactgacaggctgccactacact

SEQ ID NO: 18792 - DNA, 35 bp, Artificial Sequence
  Synthetic oligonucleotide
tcacctctgctggcttacacagcctacagcctact

SEQ ID NO: 18793 - DNA, 36 bp, Artificial Sequence
  Synthetic oligonucleotide
tcaacacccgacgctcgccttaccagtaaccacaaa

SEQ ID NO: 18794 - DNA, 37 bp, Artificial Sequence
  Synthetic oligonucleotide
tacgcacagtccagtatgccccatcaacccgccttga

SEQ ID NO: 18795 - DNA, 35 bp, Artificial Sequence
  Synthetic oligonucleotide
tacccgcacaccctggccttgagccctgtagatcc

SEQ ID NO: 18796 - DNA, 35 bp, Artificial Sequence
  Synthetic oligonucleotide
agataccccgttcgagttaccacccccggatgctc

SEQ ID NO: 18797 - DNA, 35 bp, Artificial Sequence
  Synthetic oligonucleotide
agatcgccccttccgccctgtcccagaaacccttg

SEQ ID NO: 18798 - DNA, 36 bp, Artificial Sequence
  Synthetic oligonucleotide
aaagccctcacaccgtccgtagcaatgatccgccca

SEQ ID NO: 18799 - DNA, 36 bp, Artificial Sequence
  Synthetic oligonucleotide
acgggtgccccgccgcccagattcgcccctgctgca

SEQ ID NO: 18800 - DNA, 35 bp, Artificial Sequence
  Synthetic oligonucleotide
atcacctcctgtgcgacgaacgctatcctttctgg

SEQ ID NO: 18801 - DNA, 35 bp, Artificial Sequence
  Synthetic oligonucleotide
gtgcggtgggtgtaggtctgggaggagtggtaggt

SEQ ID NO: 18802 - DNA, 35 bp, Artificial Sequence
  Synthetic oligonucleotide
acgcaacaacgtcacactcgtctcttatctccggt

SEQ ID NO: 18803 - DNA, 36 bp, Artificial Sequence
  Synthetic oligonucleotide
gtaccacgaccccagacacccagaagttgatcgcca

SEQ ID NO: 18804 - DNA, 37 bp, Artificial Sequence
  Synthetic oligonucleotide
ttggggggagaggccgtaaataatgggggctgcagga

SEQ ID NO: 18805 - DNA, 36 bp, Artificial Sequence
  Synthetic oligonucleotide
atcccgacgcggttacagcccatcaaccctcactta

SEQ ID NO: 18806 - DNA, 36 bp, Artificial Sequence
  Synthetic oligonucleotide
gttgacccaatgaacatctgctaacgctttgcctta

SEQ ID NO: 18807 - DNA, 35 bp, Artificial Sequence
  Synthetic oligonucleotide
gagtactgctaacactgcttctgccacgcctttac

SEQ ID NO: 18808 - DNA, 35 bp, Artificial Sequence
  Synthetic oligonucleotide
ataccgacctctgttccatcaatcccagtaggagc

SEQ ID NO: 18809 - DNA, 35 bp, Artificial Sequence
  Synthetic oligonucleotide
gtaggccgggtggttcggaggggggaggggacgac

SEQ ID NO: 18810 - DNA, 35 bp, Artificial Sequence
  Synthetic oligonucleotide
gccattgccgtccctatctgtctttaatgtcctac

SEQ ID NO: 18811 - DNA, 35 bp, Artificial Sequence
  Synthetic oligonucleotide
accctggagccgcgcacataggcccaaacccatcc

SEQ ID NO: 18812 - DNA, 35 bp, Artificial Sequence
  Synthetic oligonucleotide
tacgaccacccgcttcaatcgcgcacatatgcgtc

SEQ ID NO: 18813 - DNA, 35 bp, Artificial Sequence
  Synthetic oligonucleotide
tcttgctcacactgcatacgtcataccctgcgttt

SEQ ID NO: 18814 - DNA, 36 bp, Artificial Sequence
  Synthetic oligonucleotide
accaacctcaaggggacactatgctcaacattccaa

SEQ ID NO: 18815 - DNA, 35 bp, Artificial Sequence
  Synthetic oligonucleotide
aaagtggactggggtagggaatgggatgggtcata

SEQ ID NO: 18816 - DNA, 35 bp, Artificial Sequence
  Synthetic oligonucleotide
acacgggaagccaccgaatccagtcattgaacacc

SEQ ID NO: 18817 - DNA, 35 bp, Artificial Sequence
  Synthetic oligonucleotide
tcatacggtagagatggctgctcattttccccttt

SEQ ID NO: 18818 - DNA, 37 bp, Artificial Sequence
  Synthetic oligonucleotide
ttgacgagcgcgtttgtagggagtgcggggtggggga

SEQ ID NO: 18819 - DNA, 35 bp, Artificial Sequence
  Synthetic oligonucleotide
gcctcccgcggttattattttggccctcttacagc

SEQ ID NO: 18820 - DNA, 35 bp, Artificial Sequence
  Synthetic oligonucleotide
tttcacccgaccaactcgcgaacgcgaaaccttcg

SEQ ID NO: 18821 - DNA, 35 bp, Artificial Sequence
  Synthetic oligonucleotide
gacctcaaccacatctatctgccctacgtgatttt

SEQ ID NO: 18822 - DNA, 37 bp, Artificial Sequence
  Synthetic oligonucleotide
tcctgccccctggctacaggccgtatccaccttcgga

SEQ ID NO: 18823 - DNA, 38 bp, Artificial Sequence
  Synthetic oligonucleotide
gaccgtcccatacggtcgcacgcccattccttgcctga

SEQ ID NO: 18824 - DNA, 37 bp, Artificial Sequence
  Synthetic oligonucleotide
gttggacgcatagtaaggaggttaggggggggagtga

SEQ ID NO: 18825 - DNA, 35 bp, Artificial Sequence
  Synthetic oligonucleotide
gctgcccatgagtccattgttcaacaatcccttgc

SEQ ID NO: 18826 - DNA, 35 bp, Artificial Sequence
  Synthetic oligonucleotide
gctcacctcactcacctgctgcattaccggaatag

SEQ ID NO: 18827 - DNA, 35 bp, Artificial Sequence
  Synthetic oligonucleotide
gcaattagcatctgacacctcaccgcactccatgg

SEQ ID NO: 18828 - DNA, 35 bp, Artificial Sequence
  Synthetic oligonucleotide
gactacgcccacgccgatcgcgcgctcattcgtct

SEQ ID NO: 18829 - DNA, 37 bp, Artificial Sequence
  Synthetic oligonucleotide
gcccaccggcgcctgtcaaccactccaattccaccga

SEQ ID NO: 18830 - DNA, 37 bp, Artificial Sequence
  Synthetic oligonucleotide
tgaaccgccccctgatactatctttctcttcgcatga

SEQ ID NO: 18831 - DNA, 38 bp, Artificial Sequence
  Synthetic oligonucleotide
tgttgcctccacccgtccaaaagcccactgccatatga

SEQ ID NO: 18832 - DNA, 35 bp, Artificial Sequence
  Synthetic oligonucleotide
tccgatcactcgcgggtccgtacgctactgcattc

SEQ ID NO: 18833 - DNA, 35 bp, Artificial Sequence
  Synthetic oligonucleotide
tggtcaccgcaagccatgtcactgcacctctcccg

SEQ ID NO: 18834 - DNA, 35 bp, Artificial Sequence
  Synthetic oligonucleotide
atcagtgatcccccccgcctgacgcgactccctgg

SEQ ID NO: 18835 - DNA, 35 bp, Artificial Sequence
  Synthetic oligonucleotide
acacgcccttgcaacttgtcccttatcccatcggt

SEQ ID NO: 18836 - DNA, 35 bp, Artificial Sequence
  Synthetic oligonucleotide
tgaagatgtcctcgtcaccctggcttttgatcaca

SEQ ID NO: 18837 - DNA, 35 bp, Artificial Sequence
  Synthetic oligonucleotide
tccaaacacacgcacacaggcccaagagggttacc

SEQ ID NO: 18838 - DNA, 35 bp, Artificial Sequence
  Synthetic oligonucleotide
gcagtgcgcacacttgcaaacgtatccaactattc

SEQ ID NO: 18839 - DNA, 35 bp, Artificial Sequence
  Synthetic oligonucleotide
attatgacacgggaagctagaaaaggcgggtgggg

SEQ ID NO: 18840 - DNA, 35 bp, Artificial Sequence
  Synthetic oligonucleotide
ccacctcatgcctcctcgcccgtttttacacatgg

SEQ ID NO: 18841 - DNA, 38 bp, Artificial Sequence
  Synthetic oligonucleotide
gaacgctagttcacgtgggtcacctgtgaccgtattga

SEQ ID NO: 18842 - DNA, 36 bp, Artificial Sequence
  Synthetic oligonucleotide
gccgaagccccaagcgaggtcccctacatcttacta

SEQ ID NO: 18843 - DNA, 35 bp, Artificial Sequence
  Synthetic oligonucleotide
gcccacacgaacggacggtaccttacattagcatt

SEQ ID NO: 18844 - DNA, 35 bp, Artificial Sequence
  Synthetic oligonucleotide
attaccccgcacgaaatgtcactgacccgcgttta

SEQ ID NO: 18845 - DNA, 35 bp, Artificial Sequence
  Synthetic oligonucleotide
tagcatttgcgatcgtatcttctcaacaccaccac

SEQ ID NO: 18846 - DNA, 35 bp, Artificial Sequence
  Synthetic oligonucleotide
tctgatgcgccactataccgcaactaacaatcacg

SEQ ID NO: 18847 - DNA, 35 bp, Artificial Sequence
  Synthetic oligonucleotide
accgccacctcggaacccacgacgccttcgtagcg

SEQ ID NO: 18848 - DNA, 35 bp, Artificial Sequence
  Synthetic oligonucleotide
tttccgccactgcctttcctcttatgtcctgcgat

SEQ ID NO: 18849 - DNA, 35 bp, Artificial Sequence
  Synthetic oligonucleotide
tgcacgcacgcttgacaccctcttcttcaaagtat

SEQ ID NO: 18850 - DNA, 35 bp, Artificial Sequence
  Synthetic oligonucleotide
cccattcccgacacgacctgcacaaaggcgccact

SEQ ID NO: 18851 - DNA, 35 bp, Artificial Sequence
  Synthetic oligonucleotide
gttgggccaaggccacactcgtaccaccgcttctt

SEQ ID NO: 18852 - DNA, 36 bp, Artificial Sequence
  Synthetic oligonucleotide
ttaggtcgcgggggcaagtgggatggggaagggaaa

SEQ ID NO: 18853 - DNA, 36 bp, Artificial Sequence
  Synthetic oligonucleotide
agcccgaccaggctcccttccgtgtcgtattctaca

SEQ ID NO: 18854 - DNA, 36 bp, Artificial Sequence
  Synthetic oligonucleotide
aaggatggagatgagggggaccataggggaatcgga

SEQ ID NO: 18855 - DNA, 37 bp, Artificial Sequence
  Synthetic oligonucleotide
gccgccccgcccccttcatccgataacagcaccctga

SEQ ID NO: 18856 - DNA, 35 bp, Artificial Sequence
  Synthetic oligonucleotide
actcatcaggctccctcgtgccgtccgactatacc

SEQ ID NO: 18857 - DNA, 35 bp, Artificial Sequence
  Synthetic oligonucleotide
tcggacggacaccacacttagttatgtaactattt

SEQ ID NO: 18858 - DNA, 36 bp, Artificial Sequence
  Synthetic oligonucleotide
gttcacgcacttttccccatgtgacgggtcttacca

SEQ ID NO: 18859 - DNA, 37 bp, Artificial Sequence
  Synthetic oligonucleotide
aattccccgcatccggaccactctgcatgtgctatga

SEQ ID NO: 18860 - DNA, 35 bp, Artificial Sequence
  Synthetic oligonucleotide
gcgaagctctacgcgttcctaacctggcacctaac

SEQ ID NO: 18861 - DNA, 35 bp, Artificial Sequence
  Synthetic oligonucleotide
tgaggcaaagcctcaagtcctaatttcctctcgcc

SEQ ID NO: 18862 - DNA, 35 bp, Artificial Sequence
  Synthetic oligonucleotide
tatacgtcctcgatagttttaatcgtcctcctctc

SEQ ID NO: 18863 - DNA, 35 bp, Artificial Sequence
  Synthetic oligonucleotide
agtcaacgggcgtgggaaagaaaggaaggatgtag

SEQ ID NO: 18864 - DNA, 36 bp, Artificial Sequence
  Synthetic oligonucleotide
tgtgcattcattaaacaacatcgctgccgtgaccca

SEQ ID NO: 18865 - DNA, 37 bp, Artificial Sequence
  Synthetic oligonucleotide
tgagaccccatgagcccatcatccgcgccctcgccga

SEQ ID NO: 18866 - DNA, 37 bp, Artificial Sequence
  Synthetic oligonucleotide
gccctcaactactccatgctgtcatcgacctcatcga

SEQ ID NO: 18867 - DNA, 37 bp, Artificial Sequence
  Synthetic oligonucleotide
gcacccctgagtactcagaccacctcttgtcaattga

SEQ ID NO: 18868 - DNA, 35 bp, Artificial Sequence
  Synthetic oligonucleotide
atccatcctatcccgatacttgagtagtctacgac

SEQ ID NO: 18869 - DNA, 35 bp, Artificial Sequence
  Synthetic oligonucleotide
tgtgtctggctcgcttctgctcttacactctctac

SEQ ID NO: 18870 - DNA, 35 bp, Artificial Sequence
  Synthetic oligonucleotide
tttcggagcccgtctacccatccccttcttctcct

SEQ ID NO: 18871 - DNA, 35 bp, Artificial Sequence
  Synthetic oligonucleotide
gatgccggcatgggcgcttgccacccgaccccttt

SEQ ID NO: 18872 - DNA, 36 bp, Artificial Sequence
  Synthetic oligonucleotide
tgtagcccgcctcccccgtttccgttctaagttgga

SEQ ID NO: 18873 - DNA, 36 bp, Artificial Sequence
  Synthetic oligonucleotide
accccggaccccccatcgaagctatacaacacgtga

SEQ ID NO: 18874 - DNA, 37 bp, Artificial Sequence
  Synthetic oligonucleotide
ttggactgtccgtacacccgcaacctcactactgtga

SEQ ID NO: 18875 - DNA, 35 bp, Artificial Sequence
  Synthetic oligonucleotide
accacatcacgcccactaatcaagtagtatgctcc

SEQ ID NO: 18876 - DNA, 35 bp, Artificial Sequence
  Synthetic oligonucleotide
gcacacagccccctgggtcccccaacttatatgtc

SEQ ID NO: 18877 - DNA, 36 bp, Artificial Sequence
  Synthetic oligonucleotide
ttggacactgacaatcgttccaccgtactatccaaa

SEQ ID NO: 18878 - DNA, 37 bp, Artificial Sequence
  Synthetic oligonucleotide
ataaccaccactcgatagcccgtccgccctccaccga

SEQ ID NO: 18879 - DNA, 38 bp, Artificial Sequence
  Synthetic oligonucleotide
tgtcgagacgcaccatcttcaccatgtttctatcttga

SEQ ID NO: 18880 - DNA, 38 bp, Artificial Sequence
  Synthetic oligonucleotide
gccgcattccgctcagttgctgcacgcccttttgttga

SEQ ID NO: 18881 - DNA, 36 bp, Artificial Sequence
  Synthetic oligonucleotide
gagggagtgcctcatttgcttccccgactttttcgc

SEQ ID NO: 18882 - DNA, 35 bp, Artificial Sequence
  Synthetic oligonucleotide
gtggaggcctgttcttgattagtttacatctttgc

SEQ ID NO: 18883 - DNA, 35 bp, Artificial Sequence
  Synthetic oligonucleotide
gttgccgggccctacttttgttacgttaactcctc

SEQ ID NO: 18884 - DNA, 35 bp, Artificial Sequence
  Synthetic oligonucleotide
tgtatccccgcctgtcctcctatttactccagctc

SEQ ID NO: 18885 - DNA, 36 bp, Artificial Sequence
  Synthetic oligonucleotide
gaccagtccatgattttatcggcatctcttacccca

SEQ ID NO: 18886 - DNA, 37 bp, Artificial Sequence
  Synthetic oligonucleotide
ataccccacgctggcccaattgatccgaacgaatcga

SEQ ID NO: 18887 - DNA, 38 bp, Artificial Sequence
  Synthetic oligonucleotide
ttagtgtcacagcgaaacattgaccctactacctctga

SEQ ID NO: 18888 - DNA, 38 bp, Artificial Sequence
  Synthetic oligonucleotide
gaggagcctgagcgatcgtcttcaccacacacctttga

SEQ ID NO: 18889 - DNA, 36 bp, Artificial Sequence
  Synthetic oligonucleotide
ttcaccaccacacttggctattcaacttaaccgtta

SEQ ID NO: 18890 - DNA, 35 bp, Artificial Sequence
  Synthetic oligonucleotide
atagcacacacatccaggcaatatcccgacgaatc

SEQ ID NO: 18891 - DNA, 35 bp, Artificial Sequence
  Synthetic oligonucleotide
tgctaatcccaatgctgcccaacgactatgccgct

SEQ ID NO: 18892 - DNA, 35 bp, Artificial Sequence
  Synthetic oligonucleotide
tgagctgtgcccttgcgaacgatcctgctgctttt

SEQ ID NO: 18893 - DNA, 36 bp, Artificial Sequence
  Synthetic oligonucleotide
gagcctggccacccttccttatgctttacaggtcaa

SEQ ID NO: 18894 - DNA, 38 bp, Artificial Sequence
  Synthetic oligonucleotide
tgatggagggcgaggatagatagggcgggaaggtgtga

SEQ ID NO: 18895 - DNA, 38 bp, Artificial Sequence
  Synthetic oligonucleotide
acgcggccaccctgagttgatccgccctccacctttga

SEQ ID NO: 18896 - DNA, 35 bp, Artificial Sequence
  Synthetic oligonucleotide
gtctgttgccccgcttgtcgcctctcggtttatac

SEQ ID NO: 18897 - DNA, 35 bp, Artificial Sequence
  Synthetic oligonucleotide
tcttcgccccctgccttgacgcctattgtcttctc

SEQ ID NO: 18898 - DNA, 35 bp, Artificial Sequence
  Synthetic oligonucleotide
gctcaggctctacatcgtctcatcttgcccgtttc

SEQ ID NO: 18899 - DNA, 35 bp, Artificial Sequence
  Synthetic oligonucleotide
atgacacgcacattttaggtgacacagtttgtgcg

SEQ ID NO: 18900 - DNA, 36 bp, Artificial Sequence
  Synthetic oligonucleotide
acactcgcccgccaccgcatttgtaattccgtgtaa

SEQ ID NO: 18901 - DNA, 35 bp, Artificial Sequence
  Synthetic oligonucleotide
tctgtcggtcgttgtactttctgcttcttccctca

SEQ ID NO: 18902 - DNA, 36 bp, Artificial Sequence
  Synthetic oligonucleotide
tgcatcgccgcattccgctcaatcgatcatcaccga

SEQ ID NO: 18903 - DNA, 35 bp, Artificial Sequence
  Synthetic oligonucleotide
gtgtcgctgctgatccgcctatagcttaacccgcc

SEQ ID NO: 18904 - DNA, 35 bp, Artificial Sequence
  Synthetic oligonucleotide
tgtccagcagagggtctaccagcgcctccccatcc

SEQ ID NO: 18905 - DNA, 35 bp, Artificial Sequence
  Synthetic oligonucleotide
gcagaaccccgcgcgtcctatctacgacgacctcc

SEQ ID NO: 18906 - DNA, 35 bp, Artificial Sequence
  Synthetic oligonucleotide
ttgtgatacgaactctgggcttccctccgtttcct

SEQ ID NO: 18907 - DNA, 36 bp, Artificial Sequence
  Synthetic oligonucleotide
gcctgtgtcgttgtgcctccattcactttcttctca

SEQ ID NO: 18908 - DNA, 38 bp, Artificial Sequence
  Synthetic oligonucleotide
tctgctcgttcccgcctcctccgcgtccatgtccgtga

SEQ ID NO: 18909 - DNA, 36 bp, Artificial Sequence
  Synthetic oligonucleotide
actggccacatttcctgcttcctaattactgtagta

SEQ ID NO: 18910 - DNA, 35 bp, Artificial Sequence
  Synthetic oligonucleotide
gcctgtaaacgggcctaagcagccacaccctttcc

SEQ ID NO: 18911 - DNA, 35 bp, Artificial Sequence
  Synthetic oligonucleotide
gagcccaatagcatctgtcccgcctattccccggc

SEQ ID NO: 18912 - DNA, 35 bp, Artificial Sequence
  Synthetic oligonucleotide
ggagcaaaaggtggtcatcccacgcgctccccatc

SEQ ID NO: 18913 - DNA, 35 bp, Artificial Sequence
  Synthetic oligonucleotide
aagatgcgcctccacacccccgccacctcaaggcg

SEQ ID NO: 18914 - DNA, 36 bp, Artificial Sequence
  Synthetic oligonucleotide
agagccggcgcactgctctcgacgcatcccctccca

SEQ ID NO: 18915 - DNA, 37 bp, Artificial Sequence
  Synthetic oligonucleotide
gacatgagtaggaacggggtagggaatggatcttgga

SEQ ID NO: 18916 - DNA, 38 bp, Artificial Sequence
  Synthetic oligonucleotide
atcgaccacctcctgctatgttcgtaattattctctga

SEQ ID NO: 18917 - DNA, 35 bp, Artificial Sequence
  Synthetic oligonucleotide
gcccggtggaaggtgagggcgggtatgcaggagac

SEQ ID NO: 18918 - DNA, 35 bp, Artificial Sequence
  Synthetic oligonucleotide
aggtaccgcacacccagttcatccccgctcacgcc

SEQ ID NO: 18919 - DNA, 35 bp, Artificial Sequence
  Synthetic oligonucleotide
gccatccacttcttcgctgagtatttccgtctcgc

SEQ ID NO: 18920 - DNA, 36 bp, Artificial Sequence
  Synthetic oligonucleotide
gttacatccccatgcccccgttgccgtcacacaaaa

SEQ ID NO: 18921 - DNA, 36 bp, Artificial Sequence
  Synthetic oligonucleotide
tccccgcatgcccccggctctagcccactccatcca

SEQ ID NO: 18922 - DNA, 36 bp, Artificial Sequence
  Synthetic oligonucleotide
ttacgtcaacatcgtcccatacaccctgttcctcga

SEQ ID NO: 18923 - DNA, 37 bp, Artificial Sequence
  Synthetic oligonucleotide
tacaaccacatcgtttagcatcctcccgctctcagga

SEQ ID NO: 18924 - DNA, 38 bp, Artificial Sequence
  Synthetic oligonucleotide
atgggtggggagggatgggtagtttgatcagatcgtga

SEQ ID NO: 18925 - DNA, 37 bp, Artificial Sequence
  Synthetic oligonucleotide
agtcgaggccaggcggtggaagcaaagggggcggtga

SEQ ID NO: 18926 - DNA, 37 bp, Artificial Sequence
  Synthetic oligonucleotide
tcctcaaccgcctcaagttttctgaatgacccgttga

SEQ ID NO: 18927 - DNA, 35 bp, Artificial Sequence
  Synthetic oligonucleotide
tgctgccctagtattgttttgtttgtgtttcgtcc

SEQ ID NO: 18928 - DNA, 35 bp, Artificial Sequence
  Synthetic oligonucleotide
gcacacagggaagagggtggtacacggtctgatcg

SEQ ID NO: 18929 - DNA, 35 bp, Artificial Sequence
  Synthetic oligonucleotide
atctggccgtccatctccagctctccagtttaact

SEQ ID NO: 18930 - DNA, 35 bp, Artificial Sequence
  Synthetic oligonucleotide
acccatactcacctggcctgttccgtacttcgagt

SEQ ID NO: 18931 - DNA, 35 bp, Artificial Sequence
  Synthetic oligonucleotide
gagtgtcactttctatcattgggcccgtttctctt

SEQ ID NO: 18932 - DNA, 36 bp, Artificial Sequence
  Synthetic oligonucleotide
gaaccaatctccgcgcctcagccctggtccactaca

SEQ ID NO: 18933 - DNA, 35 bp, Artificial Sequence
  Synthetic oligonucleotide
ccaccctccaccactggactacacagggccatgac

SEQ ID NO: 18934 - DNA, 35 bp, Artificial Sequence
  Synthetic oligonucleotide
acaccccgattggcactcgctttcacgctgttgct

SEQ ID NO: 18935 - DNA, 35 bp, Artificial Sequence
  Synthetic oligonucleotide
ttgtgtgcccgtagcgttttgacacgctcttgttt

SEQ ID NO: 18936 - DNA, 37 bp, Artificial Sequence
  Synthetic oligonucleotide
tgtgtcggccttcgatctcatttgcaccatccgcaga

SEQ ID NO: 18937 - DNA, 36 bp, Artificial Sequence
  Synthetic oligonucleotide
tgaaagggggaaggtgctggaggtacaatttgcaga

SEQ ID NO: 18938 - DNA, 35 bp, Artificial Sequence
  Synthetic oligonucleotide
acgaccgttctgacattaccttcccatctatgaac

SEQ ID NO: 18939 - DNA, 35 bp, Artificial Sequence
  Synthetic oligonucleotide
gcacctaccagcttaccagctgcccttttaacgcc

SEQ ID NO: 18940 - DNA, 35 bp, Artificial Sequence
  Synthetic oligonucleotide
tcacgtatgggcccctgacctagaacccgccactc

SEQ ID NO: 18941 - DNA, 35 bp, Artificial Sequence
  Synthetic oligonucleotide
gtcaactgccctcgtgtggccactctgtgcatgtc

SEQ ID NO: 18942 - DNA, 35 bp, Artificial Sequence
  Synthetic oligonucleotide
tcacccgcatcattcgttccgctctcccagaggtt

SEQ ID NO: 18943 - DNA, 35 bp, Artificial Sequence
  Synthetic oligonucleotide
gggggaagtggaggagtacgattgggagcttaaga

SEQ ID NO: 18944 - DNA, 36 bp, Artificial Sequence
  Synthetic oligonucleotide
tgctcgccgcaggctgctatattgctccacctacga

SEQ ID NO: 18945 - DNA, 35 bp, Artificial Sequence
  Synthetic oligonucleotide
atttcgtccgtaagccccgtctatgcactatccac

SEQ ID NO: 18946 - DNA, 35 bp, Artificial Sequence
  Synthetic oligonucleotide
tccagacctcaccctcatgcctggttgtccattcg

SEQ ID NO: 18947 - DNA, 35 bp, Artificial Sequence
  Synthetic oligonucleotide
accacatggctgttatcacgccgcccccggttact

SEQ ID NO: 18948 - DNA, 36 bp, Artificial Sequence
  Synthetic oligonucleotide
gacacagtttcccgccgccgctacagctatttcaca

SEQ ID NO: 18949 - DNA, 36 bp, Artificial Sequence
  Synthetic oligonucleotide
taagactgtggagaggttgagggtggcaatgggtga

SEQ ID NO: 18950 - DNA, 38 bp, Artificial Sequence
  Synthetic oligonucleotide
gcctcaaccgcaccctcttgtcttgaaaacatgcttga

SEQ ID NO: 18951 - DNA, 35 bp, Artificial Sequence
  Synthetic oligonucleotide
tccgcccttgtccccaatcctaccaagttgccacc

SEQ ID NO: 18952 - DNA, 35 bp, Artificial Sequence
  Synthetic oligonucleotide
gtgtgcaggtaaaatatgttcctccccgtgttgcc

SEQ ID NO: 18953 - DNA, 35 bp, Artificial Sequence
  Synthetic oligonucleotide
gccatcggtcatatcccctttttcccttgctgttc

SEQ ID NO: 18954 - DNA, 35 bp, Artificial Sequence
  Synthetic oligonucleotide
acacacgcaaatgagcggtctcattggttactttt

SEQ ID NO: 18955 - DNA, 36 bp, Artificial Sequence
  Synthetic oligonucleotide
atacgacgtcggatctctggcccatctctacaccga

SEQ ID NO: 18956 - DNA, 37 bp, Artificial Sequence
  Synthetic oligonucleotide
actgctgaccacctcgcttatccttgaagacacccga

SEQ ID NO: 18957 - DNA, 37 bp, Artificial Sequence
  Synthetic oligonucleotide
acctacgcaggcctcgtatccatactgtttctttcga

SEQ ID NO: 18958 - DNA, 38 bp, Artificial Sequence
  Synthetic oligonucleotide
ggttggtccgaacggagggaagggatccgggggggtga

SEQ ID NO: 18959 - DNA, 38 bp, Artificial Sequence
  Synthetic oligonucleotide
acacgacgcaactccatcaaacactcaacctttggtga

SEQ ID NO: 18960 - DNA, 36 bp, Artificial Sequence
  Synthetic oligonucleotide
tccctcccccatttcgcctacagtatggcggacata

SEQ ID NO: 18961 - DNA, 35 bp, Artificial Sequence
  Synthetic oligonucleotide
agctgtccccctgtcgcatctccaccattgaaccc

SEQ ID NO: 18962 - DNA, 38 bp, Artificial Sequence
  Synthetic oligonucleotide
gccacaactgctggtctatcatgatcgtttacacttga

SEQ ID NO: 18963 - DNA, 37 bp, Artificial Sequence
  Synthetic oligonucleotide
gacatgacgccagtggcttcattttccttacccttga

SEQ ID NO: 18964 - DNA, 36 bp, Artificial Sequence
  Synthetic oligonucleotide
gttcacacaggctctgactctatccagcatttttga

SEQ ID NO: 18965 - DNA, 35 bp, Artificial Sequence
  Synthetic oligonucleotide
ttcgcaggcggggaaattggaagggcgggggggac

SEQ ID NO: 18966 - DNA, 35 bp, Artificial Sequence
  Synthetic oligonucleotide
gctttccaccactcaggtccagctaggggccgccc

SEQ ID NO: 18967 - DNA, 35 bp, Artificial Sequence
  Synthetic oligonucleotide
aatacgtaccttgcctagcttcctgccctcccgcg

SEQ ID NO: 18968 - DNA, 35 bp, Artificial Sequence
  Synthetic oligonucleotide
ttcgcaaaccacagcacgccctctgtcttatgcct

SEQ ID NO: 18969 - DNA, 35 bp, Artificial Sequence
  Synthetic oligonucleotide
gacatccaggtcggcgcatccctgtcccctaatgt

SEQ ID NO: 18970 - DNA, 35 bp, Artificial Sequence
  Synthetic oligonucleotide
tagcccctcctaccatgctagactcgctgattatt

SEQ ID NO: 18971 - DNA, 36 bp, Artificial Sequence
  Synthetic oligonucleotide
tcaaccagcgcccttatattcgcctcgctctgcaca

SEQ ID NO: 18972 - DNA, 36 bp, Artificial Sequence
  Synthetic oligonucleotide
gtgatgccacactggcccgtaacccttgaaactcca

SEQ ID NO: 18973 - DNA, 35 bp, Artificial Sequence
  Synthetic oligonucleotide
tgctcaccatccgttgtccgtgctgtgtgccccga

SEQ ID NO: 18974 - DNA, 37 bp, Artificial Sequence
  Synthetic oligonucleotide
agggaaaggatcgggcgggagggggaactgtgtgtga

SEQ ID NO: 18975 - DNA, 35 bp, Artificial Sequence
  Synthetic oligonucleotide
tgtcccgacgcccgcctgctcgcatgtacttacac

SEQ ID NO: 18976 - DNA, 35 bp, Artificial Sequence
  Synthetic oligonucleotide
agcaatcccctgcaagtgcgcctccgttgtacggc

SEQ ID NO: 18977 - DNA, 35 bp, Artificial Sequence
  Synthetic oligonucleotide
gatacgggccgggcatcatcctgctattccacctc

SEQ ID NO: 18978 - DNA, 35 bp, Artificial Sequence
  Synthetic oligonucleotide
ggggggcgggaaggaagggagtcggttgagagtgg

SEQ ID NO: 18979 - DNA, 35 bp, Artificial Sequence
  Synthetic oligonucleotide
ttgccacagtgttcacttgtccattcaagcttcct

SEQ ID NO: 18980 - DNA, 36 bp, Artificial Sequence
  Synthetic oligonucleotide
atgcactggtctcgtgaaccggcccacttttttaca

SEQ ID NO: 18981 - DNA, 37 bp, Artificial Sequence
  Synthetic oligonucleotide
gatgcgttcacaccgccataatagccccctgtccaga

SEQ ID NO: 18982 - DNA, 35 bp, Artificial Sequence
  Synthetic oligonucleotide
acaaagggggggccgaaaggatcatgcaggaaata

SEQ ID NO: 18983 - DNA, 35 bp, Artificial Sequence
  Synthetic oligonucleotide
atttccgtcaccctcgattatcgccttacctggtc

SEQ ID NO: 18984 - DNA, 35 bp, Artificial Sequence
  Synthetic oligonucleotide
gcccatgtccattgaattcagctcatttcctacat

SEQ ID NO: 18985 - DNA, 36 bp, Artificial Sequence
  Synthetic oligonucleotide
gctcatgccaggctttacttgaccatgccccaccca

SEQ ID NO: 18986 - DNA, 37 bp, Artificial Sequence
  Synthetic oligonucleotide
accatccgcatatttactcgtctgctcagttacctga

SEQ ID NO: 18987 - DNA, 38 bp, Artificial Sequence
  Synthetic oligonucleotide
gccagtgcagcagcacttaccccatctctctggattga

SEQ ID NO: 18988 - DNA, 38 bp, Artificial Sequence
  Synthetic oligonucleotide
tgtcccgaccagggcgactctgttcactcccttcttga

SEQ ID NO: 18989 - DNA, 36 bp, Artificial Sequence
  Synthetic oligonucleotide
atcccccactgctacacttgaaaccgatacgcttta

SEQ ID NO: 18990 - DNA, 35 bp, Artificial Sequence
  Synthetic oligonucleotide
gcgcatagctcgaaacccaacacgccgacttgacc

SEQ ID NO: 18991 - DNA, 35 bp, Artificial Sequence
  Synthetic oligonucleotide
tctacactcccttcattgatgcctgccagcaacgc

SEQ ID NO: 18992 - DNA, 35 bp, Artificial Sequence
  Synthetic oligonucleotide
ggatcaacgccacgaccacccatttgtttttattc

SEQ ID NO: 18993 - DNA, 35 bp, Artificial Sequence
  Synthetic oligonucleotide
tgacgaccacccctgcgcactctttcctaccacag

SEQ ID NO: 18994 - DNA, 35 bp, Artificial Sequence
  Synthetic oligonucleotide
cactgcccaaccccatcctgtaaccgccgacatag

SEQ ID NO: 18995 - DNA, 35 bp, Artificial Sequence
  Synthetic oligonucleotide
ttcgcgctgtcttactgcaatcatccagcttttct

SEQ ID NO: 18996 - DNA, 35 bp, Artificial Sequence
  Synthetic oligonucleotide
ttcaccccccgcgggccatagcccctcctacatgt

SEQ ID NO: 18997 - DNA, 37 bp, Artificial Sequence
  Synthetic oligonucleotide
atcatgcacgcgtcactcctcttgcctacttgtccga

SEQ ID NO: 18998 - DNA, 38 bp, Artificial Sequence
  Synthetic oligonucleotide
gcgagagccactgcgcattacacctcccactatgatga

SEQ ID NO: 18999 - DNA, 35 bp, Artificial Sequence
  Synthetic oligonucleotide
agaggagggggcggaagaagcatgaggggcgcaat

SEQ ID NO: 19000 - DNA, 35 bp, Artificial Sequence
  Synthetic oligonucleotide
gtccatcagcccatccacaggccacgaattgaaca

SEQ ID NO: 19001 - DNA, 36 bp, Artificial Sequence
  Synthetic oligonucleotide
gccatgtgcctccggccccgcttgccctgtttctca

SEQ ID NO: 19002 - DNA, 35 bp, Artificial Sequence
  Synthetic oligonucleotide
gccatggcctcaccatcattatttcgtgtagttca

SEQ ID NO: 19003 - DNA, 36 bp, Artificial Sequence
  Synthetic oligonucleotide
gaaccgcccataaggttgcaccatatatttctcgta

SEQ ID NO: 19004 - DNA, 36 bp, Artificial Sequence
  Synthetic oligonucleotide
atgtgctgcagggggctatgcagtgacgtggcatta

SEQ ID NO: 19005 - DNA, 35 bp, Artificial Sequence
  Synthetic oligonucleotide
catcccccgtccagtctatatccgtcattcgttcc

SEQ ID NO: 19006 - DNA, 35 bp, Artificial Sequence
  Synthetic oligonucleotide
tcatccgattagcccatcaccgacgtccgaagtct

SEQ ID NO: 19007 - DNA, 35 bp, Artificial Sequence
  Synthetic oligonucleotide
ggtcgcactacgccgattaatcgctcccttgcatt

SEQ ID NO: 19008 - DNA, 36 bp, Artificial Sequence
  Synthetic oligonucleotide
acttcccgaccactgcacttttagtttgcgatgcaa

SEQ ID NO: 19009 - DNA, 37 bp, Artificial Sequence
  Synthetic oligonucleotide
gcaggggcgaacgggtaaacgggagagggggatagga

SEQ ID NO: 19010 - DNA, 35 bp, Artificial Sequence
  Synthetic oligonucleotide
tagccgcacctaacgtgctgttccttactcccgta

SEQ ID NO: 19011 - DNA, 35 bp, Artificial Sequence
  Synthetic oligonucleotide
gctccactggagtcacccagctcctcttgcctctc

SEQ ID NO: 19012 - DNA, 35 bp, Artificial Sequence
  Synthetic oligonucleotide
ttcgcgcaacacctcgctcacagtatcgccgcctg

SEQ ID NO: 19013 - DNA, 36 bp, Artificial Sequence
  Synthetic oligonucleotide
tctgtgtcccgcatctctatactctacgccacttca

SEQ ID NO: 19014 - DNA, 38 bp, Artificial Sequence
  Synthetic oligonucleotide
gcctgtgccatcacgcgttatcctgttctttcgtatga

SEQ ID NO: 19015 - DNA, 36 bp, Artificial Sequence
  Synthetic oligonucleotide
actcatcctgaactgactaggcctatcactcctgta

SEQ ID NO: 19016 - DNA, 35 bp, Artificial Sequence
  Synthetic oligonucleotide
gcggtctgccgccgcacaatggcctttatcgttcc

SEQ ID NO: 19017 - DNA, 35 bp, Artificial Sequence
  Synthetic oligonucleotide
acgtgccgtcactgctcggcgccttaccatcatca

SEQ ID NO: 19018 - DNA, 35 bp, Artificial Sequence
  Synthetic oligonucleotide
acgcccaccacaatactggggctagctttacttca

SEQ ID NO: 19019 - DNA, 37 bp, Artificial Sequence
  Synthetic oligonucleotide
tcccccccactatcatttttgctgtccgtcactttga

SEQ ID NO: 19020 - DNA, 36 bp, Artificial Sequence
  Synthetic oligonucleotide
atacccctcgcaccatctgtttacttcttaagtgta

SEQ ID NO: 19021 - DNA, 35 bp, Artificial Sequence
  Synthetic oligonucleotide
gtagcccgggccattccgtcgttattttatgttcc

SEQ ID NO: 19022 - DNA, 36 bp, Artificial Sequence
  Synthetic oligonucleotide
atgcacaactcccgtccctgcatctttagactctca

SEQ ID NO: 19023 - DNA, 37 bp, Artificial Sequence
  Synthetic oligonucleotide
gccacacgtccatctcgagtccacgttcaatgtccga

SEQ ID NO: 19024 - DNA, 35 bp, Artificial Sequence
  Synthetic oligonucleotide
gccgccccctcgtccatacggcttgtcgtcgcctc

SEQ ID NO: 19025 - DNA, 35 bp, Artificial Sequence
  Synthetic oligonucleotide
gctcaggtgggaggcgggtgggttggtgcttcggt

SEQ ID NO: 19026 - DNA, 35 bp, Artificial Sequence
  Synthetic oligonucleotide
cacgaacgcaccagtttcgtccaccccctaatgtt

SEQ ID NO: 19027 - DNA, 36 bp, Artificial Sequence
  Synthetic oligonucleotide
gcaacacacacttccacagtccggacgataagacga

SEQ ID NO: 19028 - DNA, 35 bp, Artificial Sequence
  Synthetic oligonucleotide
tcatgcaccaaattcggttactgccttttcgacga

SEQ ID NO: 19029 - DNA, 38 bp, Artificial Sequence
  Synthetic oligonucleotide
gtaccgccctgacgcactcgttccgttacccctggtga

SEQ ID NO: 19030 - DNA, 35 bp, Artificial Sequence
  Synthetic oligonucleotide
gcgcacccttccctgccgtttcatcgtaaggtgcc

SEQ ID NO: 19031 - DNA, 35 bp, Artificial Sequence
  Synthetic oligonucleotide
tcccgccagggatatctccctcgcaaccatgcctc

SEQ ID NO: 19032 - DNA, 35 bp, Artificial Sequence
  Synthetic oligonucleotide
gcttggtcctgctccataatgcccaccctatcccg

SEQ ID NO: 19033 - DNA, 35 bp, Artificial Sequence
  Synthetic oligonucleotide
tcgtcccctcatcagtctatcggtacgtgccttct

SEQ ID NO: 19034 - DNA, 35 bp, Artificial Sequence
  Synthetic oligonucleotide
gcccttccacgccgctctgggctacatgcccactt

SEQ ID NO: 19035 - DNA, 37 bp, Artificial Sequence
  Synthetic oligonucleotide
gactgccccgccccctataaacgaacgtctataccga

SEQ ID NO: 19036 - DNA, 37 bp, Artificial Sequence
  Synthetic oligonucleotide
acgccacggcggatccctttctcaccctgcgtgccga

SEQ ID NO: 19037 - DNA, 37 bp, Artificial Sequence
  Synthetic oligonucleotide
actccacttcccgactatctgtactgtacaccagtga

SEQ ID NO: 19038 - DNA, 36 bp, Artificial Sequence
  Synthetic oligonucleotide
ttagcactatgccggtcctcgccaccactcgcaata

SEQ ID NO: 19039 - DNA, 35 bp, Artificial Sequence
  Synthetic oligonucleotide
gttcatgcaccccgttcgttaccggtctcttaacc

SEQ ID NO: 19040 - DNA, 35 bp, Artificial Sequence
  Synthetic oligonucleotide
tccccgccgtaggttcgttactatacacctgggtc

SEQ ID NO: 19041 - DNA, 35 bp, Artificial Sequence
  Synthetic oligonucleotide
tgagaacaaggacgggacacgaagagggacaggcg

SEQ ID NO: 19042 - DNA, 35 bp, Artificial Sequence
  Synthetic oligonucleotide
tgctggtgcacgctctgtccaatctgcagttttcc

SEQ ID NO: 19043 - DNA, 35 bp, Artificial Sequence
  Synthetic oligonucleotide
ttacaccgtaccatactctgttccttcatctgtgc

SEQ ID NO: 19044 - DNA, 35 bp, Artificial Sequence
  Synthetic oligonucleotide
gcgtgacgacgtacacccttttgatcataatgcct

SEQ ID NO: 19045 - DNA, 36 bp, Artificial Sequence
  Synthetic oligonucleotide
gatgccatgaggggggggaacgactgacaggcgaaa

SEQ ID NO: 19046 - DNA, 37 bp, Artificial Sequence
  Synthetic oligonucleotide
gtggatagggtgagggtgggaacgtatcgtgatggga

SEQ ID NO: 19047 - DNA, 38 bp, Artificial Sequence
  Synthetic oligonucleotide
gaacgctccacatcgcactgccggtattcatcccctga

SEQ ID NO: 19048 - DNA, 35 bp, Artificial Sequence
  Synthetic oligonucleotide
gcccagccccgccgtctctcgaatgtctcctgtta

SEQ ID NO: 19049 - DNA, 35 bp, Artificial Sequence
  Synthetic oligonucleotide
gttggctggtcaaccgagcagcagacacttctcac

SEQ ID NO: 19050 - DNA, 35 bp, Artificial Sequence
  Synthetic oligonucleotide
tatgctccatgcaacaacccagcacctcaccggac

SEQ ID NO: 19051 - DNA, 35 bp, Artificial Sequence
  Synthetic oligonucleotide
tgcccgtcagtccgctgtcgccaaatccagtcccc

SEQ ID NO: 19052 - DNA, 35 bp, Artificial Sequence
  Synthetic oligonucleotide
agggtcgcactcacttcttatgttcctgcctggcc

SEQ ID NO: 19053 - DNA, 35 bp, Artificial Sequence
  Synthetic oligonucleotide
tgacgctgcgttaatcagttcaccccccgtctatc

SEQ ID NO: 19054 - DNA, 35 bp, Artificial Sequence
  Synthetic oligonucleotide
tgaatctgcctgctttgtcctcgagttccctagcg

SEQ ID NO: 19055 - DNA, 35 bp, Artificial Sequence
  Synthetic oligonucleotide
gatgacatacgagtaggggaggaggggctcacgcg

SEQ ID NO: 19056 - DNA, 35 bp, Artificial Sequence
  Synthetic oligonucleotide
gagaccagacaccagcccgctgcttcctcctccca

SEQ ID NO: 19057 - DNA, 36 bp, Artificial Sequence
  Synthetic oligonucleotide
acaccctatcctatctgatgcatgtacgttttgcca

SEQ ID NO: 19058 - DNA, 36 bp, Artificial Sequence
  Synthetic oligonucleotide
tacgcaagctgcattaaatcgaattgtgctctctca

SEQ ID NO: 19059 - DNA, 36 bp, Artificial Sequence
  Synthetic oligonucleotide
atccaccctcgacctgatatatttggcgtacaccga

SEQ ID NO: 19060 - DNA, 38 bp, Artificial Sequence
  Synthetic oligonucleotide
gacgcagatctccgaacccttgatactacctgctatga

SEQ ID NO: 19061 - DNA, 35 bp, Artificial Sequence
  Synthetic oligonucleotide
gtgcgtgacctacattgttaccatgtcccgctata

SEQ ID NO: 19062 - DNA, 35 bp, Artificial Sequence
  Synthetic oligonucleotide
gcaagtcgccgcgaatcagtctacccctcctacgc

SEQ ID NO: 19063 - DNA, 35 bp, Artificial Sequence
  Synthetic oligonucleotide
taaccgcggccaaacacttctaggctttacttact

SEQ ID NO: 19064 - DNA, 35 bp, Artificial Sequence
  Synthetic oligonucleotide
tcacaggactgcctgcgtgttccggtcctttactt

SEQ ID NO: 19065 - DNA, 35 bp, Artificial Sequence
  Synthetic oligonucleotide
attcatacgccaccctttatctcgtccactgcgaa

SEQ ID NO: 19066 - DNA, 35 bp, Artificial Sequence
  Synthetic oligonucleotide
agattcctcccacatgcatgccgccgcccatccga

SEQ ID NO: 19067 - DNA, 38 bp, Artificial Sequence
  Synthetic oligonucleotide
gaggagagtggaaggtggtggggggtacaagaacgtga

SEQ ID NO: 19068 - DNA, 37 bp, Artificial Sequence
  Synthetic oligonucleotide
gccatcccccaacgcgtttagcgatccaaagttttga

SEQ ID NO: 19069 - DNA, 35 bp, Artificial Sequence
  Synthetic oligonucleotide
aacctgtgtttcgttcgtactaccacccgagtctc

SEQ ID NO: 19070 - DNA, 35 bp, Artificial Sequence
  Synthetic oligonucleotide
tccaccccttttccaccatggttgccctcggtggg

SEQ ID NO: 19071 - DNA, 35 bp, Artificial Sequence
  Synthetic oligonucleotide
tctgtatcccccgaccgcacttggttcatgtaatt

SEQ ID NO: 19072 - DNA, 35 bp, Artificial Sequence
  Synthetic oligonucleotide
accagctcgcccaaccgcctattttaccctgcgca

SEQ ID NO: 19073 - DNA, 37 bp, Artificial Sequence
  Synthetic oligonucleotide
acatggggtgttgcaaggggggcgtggggccaagaga

SEQ ID NO: 19074 - DNA, 37 bp, Artificial Sequence
  Synthetic oligonucleotide
atttcgcacgcacacttctctagctactcgatttcga

SEQ ID NO: 19075 - DNA, 38 bp, Artificial Sequence
  Synthetic oligonucleotide
atggtaccattcgacgcaaatcatcaggaacacactga

SEQ ID NO: 19076 - DNA, 38 bp, Artificial Sequence
  Synthetic oligonucleotide
ttgccgccgccccgcgttttagctccttatcattctga

SEQ ID NO: 19077 - DNA, 35 bp, Artificial Sequence
  Synthetic oligonucleotide
ggaagccacttgctgccctcctggtgcccgttctc

SEQ ID NO: 19078 - DNA, 35 bp, Artificial Sequence
  Synthetic oligonucleotide
gagcatggtgggaggaagtcaagtttcgaagtggg

SEQ ID NO: 19079 - DNA, 35 bp, Artificial Sequence
  Synthetic oligonucleotide
acgacgcccgcacgccccctcccgtcacaacagct

SEQ ID NO: 19080 - DNA, 36 bp, Artificial Sequence
  Synthetic oligonucleotide
tctgagtcctctgtctgccctgttgtactgccccca

SEQ ID NO: 19081 - DNA, 37 bp, Artificial Sequence
  Synthetic oligonucleotide
gcgaagagacgggttgggtaggggtagtgaagtgtga

SEQ ID NO: 19082 - DNA, 35 bp, Artificial Sequence
  Synthetic oligonucleotide
gtgcccatcctcacattccccaacaactgctacta

SEQ ID NO: 19083 - DNA, 35 bp, Artificial Sequence
  Synthetic oligonucleotide
gagtgacgcccccacccatctgacgaacataatta

SEQ ID NO: 19084 - DNA, 35 bp, Artificial Sequence
  Synthetic oligonucleotide
aacgcccgcgacctccattgaccacccgacgtgcc

SEQ ID NO: 19085 - DNA, 35 bp, Artificial Sequence
  Synthetic oligonucleotide
tgaccccttttattgcaaacctcgcgtactcgccg

SEQ ID NO: 19086 - DNA, 33 bp, Artificial Sequence
  Synthetic oligonucleotide
acctactccggacccccctgtttcgaaaactat

SEQ ID NO: 19087 - DNA, 35 bp, Artificial Sequence
  Synthetic oligonucleotide
gtgccactcccttgtgccgttattcggaaatccct

SEQ ID NO: 19088 - DNA, 35 bp, Artificial Sequence
  Synthetic oligonucleotide
agggatggagtgggatacggtaagcatggtggggt

SEQ ID NO: 19089 - DNA, 38 bp, Artificial Sequence
  Synthetic oligonucleotide
accaacatcgctctgtagtccgtaccttacacccttga

SEQ ID NO: 19090 - DNA, 36 bp, Artificial Sequence
  Synthetic oligonucleotide
ggatcccacctgtctatcacccactactccagctta

SEQ ID NO: 19091 - DNA, 35 bp, Artificial Sequence
  Synthetic oligonucleotide
acctacgctaatacgtacacgtgcgaatcccctcc

SEQ ID NO: 19092 - DNA, 35 bp, Artificial Sequence
  Synthetic oligonucleotide
tcccctccactgttcaccatgcgatcccttaggtc

SEQ ID NO: 19093 - DNA, 35 bp, Artificial Sequence
  Synthetic oligonucleotide
gttgccctccgaccttacatgcacgtgacggtgct

SEQ ID NO: 19094 - DNA, 35 bp, Artificial Sequence
  Synthetic oligonucleotide
tacctgtccatatcgcctgacctcgccgaggctct

SEQ ID NO: 19095 - DNA, 36 bp, Artificial Sequence
  Synthetic oligonucleotide
tgccccacccggtccgtatgggattcctcctttgta

SEQ ID NO: 19096 - DNA, 35 bp, Artificial Sequence
  Synthetic oligonucleotide
tctgtcgttgctactgttatccgcgcccctacatc

SEQ ID NO: 19097 - DNA, 35 bp, Artificial Sequence
  Synthetic oligonucleotide
ttgactgcccccctgatcttgcagagcctccatgg

SEQ ID NO: 19098 - DNA, 35 bp, Artificial Sequence
  Synthetic oligonucleotide
tagtgagggatgggggatgaatggtgcgagtgttt

SEQ ID NO: 19099 - DNA, 36 bp, Artificial Sequence
  Synthetic oligonucleotide
gcaccgctctggtgtacgtcctactcattttgccaa

SEQ ID NO: 19100 - DNA, 36 bp, Artificial Sequence
  Synthetic oligonucleotide
tcctgcgtacaggaccacacccgggctgccccttaa

SEQ ID NO: 19101 - DNA, 36 bp, Artificial Sequence
  Synthetic oligonucleotide
tccaatcatgcaatggctctacggtacaccccacca

SEQ ID NO: 19102 - DNA, 36 bp, Artificial Sequence
  Synthetic oligonucleotide
tcgctaccgctgctaactacctccatctgggatgca

SEQ ID NO: 19103 - DNA, 38 bp, Artificial Sequence
  Synthetic oligonucleotide
actcaaggcctttgtcggtttttggcccttccttctga

SEQ ID NO: 19104 - DNA, 37 bp, Artificial Sequence
  Synthetic oligonucleotide
acgacccggctaggggtaggggaggtaggtaatgtga

SEQ ID NO: 19105 - DNA, 35 bp, Artificial Sequence
  Synthetic oligonucleotide
tcctcatacgcccggctcattaaacacacagaacc

SEQ ID NO: 19106 - DNA, 35 bp, Artificial Sequence
  Synthetic oligonucleotide
gatatcaaccccgcctagattgcatggccctgacc

SEQ ID NO: 19107 - DNA, 35 bp, Artificial Sequence
  Synthetic oligonucleotide
gcacggggtgttcgttatcttatatggctgcctcc

SEQ ID NO: 19108 - DNA, 35 bp, Artificial Sequence
  Synthetic oligonucleotide
tctcacgcatcaccgcccctagctacttccattag

SEQ ID NO: 19109 - DNA, 35 bp, Artificial Sequence
  Synthetic oligonucleotide
tgaaagagagagtacggggtgtaacaggggggacg

SEQ ID NO: 19110 - DNA, 35 bp, Artificial Sequence
  Synthetic oligonucleotide
tccccaccccgcacgttctctatcatagctggcct

SEQ ID NO: 19111 - DNA, 38 bp, Artificial Sequence
  Synthetic oligonucleotide
agacccgcccaatccccctgctttgttcacggtcgtga

SEQ ID NO: 19112 - DNA, 35 bp, Artificial Sequence
  Synthetic oligonucleotide
gcacctctgatagcgccacccaacttccctacgta

SEQ ID NO: 19113 - DNA, 35 bp, Artificial Sequence
  Synthetic oligonucleotide
gatgtcgtgccacattagtcttccctgcactctgc

SEQ ID NO: 19114 - DNA, 35 bp, Artificial Sequence
  Synthetic oligonucleotide
tccggacctgcctgcactctccggccattatcatc

SEQ ID NO: 19115 - DNA, 35 bp, Artificial Sequence
  Synthetic oligonucleotide
gatccacccacatgcaatcaatgcacaaatgtgtc

SEQ ID NO: 19116 - DNA, 35 bp, Artificial Sequence
  Synthetic oligonucleotide
tctcccccgccttacgaaaccaaacaggtggtttt

SEQ ID NO: 19117 - DNA, 35 bp, Artificial Sequence
  Synthetic oligonucleotide
gcgacgctcacattgacatacaccactcgcccgga

SEQ ID NO: 19118 - DNA, 38 bp, Artificial Sequence
  Synthetic oligonucleotide
ttcgcgccgccaggtgattcccagccccttcatcatga

SEQ ID NO: 19119 - DNA, 38 bp, Artificial Sequence
  Synthetic oligonucleotide
tcctacccgacgccacacttctgtcaaagtcaatttga

SEQ ID NO: 19120 - DNA, 36 bp, Artificial Sequence
  Synthetic oligonucleotide
tctacgtcactgcccttcacgtcacacgattagtta

SEQ ID NO: 19121 - DNA, 35 bp, Artificial Sequence
  Synthetic oligonucleotide
tatatcaccggcgcccataatcctccatcatccac

SEQ ID NO: 19122 - DNA, 35 bp, Artificial Sequence
  Synthetic oligonucleotide
tcaaacaggccgctctccccaagtcttagtcgcac

SEQ ID NO: 19123 - DNA, 35 bp, Artificial Sequence
  Synthetic oligonucleotide
gacccatcctgttacacttgctattctaagcatcg

SEQ ID NO: 19124 - DNA, 35 bp, Artificial Sequence
  Synthetic oligonucleotide
ttgtgctccgtgctcacctatacattaccttcagt

SEQ ID NO: 19125 - DNA, 35 bp, Artificial Sequence
  Synthetic oligonucleotide
gaccatgtcacatatcgattcaccactcggacaaa

SEQ ID NO: 19126 - DNA, 36 bp, Artificial Sequence
  Synthetic oligonucleotide
tgcttctcctcacctgccttaactgacattcggtca

SEQ ID NO: 19127 - DNA, 37 bp, Artificial Sequence
  Synthetic oligonucleotide
tgactcccttgacctgccactgcgccgatcctttgga

SEQ ID NO: 19128 - DNA, 35 bp, Artificial Sequence
  Synthetic oligonucleotide
ttgcgaccgcctgacactccaatagtcaacccccc

SEQ ID NO: 19129 - DNA, 35 bp, Artificial Sequence
  Synthetic oligonucleotide
gatcacccattggagtggacttaatacttgcctcc

SEQ ID NO: 19130 - DNA, 35 bp, Artificial Sequence
  Synthetic oligonucleotide
gtggtgtgagttggggggggtagggactgtgcggc

SEQ ID NO: 19131 - DNA, 35 bp, Artificial Sequence
  Synthetic oligonucleotide
tgagcgggggggtggggagggagcaatatcgtaag

SEQ ID NO: 19132 - DNA, 35 bp, Artificial Sequence
  Synthetic oligonucleotide
acatcccgtaggcagtacctgttgtttggtccctt

SEQ ID NO: 19133 - DNA, 36 bp, Artificial Sequence
  Synthetic oligonucleotide
acgcccgcccctccatccggttgaagccatagctca

SEQ ID NO: 19134 - DNA, 36 bp, Artificial Sequence
  Synthetic oligonucleotide
accctcaccgcgcatgcatgtcttctaacttcccga

SEQ ID NO: 19135 - DNA, 38 bp, Artificial Sequence
  Synthetic oligonucleotide
gcgaactccaaatgctaccccccctcgcatgtccctga

SEQ ID NO: 19136 - DNA, 38 bp, Artificial Sequence
  Synthetic oligonucleotide
acaaccgcgcggtcctgcttcaactgactcaaccttga

SEQ ID NO: 19137 - DNA, 38 bp, Artificial Sequence
  Synthetic oligonucleotide
gatgccacgtaagggaatgggggcggaatgggtgttga

SEQ ID NO: 19138 - DNA, 35 bp, Artificial Sequence
  Synthetic oligonucleotide
acataccttctcagccccagatgtactgctttcca

SEQ ID NO: 19139 - DNA, 37 bp, Artificial Sequence
  Synthetic oligonucleotide
gcggtgggaactgggaaagggaatacgggtagggaga

SEQ ID NO: 19140 - DNA, 37 bp, Artificial Sequence
  Synthetic oligonucleotide
ttcagccccacagtgatcgattgtgtgcccctctcga

SEQ ID NO: 19141 - DNA, 35 bp, Artificial Sequence
  Synthetic oligonucleotide
gcactcctgcgcctggcccctaatcttactctttc

SEQ ID NO: 19142 - DNA, 35 bp, Artificial Sequence
  Synthetic oligonucleotide
actgcacacaaagcttatgagcaacctcacccgtt

SEQ ID NO: 19143 - DNA, 35 bp, Artificial Sequence
  Synthetic oligonucleotide
accgtacatggccagatccaccactctatgtcaca

SEQ ID NO: 19144 - DNA, 38 bp, Artificial Sequence
  Synthetic oligonucleotide
gccctgccccacactagtgagctttttgacagccctga

SEQ ID NO: 19145 - DNA, 36 bp, Artificial Sequence
  Synthetic oligonucleotide
gtgccacctcattcactatgtagccttgtgtcccta

SEQ ID NO: 19146 - DNA, 35 bp, Artificial Sequence
  Synthetic oligonucleotide
taagtcccgcaattcaccccgcccctaaggagccc

SEQ ID NO: 19147 - DNA, 35 bp, Artificial Sequence
  Synthetic oligonucleotide
gtgcaggccccatcccaaccttagtcagcaattgc

SEQ ID NO: 19148 - DNA, 35 bp, Artificial Sequence
  Synthetic oligonucleotide
ttgacctggcgcaccctccttaacgtactttgttg

SEQ ID NO: 19149 - DNA, 36 bp, Artificial Sequence
  Synthetic oligonucleotide
gcacgcgcgacatcgcttacaccctccccgctgcca

SEQ ID NO: 19150 - DNA, 36 bp, Artificial Sequence
  Synthetic oligonucleotide
gtcttagccacctgctctgttccgattcctgacgga

SEQ ID NO: 19151 - DNA, 35 bp, Artificial Sequence
  Synthetic oligonucleotide
tcccatgtccttcctgtatcggctggcccacatcg

SEQ ID NO: 19152 - DNA, 35 bp, Artificial Sequence
  Synthetic oligonucleotide
tgatggcccgggccgtcctttattggttccattcg

SEQ ID NO: 19153 - DNA, 36 bp, Artificial Sequence
  Synthetic oligonucleotide
tgccattccccctggccattcctgttgcctcgttaa

SEQ ID NO: 19154 - DNA, 36 bp, Artificial Sequence
  Synthetic oligonucleotide
tgttacccgctcgccacatcccgcgttcaagcgata

SEQ ID NO: 19155 - DNA, 35 bp, Artificial Sequence
  Synthetic oligonucleotide
gcatcgcggcactgtgccgattttcccctcccatc

SEQ ID NO: 19156 - DNA, 35 bp, Artificial Sequence
  Synthetic oligonucleotide
gtgcggtacagattgatgctcctctactcctattg

SEQ ID NO: 19157 - DNA, 36 bp, Artificial Sequence
  Synthetic oligonucleotide
gtccttctgcctcaccgcctccacgctccgcaggaa

SEQ ID NO: 19158 - DNA, 37 bp, Artificial Sequence
  Synthetic oligonucleotide
gcgccccatcactatttcaaaaacctgcactcttgga

SEQ ID NO: 19159 - DNA, 37 bp, Artificial Sequence
  Synthetic oligonucleotide
ttacaacaccaccatcacaagagcagtctccggttga

SEQ ID NO: 19160 - DNA, 35 bp, Artificial Sequence
  Synthetic oligonucleotide
tcattcccgtcccgcatgtacacacctcgccgacg

SEQ ID NO: 19161 - DNA, 35 bp, Artificial Sequence
  Synthetic oligonucleotide
ttcagcctgccgaatccctatcatccccggtcatt

SEQ ID NO: 19162 - DNA, 35 bp, Artificial Sequence
  Synthetic oligonucleotide
gatgaccccatggtatttccgccccctgccgagtt

SEQ ID NO: 19163 - DNA, 36 bp, Artificial Sequence
  Synthetic oligonucleotide
gacaccagccgcgatcaacatacgactctcatgcaa

SEQ ID NO: 19164 - DNA, 35 bp, Artificial Sequence
  Synthetic oligonucleotide
acgctacccatgcgtatcgtcatagcaatcttacc

SEQ ID NO: 19165 - DNA, 35 bp, Artificial Sequence
  Synthetic oligonucleotide
acttccccccacttgtaatggcagctccctcgttc

SEQ ID NO: 19166 - DNA, 36 bp, Artificial Sequence
  Synthetic oligonucleotide
gcatgcccaccacgcagcgtacctttgccgatctaa

SEQ ID NO: 19167 - DNA, 38 bp, Artificial Sequence
  Synthetic oligonucleotide
ggaacaaaggtcgggggggagtcgggatagaatgttga

SEQ ID NO: 19168 - DNA, 37 bp, Artificial Sequence
  Synthetic oligonucleotide
gaaccacgcgttcccttacgtttggtgatctttttga

SEQ ID NO: 19169 - DNA, 35 bp, Artificial Sequence
  Synthetic oligonucleotide
tacatctgcccactctttgacatccctgacatagc

SEQ ID NO: 19170 - DNA, 36 bp, Artificial Sequence
  Synthetic oligonucleotide
tgacgcccctgtcccccatttttagcaagcattcgg

SEQ ID NO: 19171 - DNA, 35 bp, Artificial Sequence
  Synthetic oligonucleotide
ttttacccccgttcgtcacgtgcatcccccctttt

SEQ ID NO: 19172 - DNA, 37 bp, Artificial Sequence
  Synthetic oligonucleotide
gacccaccggtcagagctcgttaccatcaattccaga

SEQ ID NO: 19173 - DNA, 37 bp, Artificial Sequence
  Synthetic oligonucleotide
accttctacgcacttttcttagccgcatcctccgtga

SEQ ID NO: 19174 - DNA, 35 bp, Artificial Sequence
  Synthetic oligonucleotide
ttgtagcccgcctacccccagccaccgattcatgc

SEQ ID NO: 19175 - DNA, 36 bp, Artificial Sequence
  Synthetic oligonucleotide
acttaggggggaacggaaggttacttgggaggagga

SEQ ID NO: 19176 - DNA, 36 bp, Artificial Sequence
  Synthetic oligonucleotide
tagagaaggcacgaggggacgggagtggaatttgga

SEQ ID NO: 19177 - DNA, 38 bp, Artificial Sequence
  Synthetic oligonucleotide
tgatgcctcacttcatccattcgaacgacatcacatga

SEQ ID NO: 19178 - DNA, 38 bp, Artificial Sequence
  Synthetic oligonucleotide
gccgattgccctaggtctgttaaaactcttcgccctga

SEQ ID NO: 19179 - DNA, 36 bp, Artificial Sequence
  Synthetic oligonucleotide
ttggcccctaccgaacctgtgccgcctccgtattga

SEQ ID NO: 19180 - DNA, 38 bp, Artificial Sequence
  Synthetic oligonucleotide
tgccatgcaacaccatgctcgtactcatttatttttga

SEQ ID NO: 19181 - DNA, 35 bp, Artificial Sequence
  Synthetic oligonucleotide
attcaccccagtccgttttccgatcgcagtttggc

SEQ ID NO: 19182 - DNA, 35 bp, Artificial Sequence
  Synthetic oligonucleotide
gtccgggcaggcatatttcggttatggcatttctc

SEQ ID NO: 19183 - DNA, 36 bp, Artificial Sequence
  Synthetic oligonucleotide
gccctcagccctcctgtctattattcttacgcctaa

SEQ ID NO: 19184 - DNA, 35 bp, Artificial Sequence
  Synthetic oligonucleotide
gagagaacccgcctgactactgctgaaacgtacca

SEQ ID NO: 19185 - DNA, 36 bp, Artificial Sequence
  Synthetic oligonucleotide
gccgactgcacccccatcctacgagcttgatctcca

SEQ ID NO: 19186 - DNA, 36 bp, Artificial Sequence
  Synthetic oligonucleotide
ttcgcctcaatatgcccaaccaccgtagcccctcta

SEQ ID NO: 19187 - DNA, 36 bp, Artificial Sequence
  Synthetic oligonucleotide
tcgacccccacctgttcactcttctctcgtccagca

SEQ ID NO: 19188 - DNA, 37 bp, Artificial Sequence
  Synthetic oligonucleotide
agagagtagggacacaggggtaggggagccggggtga

SEQ ID NO: 19189 - DNA, 37 bp, Artificial Sequence
  Synthetic oligonucleotide
tgaccctaccctcagcaggtagtttctcaccatttga

SEQ ID NO: 19190 - DNA, 28 bp, Artificial Sequence
  Synthetic oligonucleotide
ggtgcctaagcaccatattacctcacac

SEQ ID NO: 19191 - DNA, 35 bp, Artificial Sequence
  Synthetic oligonucleotide
tccactgcaggttgggaacacctcagattcttgcc

SEQ ID NO: 19192 - DNA, 35 bp, Artificial Sequence
  Synthetic oligonucleotide
gcaacaacgctccatctgcttcctcattcctgcag

SEQ ID NO: 19193 - DNA, 35 bp, Artificial Sequence
  Synthetic oligonucleotide
taaggcaaccatccctcagtctacccggcctacct

SEQ ID NO: 19194 - DNA, 36 bp, Artificial Sequence
  Synthetic oligonucleotide
gccactatcacacgtttcaagcccgtgttttcccaa

SEQ ID NO: 19195 - DNA, 35 bp, Artificial Sequence
  Synthetic oligonucleotide
actcccctccctgccagctaattgctcctattgca

SEQ ID NO: 19196 - DNA, 37 bp, Artificial Sequence
  Synthetic oligonucleotide
gaacaacagttcccggtctctttctccatccacatga

SEQ ID NO: 19197 - DNA, 36 bp, Artificial Sequence
  Synthetic oligonucleotide
tcaaccgcaccactgtacccttcatgtattagctga

SEQ ID NO: 19198 - DNA, 38 bp, Artificial Sequence
  Synthetic oligonucleotide
gacctccgccataaatgcattttgttcttacttcgtga

SEQ ID NO: 19199 - DNA, 35 bp, Artificial Sequence
  Synthetic oligonucleotide
gagagtgcctacgatccgaactgaacatcctcccg

SEQ ID NO: 19200 - DNA, 35 bp, Artificial Sequence
  Synthetic oligonucleotide
ttggcccacagccgacagtcatccaccgctttctc

SEQ ID NO: 19201 - DNA, 35 bp, Artificial Sequence
  Synthetic oligonucleotide
acgaccagagtaataaccaccgctccctctaaacg

SEQ ID NO: 19202 - DNA, 35 bp, Artificial Sequence
  Synthetic oligonucleotide
gtgggggaggaaacgggggcattagagcgccgtgg

SEQ ID NO: 19203 - DNA, 35 bp, Artificial Sequence
  Synthetic oligonucleotide
tccggtatgccgtctccccgtttgtccgttaccgt

SEQ ID NO: 19204 - DNA, 37 bp, Artificial Sequence
  Synthetic oligonucleotide
agtaggggaggaagggcgaaacgggactcaagtgcga

SEQ ID NO: 19205 - DNA, 38 bp, Artificial Sequence
  Synthetic oligonucleotide
tcagtacgctcacacgccattagggccttcttttctga

SEQ ID NO: 19206 - DNA, 37 bp, Artificial Sequence
  Synthetic oligonucleotide
tccgtcacctatcagcaggggccttatccttcattga

SEQ ID NO: 19207 - DNA, 38 bp, Artificial Sequence
  Synthetic oligonucleotide
tacggtgcgcacgaccacaaacgccacgaacaccttga

SEQ ID NO: 19208 - DNA, 35 bp, Artificial Sequence
  Synthetic oligonucleotide
gtagaaagccaaaggttatggggggaaggtagacg

SEQ ID NO: 19209 - DNA, 35 bp, Artificial Sequence
  Synthetic oligonucleotide
tctcgtacgccatctggtcgtatgctatcctcttt

SEQ ID NO: 19210 - DNA, 36 bp, Artificial Sequence
  Synthetic oligonucleotide
tcacccacttcacgcctctactgaggtagttaaaaa

SEQ ID NO: 19211 - DNA, 36 bp, Artificial Sequence
  Synthetic oligonucleotide
acttgcgcactccgcggtgggccttcctctatttca

SEQ ID NO: 19212 - DNA, 38 bp, Artificial Sequence
  Synthetic oligonucleotide
tgccctaaaccgacgctgcgcctgccctaccatattga

SEQ ID NO: 19213 - DNA, 35 bp, Artificial Sequence
  Synthetic oligonucleotide
gtcctgcgaacactctgacccctttatccgcgcgc

SEQ ID NO: 19214 - DNA, 35 bp, Artificial Sequence
  Synthetic oligonucleotide
aaaggtggagaagtgcgtggctggcaggggaaagg

SEQ ID NO: 19215 - DNA, 35 bp, Artificial Sequence
  Synthetic oligonucleotide
acgttgtgtaacttggtttttttgcctcattccct

SEQ ID NO: 19216 - DNA, 35 bp, Artificial Sequence
  Synthetic oligonucleotide
tgagatgtgtctccgttgctctgcctccatttttt

SEQ ID NO: 19217 - DNA, 36 bp, Artificial Sequence
  Synthetic oligonucleotide
gatctgcccccgccgcaatatgcgagatctgaatca

SEQ ID NO: 19218 - DNA, 35 bp, Artificial Sequence
  Synthetic oligonucleotide
tccctgcacgcgccttggtgcccacccccctacac

SEQ ID NO: 19219 - DNA, 35 bp, Artificial Sequence
  Synthetic oligonucleotide
gacaccaggtattctgcaccttatagccctgtcct

SEQ ID NO: 19220 - DNA, 35 bp, Artificial Sequence
  Synthetic oligonucleotide
ggtacacgccccacggtcaaaggcccctacactgt

SEQ ID NO: 19221 - DNA, 37 bp, Artificial Sequence
  Synthetic oligonucleotide
gggggtggagaaggtggtgatgaggaatgtaagcaga

SEQ ID NO: 19222 - DNA, 36 bp, Artificial Sequence
  Synthetic oligonucleotide
tgccactctgccacgcacgttacaacaccaggtgta

SEQ ID NO: 19223 - DNA, 36 bp, Artificial Sequence
  Synthetic oligonucleotide
tcgaccccactcacgtgctacaccccaaagttcgtc

SEQ ID NO: 19224 - DNA, 35 bp, Artificial Sequence
  Synthetic oligonucleotide
gaccaggcactcgaaaacagccccccgacctcatt

SEQ ID NO: 19225 - DNA, 35 bp, Artificial Sequence
  Synthetic oligonucleotide
gcccactcgccgtcgaatggcgcattacgtttctt

SEQ ID NO: 19226 - DNA, 36 bp, Artificial Sequence
  Synthetic oligonucleotide
tcactcactggtcaccgctcagtacatcgcttctca

SEQ ID NO: 19227 - DNA, 37 bp, Artificial Sequence
  Synthetic oligonucleotide
tccaggggtaggggagtgggggaattcacgtacggga

SEQ ID NO: 19228 - DNA, 35 bp, Artificial Sequence
  Synthetic oligonucleotide
aactcacgccaatacacgttccgacgcaaaccgcc

SEQ ID NO: 19229 - DNA, 35 bp, Artificial Sequence
  Synthetic oligonucleotide
tatctacgcacccgactctcggtatgcctgccctc

SEQ ID NO: 19230 - DNA, 35 bp, Artificial Sequence
  Synthetic oligonucleotide
tctcaagcccatgaacgccgccctttcctatacgt

SEQ ID NO: 19231 - DNA, 37 bp, Artificial Sequence
  Synthetic oligonucleotide
accacttgctgatccgctcctactcgcctttcccgga

SEQ ID NO: 19232 - DNA, 37 bp, Artificial Sequence
  Synthetic oligonucleotide
atgggggagacgaagtttgtgtgggtggtgtggggga

SEQ ID NO: 19233 - DNA, 36 bp, Artificial Sequence
  Synthetic oligonucleotide
tcgccgggccccgctgcctacttgcacaaatcctta

SEQ ID NO: 19234 - DNA, 35 bp, Artificial Sequence
  Synthetic oligonucleotide
tccctgtccgacgaatatgctaacacgtaactgtc

SEQ ID NO: 19235 - DNA, 36 bp, Artificial Sequence
  Synthetic oligonucleotide
ggacgacccctatctcgcctcagttcatgaacgcca

SEQ ID NO: 19236 - DNA, 37 bp, Artificial Sequence
  Synthetic oligonucleotide
tccttgccatcgaccggctctacttgtctttctccga

SEQ ID NO: 19237 - DNA, 35 bp, Artificial Sequence
  Synthetic oligonucleotide
acaaccacgcgctaccttcgccgtacaacccaccc

SEQ ID NO: 19238 - DNA, 35 bp, Artificial Sequence
  Synthetic oligonucleotide
tcagcccctcaattctgcaaacgtggcattgcctc

SEQ ID NO: 19239 - DNA, 35 bp, Artificial Sequence
  Synthetic oligonucleotide
tgcaacccgcaacactccgcacatatgaacgatag

SEQ ID NO: 19240 - DNA, 35 bp, Artificial Sequence
  Synthetic oligonucleotide
taacgccactctagcagatcgtctatcgcccttcg

SEQ ID NO: 19241 - DNA, 37 bp, Artificial Sequence
  Synthetic oligonucleotide
aatccagccccacgcaccaccgagaacagaacatcga

SEQ ID NO: 19242 - DNA, 38 bp, Artificial Sequence
  Synthetic oligonucleotide
ctgttacccccgccctgtacgttagtttcgtgcactga

SEQ ID NO: 19243 - DNA, 35 bp, Artificial Sequence
  Synthetic oligonucleotide
gtcatcccgcccctcccagttgccctatttcatac

SEQ ID NO: 19244 - DNA, 35 bp, Artificial Sequence
  Synthetic oligonucleotide
gcatggggaaggagggtgttgggttcaaacggctt

SEQ ID NO: 19245 - DNA, 37 bp, Artificial Sequence
  Synthetic oligonucleotide
tccatgcaacttgcgcctcatctccatcccgccatga

SEQ ID NO: 19246 - DNA, 38 bp, Artificial Sequence
  Synthetic oligonucleotide
atgttgctcggcggtgcacttcttgacctcccctttga

SEQ ID NO: 19247 - DNA, 38 bp, Artificial Sequence
  Synthetic oligonucleotide
tacaagcgccctgtccgtgttccatattcctgctttga

SEQ ID NO: 19248 - DNA, 36 bp, Artificial Sequence
  Synthetic oligonucleotide
acttaccactcctgccgcgcaaccccgatagtcgta

SEQ ID NO: 19249 - DNA, 35 bp, Artificial Sequence
  Synthetic oligonucleotide
gaagtgcgtgtcctgcccgccccccacaatatggc

SEQ ID NO: 19250 - DNA, 35 bp, Artificial Sequence
  Synthetic oligonucleotide
tcgctccatccttctgaaagctatcatgatccgtt

SEQ ID NO: 19251 - DNA, 35 bp, Artificial Sequence
  Synthetic oligonucleotide
tcatcatccgttgttgcagtaacggctttctctca

SEQ ID NO: 19252 - DNA, 36 bp, Artificial Sequence
  Synthetic oligonucleotide
tcctctgatccaacctgcgtattctcgtaccattca

SEQ ID NO: 19253 - DNA, 35 bp, Artificial Sequence
  Synthetic oligonucleotide
gcgtgtccccactcctccgtgtccccccgtcgaga

SEQ ID NO: 19254 - DNA, 30 bp, Artificial Sequence
  Synthetic oligonucleotide
aacccacgttttctctccgtacgcggtact

SEQ ID NO: 19255 - DNA, 35 bp, Artificial Sequence
  Synthetic oligonucleotide
aatcccgccacctccagatcgttctttgccacctt

SEQ ID NO: 19256 - DNA, 35 bp, Artificial Sequence
  Synthetic oligonucleotide
tcgcaactgcccctgcacattaccaaaacgacaca

SEQ ID NO: 19257 - DNA, 36 bp, Artificial Sequence
  Synthetic oligonucleotide
gtccagctcggtgatcgattcctcatttcctgttga

SEQ ID NO: 19258 - DNA, 37 bp, Artificial Sequence
  Synthetic oligonucleotide
taccagcccatcatctcagatccctctccgctgttga

SEQ ID NO: 19259 - DNA, 35 bp, Artificial Sequence
  Synthetic oligonucleotide
gttccatcccgaagttcccaaagcttacgagtaag

SEQ ID NO: 19260 - DNA, 35 bp, Artificial Sequence
  Synthetic oligonucleotide
atcgggtacagtagggggggggagatctcattggg

SEQ ID NO: 19261 - DNA, 35 bp, Artificial Sequence
  Synthetic oligonucleotide
actacccccgcgcattcttcgtttttctgtcatgg

SEQ ID NO: 19262 - DNA, 35 bp, Artificial Sequence
  Synthetic oligonucleotide
gccaagtgggggagttgtaggaggggagtgttgtg

SEQ ID NO: 19263 - DNA, 35 bp, Artificial Sequence
  Synthetic oligonucleotide
atacacaccgccgccgccccgccggtcaaattttg

SEQ ID NO: 19264 - DNA, 36 bp, Artificial Sequence
  Synthetic oligonucleotide
acaccgcccttgtactcggtaactagtttttatcca

SEQ ID NO: 19265 - DNA, 37 bp, Artificial Sequence
  Synthetic oligonucleotide
tgttgcgcaaccatcctccacgtgatcatctcctgga

SEQ ID NO: 19266 - DNA, 37 bp, Artificial Sequence
  Synthetic oligonucleotide
aaacggggtgggaagggggcctgggactggttttgga

SEQ ID NO: 19267 - DNA, 37 bp, Artificial Sequence
  Synthetic oligonucleotide
tacgacagggcggtgaggaaagttggttagggtgtga

SEQ ID NO: 19268 - DNA, 35 bp, Artificial Sequence
  Synthetic oligonucleotide
ttcgtagcctccaatgacactttcatcgttttcac

SEQ ID NO: 19269 - DNA, 35 bp, Artificial Sequence
  Synthetic oligonucleotide
accctcctacgctgttattttccgttcacttgtac

SEQ ID NO: 19270 - DNA, 35 bp, Artificial Sequence
  Synthetic oligonucleotide
gaactgacgcgacgcgtggctcgaactcatccatc

SEQ ID NO: 19271 - DNA, 35 bp, Artificial Sequence
  Synthetic oligonucleotide
tccgcgctacccctccgctgtccttaaatagtaat

SEQ ID NO: 19272 - DNA, 35 bp, Artificial Sequence
  Synthetic oligonucleotide
gccctgaccccactgtacgtaaagtcaaaacactt

SEQ ID NO: 19273 - DNA, 35 bp, Artificial Sequence
  Synthetic oligonucleotide
gcgatgcatgcgatctacgctgcactacccaattt

SEQ ID NO: 19274 - DNA, 35 bp, Artificial Sequence
  Synthetic oligonucleotide
gattgcgccgtacgcgtagtgttgatctccgtttt

SEQ ID NO: 19275 - DNA, 36 bp, Artificial Sequence
  Synthetic oligonucleotide
gacccccccatgcacttactaggtttggcacccaaa

SEQ ID NO: 19276 - DNA, 36 bp, Artificial Sequence
  Synthetic oligonucleotide
tcgaacccctgccatacacgacggacttcttctcga

SEQ ID NO: 19277 - DNA, 35 bp, Artificial Sequence
  Synthetic oligonucleotide
tcatttgctcatccggtgccccactgtccttcaac

SEQ ID NO: 19278 - DNA, 35 bp, Artificial Sequence
  Synthetic oligonucleotide
tcacacccctgcactgtattaggttaatgattccg

SEQ ID NO: 19279 - DNA, 35 bp, Artificial Sequence
  Synthetic oligonucleotide
atcgactccacggtgccatctctaggatttcttcg

SEQ ID NO: 19280 - DNA, 35 bp, Artificial Sequence
  Synthetic oligonucleotide
acgaacatgaaggagggggagcatgagtgatggat

SEQ ID NO: 19281 - DNA, 35 bp, Artificial Sequence
  Synthetic oligonucleotide
ccactccacccacctcgagcaccaccggtcgtgct

SEQ ID NO: 19282 - DNA, 35 bp, Artificial Sequence
  Synthetic oligonucleotide
tgcgagacgcattgcacatcttatttcagcttttt

SEQ ID NO: 19283 - DNA, 36 bp, Artificial Sequence
  Synthetic oligonucleotide
taatctgcccaggccatgcaactcgtgtcgctacca

SEQ ID NO: 19284 - DNA, 37 bp, Artificial Sequence
  Synthetic oligonucleotide
tgttgtgcccgaacattatggctgcctgctctctcga

SEQ ID NO: 19285 - DNA, 38 bp, Artificial Sequence
  Synthetic oligonucleotide
acccccgccccctcaatgttaagtatgatcttgcatga

SEQ ID NO: 19286 - DNA, 37 bp, Artificial Sequence
  Synthetic oligonucleotide
ggccccctaccgccctgtcacatgcaggatcccctga

SEQ ID NO: 19287 - DNA, 35 bp, Artificial Sequence
  Synthetic oligonucleotide
ggtgtccaagcccccgaatccagccggtctcctac

SEQ ID NO: 19288 - DNA, 35 bp, Artificial Sequence
  Synthetic oligonucleotide
accattgactacccgtgaagttttcgcctctggcc

SEQ ID NO: 19289 - DNA, 35 bp, Artificial Sequence
  Synthetic oligonucleotide
agtgcgctaaagatctgattagtcgttccatcctg

SEQ ID NO: 19290 - DNA, 35 bp, Artificial Sequence
  Synthetic oligonucleotide
tcccgccctcgaggatccttggccatgactttgct

SEQ ID NO: 19291 - DNA, 37 bp, Artificial Sequence
  Synthetic oligonucleotide
gccctagcagatcgtccattgacttgctcctctccga

SEQ ID NO: 19292 - DNA, 37 bp, Artificial Sequence
  Synthetic oligonucleotide
taacatccggcacagcatatatcactcccacacagga

SEQ ID NO: 19293 - DNA, 36 bp, Artificial Sequence
  Synthetic oligonucleotide
gatgaccaagaggtggcatagggatgaacatacgta

SEQ ID NO: 19294 - DNA, 35 bp, Artificial Sequence
  Synthetic oligonucleotide
tgtagcccttcgcgtgtcgttccgctgccaatgcc

SEQ ID NO: 19295 - DNA, 35 bp, Artificial Sequence
  Synthetic oligonucleotide
gttgcaggggtaggaccgccccccctccctctccg

SEQ ID NO: 19296 - DNA, 35 bp, Artificial Sequence
  Synthetic oligonucleotide
gacaccttcaatagcttcatctgttcatccctttg

SEQ ID NO: 19297 - DNA, 35 bp, Artificial Sequence
  Synthetic oligonucleotide
ttatacgacccctgccctctggctacaatgcttct

SEQ ID NO: 19298 - DNA, 37 bp, Artificial Sequence
  Synthetic oligonucleotide
tccccccgtcccgcgagtatgtgccttggttgcccga

SEQ ID NO: 19299 - DNA, 36 bp, Artificial Sequence
  Synthetic oligonucleotide
gacacagggttgtgtcacgatcatgtgcgggaagga

SEQ ID NO: 19300 - DNA, 37 bp, Artificial Sequence
  Synthetic oligonucleotide
ttcgggccacttcatttatctttttgttcctgttgga

SEQ ID NO: 19301 - DNA, 35 bp, Artificial Sequence
  Synthetic oligonucleotide
tgtgaccgcttacacacccctccgtcgccttggta

SEQ ID NO: 19302 - DNA, 35 bp, Artificial Sequence
  Synthetic oligonucleotide
tatgcctaccattgcgcatgcaacgacgtccccgc

SEQ ID NO: 19303 - DNA, 35 bp, Artificial Sequence
  Synthetic oligonucleotide
acctgcgcctccgtttaatctgttttctttccagg

SEQ ID NO: 19304 - DNA, 35 bp, Artificial Sequence
  Synthetic oligonucleotide
aacaggcctggctgccgcatcctttctcttacttg

SEQ ID NO: 19305 - DNA, 35 bp, Artificial Sequence
  Synthetic oligonucleotide
tgcataagcacaccacacgtacctccaattcgcga

SEQ ID NO: 19306 - DNA, 38 bp, Artificial Sequence
  Synthetic oligonucleotide
gacccgcccaaggtgatcctatgcactccccttattga

SEQ ID NO: 19307 - DNA, 35 bp, Artificial Sequence
  Synthetic oligonucleotide
atgcaatacgcacccgcccccttgtgctcgtgaac

SEQ ID NO: 19308 - DNA, 35 bp, Artificial Sequence
  Synthetic oligonucleotide
taccaaggagcgcgccccatcaacatgctgttccc

SEQ ID NO: 19309 - DNA, 35 bp, Artificial Sequence
  Synthetic oligonucleotide
acagagcaatgtgcgcccatgcttaacactcctcc

SEQ ID NO: 19310 - DNA, 35 bp, Artificial Sequence
  Synthetic oligonucleotide
accaagggtccgattcaccagtcttcctccacctc

SEQ ID NO: 19311 - DNA, 36 bp, Artificial Sequence
  Synthetic oligonucleotide
tgacgtagggggtggaggagtgggttctaggtgtga

SEQ ID NO: 19312 - DNA, 38 bp, Artificial Sequence
  Synthetic oligonucleotide
gagggtggtagtggaaattaagtgtgggtggctattga

SEQ ID NO: 19313 - DNA, 36 bp, Artificial Sequence
  Synthetic oligonucleotide
tcatgcagccttcgcgatattctcgtaccacccata

SEQ ID NO: 19314 - DNA, 35 bp, Artificial Sequence
  Synthetic oligonucleotide
gactccggatcccgacctctacgtaagccatacac

SEQ ID NO: 19315 - DNA, 35 bp, Artificial Sequence
  Synthetic oligonucleotide
ttctaccacccgatatatggccaatgtttagcccc

SEQ ID NO: 19316 - DNA, 35 bp, Artificial Sequence
  Synthetic oligonucleotide
gaacctcattcgattctgttaacgccgtggtctcc

SEQ ID NO: 19317 - DNA, 35 bp, Artificial Sequence
  Synthetic oligonucleotide
gtcgagacccggccctatgcttacatgcgcattat

SEQ ID NO: 19318 - DNA, 35 bp, Artificial Sequence
  Synthetic oligonucleotide
tactcgacccgtatgaagcaacgccgaaaccttgt

SEQ ID NO: 19319 - DNA, 35 bp, Artificial Sequence
  Synthetic oligonucleotide
tcacatcggccgaccattcttaacttctagctgtt

SEQ ID NO: 19320 - DNA, 35 bp, Artificial Sequence
  Synthetic oligonucleotide
gctaccgttccaactgttcctgggcgccacttcca

SEQ ID NO: 19321 - DNA, 35 bp, Artificial Sequence
  Synthetic oligonucleotide
tgactgaccgacttcccccttcgtccccggttgtc

SEQ ID NO: 19322 - DNA, 35 bp, Artificial Sequence
  Synthetic oligonucleotide
acccgtgtaccgttccgaatctatgacgtactttc

SEQ ID NO: 19323 - DNA, 35 bp, Artificial Sequence
  Synthetic oligonucleotide
gaacagtaaagggttgcaggggggattgagggaag

SEQ ID NO: 19324 - DNA, 35 bp, Artificial Sequence
  Synthetic oligonucleotide
gagaggcgggatagaacaaacggaaagaggggccg

SEQ ID NO: 19325 - DNA, 35 bp, Artificial Sequence
  Synthetic oligonucleotide
tacgtgcaccccaagtaccatcactgtctctcgat

SEQ ID NO: 19326 - DNA, 35 bp, Artificial Sequence
  Synthetic oligonucleotide
atgaccgccatgtcattttgcctaggattatcttt

SEQ ID NO: 19327 - DNA, 36 bp, Artificial Sequence
  Synthetic oligonucleotide
gaaccccgagcagaatgcctatcctccgtgctttaa

SEQ ID NO: 19328 - DNA, 36 bp, Artificial Sequence
  Synthetic oligonucleotide
tacccgcgcatatcacccgggtccaatgggccatca

SEQ ID NO: 19329 - DNA, 37 bp, Artificial Sequence
  Synthetic oligonucleotide
atgcacccttgcctatgcccccacacttggacaggga

SEQ ID NO: 19330 - DNA, 36 bp, Artificial Sequence
  Synthetic oligonucleotide
atcgacctacgttcgcgatatctccatcagggccta

SEQ ID NO: 19331 - DNA, 35 bp, Artificial Sequence
  Synthetic oligonucleotide
tgatccgcccattacaatcacagtcctgtatcggt

SEQ ID NO: 19332 - DNA, 37 bp, Artificial Sequence
  Synthetic oligonucleotide
acatccccctgatactgagttctctgcccccaactga

SEQ ID NO: 19333 - DNA, 38 bp, Artificial Sequence
  Synthetic oligonucleotide
aacaccacccagcttgatcgcattacttgggttattga

SEQ ID NO: 19334 - DNA, 37 bp, Artificial Sequence
  Synthetic oligonucleotide
tgcgatcagggccccgttatgtccacttatcccttga

SEQ ID NO: 19335 - DNA, 38 bp, Artificial Sequence
  Synthetic oligonucleotide
acccaccccgcgctttgtgcctaacttagtatgcttga

SEQ ID NO: 19336 - DNA, 36 bp, Artificial Sequence
  Synthetic oligonucleotide
acaccaagtgtggcgctactccatcctgttatacta

SEQ ID NO: 19337 - DNA, 35 bp, Artificial Sequence
  Synthetic oligonucleotide
acacggagcagtatgtaccaccataccaccctaac

SEQ ID NO: 19338 - DNA, 35 bp, Artificial Sequence
  Synthetic oligonucleotide
gcacactccgaaactggtcccattgttgttcgcac

SEQ ID NO: 19339 - DNA, 35 bp, Artificial Sequence
  Synthetic oligonucleotide
actctacatgagcttggttcaaagccctgcccctc

SEQ ID NO: 19340 - DNA, 35 bp, Artificial Sequence
  Synthetic oligonucleotide
atccgcggccattaacatctttccttcgccatctg

SEQ ID NO: 19341 - DNA, 35 bp, Artificial Sequence
  Synthetic oligonucleotide
gttggccacccaccttgtccgattcatgaactctg

SEQ ID NO: 19342 - DNA, 36 bp, Artificial Sequence
  Synthetic oligonucleotide
ttcactggcctatgtctcctcagctttcatctggca

SEQ ID NO: 19343 - DNA, 36 bp, Artificial Sequence
  Synthetic oligonucleotide
tcactcctctacgtacgtgtcttcagttcccggtca

SEQ ID NO: 19344 - DNA, 37 bp, Artificial Sequence
  Synthetic oligonucleotide
acctgacctccacgtgggaccaccaggatttacccga

SEQ ID NO: 19345 - DNA, 37 bp, Artificial Sequence
  Synthetic oligonucleotide
actgcagggtaccctgctgcttacacctaccattcga

SEQ ID NO: 19346 - DNA, 38 bp, Artificial Sequence
  Synthetic oligonucleotide
gcgtaccacgccaccacttgctatgaaaactattttga

SEQ ID NO: 19347 - DNA, 35 bp, Artificial Sequence
  Synthetic oligonucleotide
tgtccacatatgcccgtacctgcctcataagttcc

SEQ ID NO: 19348 - DNA, 35 bp, Artificial Sequence
  Synthetic oligonucleotide
tcagccacaaatctccttcgccggtcacttcattg

SEQ ID NO: 19349 - DNA, 35 bp, Artificial Sequence
  Synthetic oligonucleotide
tgacaccccccagctgaaacatccccaaatgttat

SEQ ID NO: 19350 - DNA, 35 bp, Artificial Sequence
  Synthetic oligonucleotide
taacgccaccattttgttttacacctgctcggact

SEQ ID NO: 19351 - DNA, 34 bp, Artificial Sequence
  Synthetic oligonucleotide
tttggaggcgcatactcgtacttgtcggcctcct

SEQ ID NO: 19352 - DNA, 35 bp, Artificial Sequence
  Synthetic oligonucleotide
gcaacacgagggtttccatggtgcctgcttctttt

SEQ ID NO: 19353 - DNA, 36 bp, Artificial Sequence
  Synthetic oligonucleotide
atgtgagcaaagggagcacatgaggcgaaggaaaaa

SEQ ID NO: 19354 - DNA, 37 bp, Artificial Sequence
  Synthetic oligonucleotide
gcctgccccgactaacggttaacacaacctggaacga

SEQ ID NO: 19355 - DNA, 38 bp, Artificial Sequence
  Synthetic oligonucleotide
tatgccttagacgtcttcaagttccctgccaccactga

SEQ ID NO: 19356 - DNA, 35 bp, Artificial Sequence
  Synthetic oligonucleotide
tgcactccctccatctgttgcaacgaggatatacc

SEQ ID NO: 19357 - DNA, 35 bp, Artificial Sequence
  Synthetic oligonucleotide
tttgtcgggcctctatgtagtctctcctgtcaccg

SEQ ID NO: 19358 - DNA, 35 bp, Artificial Sequence
  Synthetic oligonucleotide
accacactaccgggcactgtgctgacctactccga

SEQ ID NO: 19359 - DNA, 38 bp, Artificial Sequence
  Synthetic oligonucleotide
gatcagggcacggaggaacgaaattgaggatggaatga

SEQ ID NO: 19360 - DNA, 35 bp, Artificial Sequence
  Synthetic oligonucleotide
tacaccttcgcaactgtgagtcttggccgttttcc

SEQ ID NO: 19361 - DNA, 35 bp, Artificial Sequence
  Synthetic oligonucleotide
acccacgctgaggtacgtgggtgcgagcttccctc

SEQ ID NO: 19362 - DNA, 35 bp, Artificial Sequence
  Synthetic oligonucleotide
atgtggtcgcaactgcgttttatcattctattggg

SEQ ID NO: 19363 - DNA, 35 bp, Artificial Sequence
  Synthetic oligonucleotide
gacttcagcgccaaactgcactactcaaccagcat

SEQ ID NO: 19364 - DNA, 35 bp, Artificial Sequence
  Synthetic oligonucleotide
atcgagcgacgcatgagcgagcacaccctttccct

SEQ ID NO: 19365 - DNA, 34 bp, Artificial Sequence
  Synthetic oligonucleotide
tccttcaacggaagcgctctctcctcgctgcacc

SEQ ID NO: 19366 - DNA, 37 bp, Artificial Sequence
  Synthetic oligonucleotide
aaaggttaccgacaggggagggaagggaggggtgcga

SEQ ID NO: 19367 - DNA, 38 bp, Artificial Sequence
  Synthetic oligonucleotide
gagtccgcaacggtcacacgcgcgcaccccttccttga

SEQ ID NO: 19368 - DNA, 36 bp, Artificial Sequence
  Synthetic oligonucleotide
gtgtcccatccaatgtttcccgcggctatttttcta

SEQ ID NO: 19369 - DNA, 35 bp, Artificial Sequence
  Synthetic oligonucleotide
gccatacacctctccaacagcgtacgacttgcccc

SEQ ID NO: 19370 - DNA, 35 bp, Artificial Sequence
  Synthetic oligonucleotide
tcagggtgccattgtccttccgatctcccgtatgc

SEQ ID NO: 19371 - DNA, 35 bp, Artificial Sequence
  Synthetic oligonucleotide
gtacatcacacgcgcgaccctacctaacgtgttcg

SEQ ID NO: 19372 - DNA, 35 bp, Artificial Sequence
  Synthetic oligonucleotide
accgacatgagggggaggggctaataccaagaaat

SEQ ID NO: 19373 - DNA, 35 bp, Artificial Sequence
  Synthetic oligonucleotide
gccgacgctgccctatcttacagtatcttctcgca

SEQ ID NO: 19374 - DNA, 36 bp, Artificial Sequence
  Synthetic oligonucleotide
tccgccttgtaacagttcccattggctctctctcga

SEQ ID NO: 19375 - DNA, 35 bp, Artificial Sequence
  Synthetic oligonucleotide
tccggatcatcccctccctctctgtcttgtctaac

SEQ ID NO: 19376 - DNA, 35 bp, Artificial Sequence
  Synthetic oligonucleotide
gatgacccacccgctaatagggcaacctctaaacc

SEQ ID NO: 19377 - DNA, 35 bp, Artificial Sequence
  Synthetic oligonucleotide
gttgctccctactatgtcttgggctattttccttc

SEQ ID NO: 19378 - DNA, 37 bp, Artificial Sequence
  Synthetic oligonucleotide
agctcatcagcaggttcagcctcaccgcctttcatga

SEQ ID NO: 19379 - DNA, 35 bp, Artificial Sequence
  Synthetic oligonucleotide
taagcactacaaatgccccgttgccccctttcctc

SEQ ID NO: 19380 - DNA, 35 bp, Artificial Sequence
  Synthetic oligonucleotide
tgcccgagccttccgcatcatcccacgacctaccg

SEQ ID NO: 19381 - DNA, 35 bp, Artificial Sequence
  Synthetic oligonucleotide
gtgcatggcaacggtcgattctcacgcaataccct

SEQ ID NO: 19382 - DNA, 35 bp, Artificial Sequence
  Synthetic oligonucleotide
gcccacttatcgccgggggttccgtctatatccct

SEQ ID NO: 19383 - DNA, 36 bp, Artificial Sequence
  Synthetic oligonucleotide
aaccaccatctgtttaggacgtctgttcccgtccca

SEQ ID NO: 19384 - DNA, 36 bp, Artificial Sequence
  Synthetic oligonucleotide
gtcactcggcccccgtccgaatcctgctctctatca

SEQ ID NO: 19385 - DNA, 35 bp, Artificial Sequence
  Synthetic oligonucleotide
gtgacacccgggcccgtaaatctgcactatcgaac

SEQ ID NO: 19386 - DNA, 35 bp, Artificial Sequence
  Synthetic oligonucleotide
tacctaccccgcttacgtatcacatcgcaggtccc

SEQ ID NO: 19387 - DNA, 34 bp, Artificial Sequence
  Synthetic oligonucleotide
agaccctctggccgttgacgcttatctttgtctc

SEQ ID NO: 19388 - DNA, 35 bp, Artificial Sequence
  Synthetic oligonucleotide
gatgaccgaccttcgctgaccctcctggtacctct

SEQ ID NO: 19389 - DNA, 37 bp, Artificial Sequence
  Synthetic oligonucleotide
accaccctgcttgtgaccccttgactttctcggttga

SEQ ID NO: 19390 - DNA, 35 bp, Artificial Sequence
  Synthetic oligonucleotide
actcccatcaatcccctgccggaaaagcatccggc

SEQ ID NO: 19391 - DNA, 35 bp, Artificial Sequence
  Synthetic oligonucleotide
tctccaccacaggagcctcaagcttggcacactct

SEQ ID NO: 19392 - DNA, 35 bp, Artificial Sequence
  Synthetic oligonucleotide
tcgatacccacaacacgtttatatgccatctctaa

SEQ ID NO: 19393 - DNA, 36 bp, Artificial Sequence
  Synthetic oligonucleotide
ttccctcccccgtgtgtactatctcttgtggcgcca

SEQ ID NO: 19394 - DNA, 37 bp, Artificial Sequence
  Synthetic oligonucleotide
gagtacgctgatccttttgctgttccccttttgttga

SEQ ID NO: 19395 - DNA, 38 bp, Artificial Sequence
  Synthetic oligonucleotide
atgacccgccgttaatctggtactaaaccctcatttga

SEQ ID NO: 19396 - DNA, 35 bp, Artificial Sequence
  Synthetic oligonucleotide
gagaccagcagcccgtgccgtgtcacacctttccc

SEQ ID NO: 19397 - DNA, 38 bp, Artificial Sequence
  Synthetic oligonucleotide
gcaattgagaggaatagggaaaagcatggtggtaatga

SEQ ID NO: 19398 - DNA, 37 bp, Artificial Sequence
  Synthetic oligonucleotide
gaaccgccccagctgctgacacctcttgctgttttga

SEQ ID NO: 19399 - DNA, 35 bp, Artificial Sequence
  Synthetic oligonucleotide
agatgtccctgccctgtacctacaccttaatttgg

SEQ ID NO: 19400 - DNA, 36 bp, Artificial Sequence
  Synthetic oligonucleotide
ggatcgcactgccccatcctgtactgtgttaaccca

SEQ ID NO: 19401 - DNA, 37 bp, Artificial Sequence
  Synthetic oligonucleotide
ggaagaggcaggagagagtgggaacaaaggatagaga

SEQ ID NO: 19402 - DNA, 37 bp, Artificial Sequence
  Synthetic oligonucleotide
gtccaccacagccgataatccacgtcttgcgctatga

SEQ ID NO: 19403 - DNA, 35 bp, Artificial Sequence
  Synthetic oligonucleotide
gtgcccccaccacagcacttagtcacggtaggtga

SEQ ID NO: 19404 - DNA, 37 bp, Artificial Sequence
  Synthetic oligonucleotide
tcaccgtatgtttgcttctaccagccgtatctcttga

SEQ ID NO: 19405 - DNA, 35 bp, Artificial Sequence
  Synthetic oligonucleotide
ttacggtcgctgggacacatatcacggtctcctcc

SEQ ID NO: 19406 - DNA, 35 bp, Artificial Sequence
  Synthetic oligonucleotide
tcaccgcggatctcatagtctttatcggtccttgc

SEQ ID NO: 19407 - DNA, 35 bp, Artificial Sequence
  Synthetic oligonucleotide
atcccagacatcgaccctatattgctcaggccgct

SEQ ID NO: 19408 - DNA, 35 bp, Artificial Sequence
  Synthetic oligonucleotide
tccgtaaccctcacgcaccacctatgcagctgttt

SEQ ID NO: 19409 - DNA, 35 bp, Artificial Sequence
  Synthetic oligonucleotide
agtcagcctaccacgtgcgtcgccccccgcctcaa

SEQ ID NO: 19410 - DNA, 36 bp, Artificial Sequence
  Synthetic oligonucleotide
gaacgaccaggcctcacgtgaccgctccttcataca

SEQ ID NO: 19411 - DNA, 37 bp, Artificial Sequence
  Synthetic oligonucleotide
ttgcaccatctgtctctttgactctgcccttgataga

SEQ ID NO: 19412 - DNA, 35 bp, Artificial Sequence
  Synthetic oligonucleotide
tgactcgcccactctcttcgatgaaacgaccccac

SEQ ID NO: 19413 - DNA, 35 bp, Artificial Sequence
  Synthetic oligonucleotide
ttagtccatgactctcgagcctctactccacatgc

SEQ ID NO: 19414 - DNA, 35 bp, Artificial Sequence
  Synthetic oligonucleotide
actgcccaggtctcttgcccctcctcccaaaacga

SEQ ID NO: 19415 - DNA, 37 bp, Artificial Sequence
  Synthetic oligonucleotide
aagctacctccgcaactgccaacttcgaactccacga

SEQ ID NO: 19416 - DNA, 37 bp, Artificial Sequence
  Synthetic oligonucleotide
tctgacacctgcgatcgtgcttaccctttccgccgga

SEQ ID NO: 19417 - DNA, 37 bp, Artificial Sequence
  Synthetic oligonucleotide
ggactgggggtgggaattggatgagggttgatgggga

SEQ ID NO: 19418 - DNA, 38 bp, Artificial Sequence
  Synthetic oligonucleotide
gctgggtgtcccggggggggaagggtagggtggaatga

SEQ ID NO: 19419 - DNA, 35 bp, Artificial Sequence
  Synthetic oligonucleotide
ctcgacacctggcccgtttttgccacccacttctg

SEQ ID NO: 19420 - DNA, 35 bp, Artificial Sequence
  Synthetic oligonucleotide
gcacttatgcccaccgacaacttgcacatgatcct

SEQ ID NO: 19421 - DNA, 35 bp, Artificial Sequence
  Synthetic oligonucleotide
acatccacatcccgcgtcgttcttgaaacatctct

SEQ ID NO: 19422 - DNA, 37 bp, Artificial Sequence
  Synthetic oligonucleotide
aacgcgcaattcgaatccctgcctctccgccggtgga

SEQ ID NO: 19423 - DNA, 38 bp, Artificial Sequence
  Synthetic oligonucleotide
ggacggaccagcaggggcgagagagtgaggggctgtga

SEQ ID NO: 19424 - DNA, 36 bp, Artificial Sequence
  Synthetic oligonucleotide
gatgggaaggggggtgcgagggacgggcagacggta

SEQ ID NO: 19425 - DNA, 35 bp, Artificial Sequence
  Synthetic oligonucleotide
agtgcccccatgctctggcgctcactccgcttatc

SEQ ID NO: 19426 - DNA, 37 bp, Artificial Sequence
  Synthetic oligonucleotide
attccatctgtacaaccccttgtcgccttcctgacga

SEQ ID NO: 19427 - DNA, 37 bp, Artificial Sequence
  Synthetic oligonucleotide
accacccaccgacctaccgattgctgttattgttgga

SEQ ID NO: 19428 - DNA, 36 bp, Artificial Sequence
  Synthetic oligonucleotide
gaagggcaaccatcctttgttttattgctttttgga

SEQ ID NO: 19429 - DNA, 37 bp, Artificial Sequence
  Synthetic oligonucleotide
gtccatcctcggtttctgccctcttatcctcatgtga

SEQ ID NO: 19430 - DNA, 36 bp, Artificial Sequence
  Synthetic oligonucleotide
acgagcactatctgcctccgcctctctccccgagta

SEQ ID NO: 19431 - DNA, 35 bp, Artificial Sequence
  Synthetic oligonucleotide
tctcactatgacctcgggtcgtgtccttacacttt

SEQ ID NO: 19432 - DNA, 36 bp, Artificial Sequence
  Synthetic oligonucleotide
tcatacgcctatggttgcataaatcctcctgcttca

SEQ ID NO: 19433 - DNA, 36 bp, Artificial Sequence
  Synthetic oligonucleotide
tacatccgcccgaccttaataacagtccctcatata

SEQ ID NO: 19434 - DNA, 35 bp, Artificial Sequence
  Synthetic oligonucleotide
gcacatgtgccacctacttgcggttcttctagttc

SEQ ID NO: 19435 - DNA, 35 bp, Artificial Sequence
  Synthetic oligonucleotide
gtggacccgcactatattcgttcaaggcctcccat

SEQ ID NO: 19436 - DNA, 35 bp, Artificial Sequence
  Synthetic oligonucleotide
gaccatacccttcagcacctccgccccggcccgca

SEQ ID NO: 19437 - DNA, 37 bp, Artificial Sequence
  Synthetic oligonucleotide
atcaccacactgtcgtataaccacaaaccacgtacga

SEQ ID NO: 19438 - DNA, 35 bp, Artificial Sequence
  Synthetic oligonucleotide
tacgatggcctcggtcccatacctcttccccccga

SEQ ID NO: 19439 - DNA, 37 bp, Artificial Sequence
  Synthetic oligonucleotide
gagtagggggggactgcagggatggcatcgttggcga

SEQ ID NO: 19440 - DNA, 35 bp, Artificial Sequence
  Synthetic oligonucleotide
ggggtatatgcaacgggagaaggaagattttgcag

SEQ ID NO: 19441 - DNA, 35 bp, Artificial Sequence
  Synthetic oligonucleotide
ggtaccaacccggcattgcagtccatccgcgaatt

SEQ ID NO: 19442 - DNA, 35 bp, Artificial Sequence
  Synthetic oligonucleotide
gacccacgctccacaacccatcgggtaagttcctt

SEQ ID NO: 19443 - DNA, 36 bp, Artificial Sequence
  Synthetic oligonucleotide
gaccacccgcccaaatttaggacacgcgcgcccaca

SEQ ID NO: 19444 - DNA, 37 bp, Artificial Sequence
  Synthetic oligonucleotide
tacacccgcacttccttctgccactggtattatacga

SEQ ID NO: 19445 - DNA, 37 bp, Artificial Sequence
  Synthetic oligonucleotide
gattcgaacatcctcgcctgtccctttggctacctga

SEQ ID NO: 19446 - DNA, 36 bp, Artificial Sequence
  Synthetic oligonucleotide
atgtacgcacccgaggaggtcctctctatcgcccta

SEQ ID NO: 19447 - DNA, 35 bp, Artificial Sequence
  Synthetic oligonucleotide
gccactcccaccagcgtaggcttgatcctgaacac

SEQ ID NO: 19448 - DNA, 35 bp, Artificial Sequence
  Synthetic oligonucleotide
agatcagccttctgttccacgcggtgccttcctac

SEQ ID NO: 19449 - DNA, 35 bp, Artificial Sequence
  Synthetic oligonucleotide
accgagagcagccacccctacctatttggtctgcc

SEQ ID NO: 19450 - DNA, 35 bp, Artificial Sequence
  Synthetic oligonucleotide
gccggaccacccctctgtctcaagtctacacgtgg

SEQ ID NO: 19451 - DNA, 35 bp, Artificial Sequence
  Synthetic oligonucleotide
taacacatcgccgcttacgtcgttcagcaaacctg

SEQ ID NO: 19452 - DNA, 36 bp, Artificial Sequence
  Synthetic oligonucleotide
tgtgctcccctgccgtggaatatccttgcttgttca

SEQ ID NO: 19453 - DNA, 38 bp, Artificial Sequence
  Synthetic oligonucleotide
acgacccccgtactttcccgtaaaacgcataaccatga

SEQ ID NO: 19454 - DNA, 35 bp, Artificial Sequence
  Synthetic oligonucleotide
gaccagtactcacacgagtacccttataccgtgcc

SEQ ID NO: 19455 - DNA, 35 bp, Artificial Sequence
  Synthetic oligonucleotide
atccatgccctgttgcccgtcactaccaggctacg

SEQ ID NO: 19456 - DNA, 35 bp, Artificial Sequence
  Synthetic oligonucleotide
tttgcgacagacgtccctttacaacctgctgctgt

SEQ ID NO: 19457 - DNA, 37 bp, Artificial Sequence
  Synthetic oligonucleotide
gacgtccctcccgccatcgccgcctcttataattcga

SEQ ID NO: 19458 - DNA, 37 bp, Artificial Sequence
  Synthetic oligonucleotide
gtcacacgccctctgccttagtacgcccggttcggga

SEQ ID NO: 19459 - DNA, 38 bp, Artificial Sequence
  Synthetic oligonucleotide
gtgtgcccacgtgtttgccccgcttctccctgccatga

SEQ ID NO: 19460 - DNA, 35 bp, Artificial Sequence
  Synthetic oligonucleotide
ttgacaaaaatggtacctcacgtggctcatcctcc

SEQ ID NO: 19461 - DNA, 35 bp, Artificial Sequence
  Synthetic oligonucleotide
agccaaccgcatggtgcacccgacttccatcttat

SEQ ID NO: 19462 - DNA, 36 bp, Artificial Sequence
  Synthetic oligonucleotide
accccgaccgctcctactctaaccaccccgacagga

SEQ ID NO: 19463 - DNA, 37 bp, Artificial Sequence
  Synthetic oligonucleotide
agatagcgggaacggggaaactgaggaaataggggga

SEQ ID NO: 19464 - DNA, 38 bp, Artificial Sequence
  Synthetic oligonucleotide
tctattgccacacaccgccctcgtgacatctcccatga

SEQ ID NO: 19465 - DNA, 36 bp, Artificial Sequence
  Synthetic oligonucleotide
gttgcgacgctggcacccccggtttttttccaacta

SEQ ID NO: 19466 - DNA, 35 bp, Artificial Sequence
  Synthetic oligonucleotide
tgcgtgaaagggtcatgggaaaggtagagggagcg

SEQ ID NO: 19467 - DNA, 35 bp, Artificial Sequence
  Synthetic oligonucleotide
ttcgtcggtcctcctgtaccttctcccgctgtctt

SEQ ID NO: 19468 - DNA, 37 bp, Artificial Sequence
  Synthetic oligonucleotide
taccgcacaaccagatcacctcaacacaccacgcgga

SEQ ID NO: 19469 - DNA, 38 bp, Artificial Sequence
  Synthetic oligonucleotide
gacgacgggagtatgagcaaggagcggttagaagatga

SEQ ID NO: 19470 - DNA, 38 bp, Artificial Sequence
  Synthetic oligonucleotide
acgacacacccctctccttgtaagctttctggtactga

SEQ ID NO: 19471 - DNA, 35 bp, Artificial Sequence
  Synthetic oligonucleotide
tggtcaccgcctttcgattgacatcgcgtaacacc

SEQ ID NO: 19472 - DNA, 35 bp, Artificial Sequence
  Synthetic oligonucleotide
acaatagccccattgattcctggtccgtaccttgg

SEQ ID NO: 19473 - DNA, 36 bp, Artificial Sequence
  Synthetic oligonucleotide
tacacgggcgcacggaaagctacaccctccttgtca

SEQ ID NO: 19474 - DNA, 37 bp, Artificial Sequence
  Synthetic oligonucleotide
gacctcgctggtattctcaccgaaccttgccttacga

SEQ ID NO: 19475 - DNA, 35 bp, Artificial Sequence
  Synthetic oligonucleotide
tcctgcggggaggctgggtggaggagtgtgggtgg

SEQ ID NO: 19476 - DNA, 36 bp, Artificial Sequence
  Synthetic oligonucleotide
gccatgctctgctctgggcttacatactgccgatca

SEQ ID NO: 19477 - DNA, 36 bp, Artificial Sequence
  Synthetic oligonucleotide
gccacactccagcagtttaagctttccatcatatca

SEQ ID NO: 19478 - DNA, 37 bp, Artificial Sequence
  Synthetic oligonucleotide
gcaaaggattaaaggtggagggaagggatagaagaga

SEQ ID NO: 19479 - DNA, 36 bp, Artificial Sequence
  Synthetic oligonucleotide
tcatatctccgccgccctcgaggacctcgccccgga

SEQ ID NO: 19480 - DNA, 38 bp, Artificial Sequence
  Synthetic oligonucleotide
taccgccaactacctatgaactcgtgcttcttgcctga

SEQ ID NO: 19481 - DNA, 36 bp, Artificial Sequence
  Synthetic oligonucleotide
ttggtcaatacgccagtgcgccatcccaccacctta

SEQ ID NO: 19482 - DNA, 36 bp, Artificial Sequence
  Synthetic oligonucleotide
gtctgccaacaccccaggcgtatcctagtctgctta

SEQ ID NO: 19483 - DNA, 35 bp, Artificial Sequence
  Synthetic oligonucleotide
tgcaatgcctagaacctagccactcgtaaccgtac

SEQ ID NO: 19484 - DNA, 35 bp, Artificial Sequence
  Synthetic oligonucleotide
acacacctgcgccaaccttcggtctggtagtcctc

SEQ ID NO: 19485 - DNA, 37 bp, Artificial Sequence
  Synthetic oligonucleotide
acactgcgtgcacctccccgcgtcgaatccacctcga

SEQ ID NO: 19486 - DNA, 37 bp, Artificial Sequence
  Synthetic oligonucleotide
tctggaccgctaccttcccgtttatctgccaactgga

SEQ ID NO: 19487 - DNA, 38 bp, Artificial Sequence
  Synthetic oligonucleotide
gacgggcgcaaatgcgcaatccttcgaacactacctga

SEQ ID NO: 19488 - DNA, 35 bp, Artificial Sequence
  Synthetic oligonucleotide
atgggtggggtaggtggaacttggacattgagata

SEQ ID NO: 19489 - DNA, 35 bp, Artificial Sequence
  Synthetic oligonucleotide
tgaccgagaccctctcgctaagccattcgttccac

SEQ ID NO: 19490 - DNA, 35 bp, Artificial Sequence
  Synthetic oligonucleotide
acgcaaacctgtggtccctttgcacttaacttcac

SEQ ID NO: 19491 - DNA, 35 bp, Artificial Sequence
  Synthetic oligonucleotide
taccgacgcccgtcttgctcccgacatttgcaacc

SEQ ID NO: 19492 - DNA, 35 bp, Artificial Sequence
  Synthetic oligonucleotide
ttcgcgggattagcggtctttccatcactctcttt

SEQ ID NO: 19493 - DNA, 35 bp, Artificial Sequence
  Synthetic oligonucleotide
gtgcgacccgtaatgctatgtcccccatggttcaa

SEQ ID NO: 19494 - DNA, 36 bp, Artificial Sequence
  Synthetic oligonucleotide
gacttcaccgcaggccccctcacccttggctttgaa

SEQ ID NO: 19495 - DNA, 38 bp, Artificial Sequence
  Synthetic oligonucleotide
attcccccaactgttcctgtcctagtgagacattctga

SEQ ID NO: 19496 - DNA, 38 bp, Artificial Sequence
  Synthetic oligonucleotide
tccgccacacatgccatactcgtccatgtccgttttga

SEQ ID NO: 19497 - DNA, 35 bp, Artificial Sequence
  Synthetic oligonucleotide
tccgtaccccaaatgggtctaacaagccctcttcc

SEQ ID NO: 19498 - DNA, 35 bp, Artificial Sequence
  Synthetic oligonucleotide
gcattccaccgcttttgtacctgctggatttacct

SEQ ID NO: 19499 - DNA, 35 bp, Artificial Sequence
  Synthetic oligonucleotide
aggggtgggatcgggaggggtcggtgcttactagt

SEQ ID NO: 19500 - DNA, 37 bp, Artificial Sequence
  Synthetic oligonucleotide
tcgcaactttgcaatcgtatcctccgggcctcttcga

SEQ ID NO: 19501 - DNA, 37 bp, Artificial Sequence
  Synthetic oligonucleotide
tacgtcaccgcagcacgcgattccctccctctattga

SEQ ID NO: 19502 - DNA, 38 bp, Artificial Sequence
  Synthetic oligonucleotide
gcaactcgcaacgatccgcttcttgtcctccttgttga

SEQ ID NO: 19503 - DNA, 35 bp, Artificial Sequence
  Synthetic oligonucleotide
tgtgcgactggccacagacgtccatcaatctcctc

SEQ ID NO: 19504 - DNA, 35 bp, Artificial Sequence
  Synthetic oligonucleotide
aacgtcctggatcacacgattcttcctgggctctc

SEQ ID NO: 19505 - DNA, 35 bp, Artificial Sequence
  Synthetic oligonucleotide
gacaccgaataggttctccgacaatggcctttttc

SEQ ID NO: 19506 - DNA, 36 bp, Artificial Sequence
  Synthetic oligonucleotide
gtgaggatcggtacgataaggatggggcatggggaa

SEQ ID NO: 19507 - DNA, 36 bp, Artificial Sequence
  Synthetic oligonucleotide
tcacttgccacagccgagcaatcgaggaccttggca

SEQ ID NO: 19508 - DNA, 38 bp, Artificial Sequence
  Synthetic oligonucleotide
taccactgcagtggatgacccatcactcccgctcctga

SEQ ID NO: 19509 - DNA, 35 bp, Artificial Sequence
  Synthetic oligonucleotide
tatcccccggggcaacctggaccctgcttaccttg

SEQ ID NO: 19510 - DNA, 35 bp, Artificial Sequence
  Synthetic oligonucleotide
gtgccacatcaccaatcatgtgatcgatccctttt

SEQ ID NO: 19511 - DNA, 35 bp, Artificial Sequence
  Synthetic oligonucleotide
tctaggcctccactcaatcccgttcatgctgttca

SEQ ID NO: 19512 - DNA, 37 bp, Artificial Sequence
  Synthetic oligonucleotide
gtgtaggctacaagtggtggtaggcgtggaggagaga

SEQ ID NO: 19513 - DNA, 35 bp, Artificial Sequence
  Synthetic oligonucleotide
gcatgtccgcacgcctcgtccggtcaattaccacc

SEQ ID NO: 19514 - DNA, 35 bp, Artificial Sequence
  Synthetic oligonucleotide
tttccactccccatccatccgcttcgcgaggagcc

SEQ ID NO: 19515 - DNA, 35 bp, Artificial Sequence
  Synthetic oligonucleotide
tgactaaccgacacagcctcgaccaagtcccctcc

SEQ ID NO: 19516 - DNA, 35 bp, Artificial Sequence
  Synthetic oligonucleotide
taacatgctcaccttcgcgatttcttcctgctgca

SEQ ID NO: 19517 - DNA, 35 bp, Artificial Sequence
  Synthetic oligonucleotide
tacggagggcaatagggagggtatgggaatgtgca

SEQ ID NO: 19518 - DNA, 38 bp, Artificial Sequence
  Synthetic oligonucleotide
taacccgccggcatatatatcgcgtcgtcctctactga

SEQ ID NO: 19519 - DNA, 38 bp, Artificial Sequence
  Synthetic oligonucleotide
gacaacagtgcagaactgttggcgctatacccacttga

SEQ ID NO: 19520 - DNA, 35 bp, Artificial Sequence
  Synthetic oligonucleotide
tcttgtccgtgtccccgcacaacagttttaccacc

SEQ ID NO: 19521 - DNA, 35 bp, Artificial Sequence
  Synthetic oligonucleotide
ggacactccccgtccctgcctctttgtttgctgcc

SEQ ID NO: 19522 - DNA, 35 bp, Artificial Sequence
  Synthetic oligonucleotide
agatcgccgcctatcctcaatcattgcgtggcctc

SEQ ID NO: 19523 - DNA, 35 bp, Artificial Sequence
  Synthetic oligonucleotide
gactgggggggattggatatgtcactgggggaggg

SEQ ID NO: 19524 - DNA, 35 bp, Artificial Sequence
  Synthetic oligonucleotide
acaaacccacgcccgctgtaccagttccgtcgtct

SEQ ID NO: 19525 - DNA, 36 bp, Artificial Sequence
  Synthetic oligonucleotide
gtctccatcctgtctgctcatgtcatgtcacgcgaa

SEQ ID NO: 19526 - DNA, 35 bp, Artificial Sequence
  Synthetic oligonucleotide
atccctcccgcatttccgcttctttcgcataggcg

SEQ ID NO: 19527 - DNA, 35 bp, Artificial Sequence
  Synthetic oligonucleotide
gtactgcgctctttaccgttatcgatgttcacctg

SEQ ID NO: 19528 - DNA, 35 bp, Artificial Sequence
  Synthetic oligonucleotide
gataccttaccgtccccgtgactacggcccacatt

SEQ ID NO: 19529 - DNA, 36 bp, Artificial Sequence
  Synthetic oligonucleotide
gtgaatggcgaggtgggggtattggggggtggagaa

SEQ ID NO: 19530 - DNA, 37 bp, Artificial Sequence
  Synthetic oligonucleotide
gacacggccccttccgtggttgcattccccctttcga

SEQ ID NO: 19531 - DNA, 38 bp, Artificial Sequence
  Synthetic oligonucleotide
gagactcatcaccgctcatagctgactcttccccttga

SEQ ID NO: 19532 - DNA, 36 bp, Artificial Sequence
  Synthetic oligonucleotide
gtgtgtgtgtgtggtgtgcggtggggacgacagcta

SEQ ID NO: 19533 - DNA, 36 bp, Artificial Sequence
  Synthetic oligonucleotide
gcatcgcctgcactcgcacgcacttctctcacgcta

SEQ ID NO: 19534 - DNA, 35 bp, Artificial Sequence
  Synthetic oligonucleotide
acccatacgtatgcacggaactacagtcttaccac

SEQ ID NO: 19535 - DNA, 35 bp, Artificial Sequence
  Synthetic oligonucleotide
tagttccacccgccaacaagcctgaacttcatcac

SEQ ID NO: 19536 - DNA, 35 bp, Artificial Sequence
  Synthetic oligonucleotide
gcacctttccctgggcatatggtacatatttctac

SEQ ID NO: 19537 - DNA, 35 bp, Artificial Sequence
  Synthetic oligonucleotide
tccacacagtatggccttccgggcaacctaccacc

SEQ ID NO: 19538 - DNA, 35 bp, Artificial Sequence
  Synthetic oligonucleotide
gccccccccagccaattgaacgctcagcatatggc

SEQ ID NO: 19539 - DNA, 35 bp, Artificial Sequence
  Synthetic oligonucleotide
gtcaacaccccattaactgtccgcatctttctgtt

SEQ ID NO: 19540 - DNA, 35 bp, Artificial Sequence
  Synthetic oligonucleotide
gcacctccgataccccgcgcccgaatgctttcgaa

SEQ ID NO: 19541 - DNA, 37 bp, Artificial Sequence
  Synthetic oligonucleotide
atgtgcagggcgcatgagaagcgggggggttgaagga

SEQ ID NO: 19542 - DNA, 37 bp, Artificial Sequence
  Synthetic oligonucleotide
aaatcaccgcaattaatatcccaccagccacaccgga

SEQ ID NO: 19543 - DNA, 37 bp, Artificial Sequence
  Synthetic oligonucleotide
tcgaccgacccacctcttgatgtcccccgtctctgga

SEQ ID NO: 19544 - DNA, 35 bp, Artificial Sequence
  Synthetic oligonucleotide
gattaccatatggttattgtgtcctgccctttacc

SEQ ID NO: 19545 - DNA, 35 bp, Artificial Sequence
  Synthetic oligonucleotide
accccgacggcccagtccttcgtctcggtactctc

SEQ ID NO: 19546 - DNA, 35 bp, Artificial Sequence
  Synthetic oligonucleotide
gatcaccccgtgtccagtgccaccataccgcagtc

SEQ ID NO: 19547 - DNA, 35 bp, Artificial Sequence
  Synthetic oligonucleotide
ttgatcaccatcccattgtcctgccggagaagaat

SEQ ID NO: 19548 - DNA, 35 bp, Artificial Sequence
  Synthetic oligonucleotide
gcccgcttacatccccgaaacatgtcatttggtct

SEQ ID NO: 19549 - DNA, 35 bp, Artificial Sequence
  Synthetic oligonucleotide
gcacacccttggtttttatgattcaatcgttatca

SEQ ID NO: 19550 - DNA, 38 bp, Artificial Sequence
  Synthetic oligonucleotide
ttcccagtcacgtgccctttgccagtccttctgcgtga

SEQ ID NO: 19551 - DNA, 35 bp, Artificial Sequence
  Synthetic oligonucleotide
acactgggaacactgcgggtaagcacgtttctcac

SEQ ID NO: 19552 - DNA, 35 bp, Artificial Sequence
  Synthetic oligonucleotide
gcacggatcagatctgtgatctccgcccccgaccc

SEQ ID NO: 19553 - DNA, 35 bp, Artificial Sequence
  Synthetic oligonucleotide
attaatgccgcatgtcaccccttcctcgcacgctc

SEQ ID NO: 19554 - DNA, 35 bp, Artificial Sequence
  Synthetic oligonucleotide
tagacggagcggatcatctacctcagttccacacg

SEQ ID NO: 19555 - DNA, 35 bp, Artificial Sequence
  Synthetic oligonucleotide
gcgttccgccgcacgtaacaaggggccccattccg

SEQ ID NO: 19556 - DNA, 36 bp, Artificial Sequence
  Synthetic oligonucleotide
tacctacgcctgacctgaagaattttgccctataaa

SEQ ID NO: 19557 - DNA, 35 bp, Artificial Sequence
  Synthetic oligonucleotide
ttccacccacccgctgctcccaccgctaaggggca

SEQ ID NO: 19558 - DNA, 35 bp, Artificial Sequence
  Synthetic oligonucleotide
aacccccggatggtatcacctcgaacccgccccga

SEQ ID NO: 19559 - DNA, 37 bp, Artificial Sequence
  Synthetic oligonucleotide
taagccgggatggtagggaaggggctatgggatgcga

SEQ ID NO: 19560 - DNA, 35 bp, Artificial Sequence
  Synthetic oligonucleotide
acaatgcgctcaccaatctcgcaggcttcctccac

SEQ ID NO: 19561 - DNA, 35 bp, Artificial Sequence
  Synthetic oligonucleotide
tccctcccgcgtactccgctcggctagtttcctac

SEQ ID NO: 19562 - DNA, 35 bp, Artificial Sequence
  Synthetic oligonucleotide
tcatggctgcctggctaccgtaccgccttgtttac

SEQ ID NO: 19563 - DNA, 35 bp, Artificial Sequence
  Synthetic oligonucleotide
agcgctccctctgcttgttctcccgtggtcggtcc

SEQ ID NO: 19564 - DNA, 34 bp, Artificial Sequence
  Synthetic oligonucleotide
gggttcgacgccgcatccttatcaccgttctggc

SEQ ID NO: 19565 - DNA, 35 bp, Artificial Sequence
  Synthetic oligonucleotide
agccccccaacccacccctgcgctgaccgattcaa

SEQ ID NO: 19566 - DNA, 36 bp, Artificial Sequence
  Synthetic oligonucleotide
tgcaccatcattattagcgctgcccccattggtaca

SEQ ID NO: 19567 - DNA, 36 bp, Artificial Sequence
  Synthetic oligonucleotide
atccctcaccgttgtttgctgcatttagctccacga

SEQ ID NO: 19568 - DNA, 37 bp, Artificial Sequence
  Synthetic oligonucleotide
taccagccaaggtctcccgcatcggccctcttcacga

SEQ ID NO: 19569 - DNA, 37 bp, Artificial Sequence
  Synthetic oligonucleotide
attcgcgacccatgcattcacctccgtaaccttagga

SEQ ID NO: 19570 - DNA, 36 bp, Artificial Sequence
  Synthetic oligonucleotide
gtggactcggatgcttctctgtctgttcccatgtta

SEQ ID NO: 19571 - DNA, 35 bp, Artificial Sequence
  Synthetic oligonucleotide
gtccacaacaacgatatgctccgtacctccccacc

SEQ ID NO: 19572 - DNA, 35 bp, Artificial Sequence
  Synthetic oligonucleotide
ggacatgcgtgggcgggagggtaggggggatgcgc

SEQ ID NO: 19573 - DNA, 35 bp, Artificial Sequence
  Synthetic oligonucleotide
tactacccccactctaccgcatgtctcacagcatg

SEQ ID NO: 19574 - DNA, 35 bp, Artificial Sequence
  Synthetic oligonucleotide
gcgctggccatacatgttctgtttctcgctatcct

SEQ ID NO: 19575 - DNA, 36 bp, Artificial Sequence
  Synthetic oligonucleotide
accgctccgccataaccatttgctaccggactgaaa

SEQ ID NO: 19576 - DNA, 36 bp, Artificial Sequence
  Synthetic oligonucleotide
agctgcacccatctgtcaagaccgctcaacacccca

SEQ ID NO: 19577 - DNA, 35 bp, Artificial Sequence
  Synthetic oligonucleotide
ttcacagtgcttccattgttttatctctcgtggca

SEQ ID NO: 19578 - DNA, 37 bp, Artificial Sequence
  Synthetic oligonucleotide
tgacaacccacgaagcctccggtggtacgatctccga

SEQ ID NO: 19579 - DNA, 37 bp, Artificial Sequence
  Synthetic oligonucleotide
aatgcccccccctctgttgtaccgtatatatcggcga

SEQ ID NO: 19580 - DNA, 37 bp, Artificial Sequence
  Synthetic oligonucleotide
gaggtagttaggtgagggccaagggtgggaaagggga

SEQ ID NO: 19581 - DNA, 37 bp, Artificial Sequence
  Synthetic oligonucleotide
aaggggcgggggggcggcttaaaattggacatgggga

SEQ ID NO: 19582 - DNA, 37 bp, Artificial Sequence
  Synthetic oligonucleotide
gttgctatggcacacccctcacccctcctgtgactga

SEQ ID NO: 19583 - DNA, 37 bp, Artificial Sequence
  Synthetic oligonucleotide
gtcactacccgttcgcatcacgcgctgtccccattga

SEQ ID NO: 19584 - DNA, 35 bp, Artificial Sequence
  Synthetic oligonucleotide
tactgacacattgtttgcaaaacacaacttcctta

SEQ ID NO: 19585 - DNA, 35 bp, Artificial Sequence
  Synthetic oligonucleotide
gaccacccgccatttgtccatttgcgtagcgacac

SEQ ID NO: 19586 - DNA, 35 bp, Artificial Sequence
  Synthetic oligonucleotide
gggagaccgactggttccccggcccatcacacacg

SEQ ID NO: 19587 - DNA, 35 bp, Artificial Sequence
  Synthetic oligonucleotide
gtcacatctcgcctgtgcactttaccggtcttact

SEQ ID NO: 19588 - DNA, 35 bp, Artificial Sequence
  Synthetic oligonucleotide
gacgccccccgcctggttgacagtccaaggtatct

SEQ ID NO: 19589 - DNA, 38 bp, Artificial Sequence
  Synthetic oligonucleotide
acccactcccgtcctaaatttctgttgagtcacgttga

SEQ ID NO: 19590 - DNA, 35 bp, Artificial Sequence
  Synthetic oligonucleotide
agccattcaccccatacacgtgcatgccctcctcg

SEQ ID NO: 19591 - DNA, 35 bp, Artificial Sequence
  Synthetic oligonucleotide
gtccccggcctcaccgccttgggtttcccatcact

SEQ ID NO: 19592 - DNA, 35 bp, Artificial Sequence
  Synthetic oligonucleotide
agcagtccagggtcctaactacacgctccccacct

SEQ ID NO: 19593 - DNA, 35 bp, Artificial Sequence
  Synthetic oligonucleotide
actcgccggggcctcgcatcccaacatgtagatct

SEQ ID NO: 19594 - DNA, 36 bp, Artificial Sequence
  Synthetic oligonucleotide
tacgcccgttactagtccttttatgtcgctcacaca

SEQ ID NO: 19595 - DNA, 37 bp, Artificial Sequence
  Synthetic oligonucleotide
atggagaggggggggacggacactgaggtaggatcga

SEQ ID NO: 19596 - DNA, 37 bp, Artificial Sequence
  Synthetic oligonucleotide
tacccgctcttctgcttagttcacgctcaccctggga

SEQ ID NO: 19597 - DNA, 36 bp, Artificial Sequence
  Synthetic oligonucleotide
tagtcaacgaccgttcttatgccccacccccgacta

SEQ ID NO: 19598 - DNA, 35 bp, Artificial Sequence
  Synthetic oligonucleotide
gtgcggatccgaatgccagcttcactcacccccta

SEQ ID NO: 19599 - DNA, 35 bp, Artificial Sequence
  Synthetic oligonucleotide
ggatcaatgcctccgtttctgccgtatctcaagcc

SEQ ID NO: 19600 - DNA, 35 bp, Artificial Sequence
  Synthetic oligonucleotide
gtcctgcacatgaacctgttaattactgtcaccct

SEQ ID NO: 19601 - DNA, 37 bp, Artificial Sequence
  Synthetic oligonucleotide
tccacccccattcatgagccctacaacagaccgtcga

SEQ ID NO: 19602 - DNA, 37 bp, Artificial Sequence
  Synthetic oligonucleotide
aacacacaacgcattccatttcgcaagtccacccgga

SEQ ID NO: 19603 - DNA, 37 bp, Artificial Sequence
  Synthetic oligonucleotide
agcatggagcgagggcaagaggaggaattacaaggga

SEQ ID NO: 19604 - DNA, 38 bp, Artificial Sequence
  Synthetic oligonucleotide
gatgagaaggaggctgacgcacggggaagagaggatga

SEQ ID NO: 19605 - DNA, 37 bp, Artificial Sequence
  Synthetic oligonucleotide
gcgaagaacgggaagggtcaagggagggttatcctga

SEQ ID NO: 19606 - DNA, 35 bp, Artificial Sequence
  Synthetic oligonucleotide
acagccgtctaaccgttttcgctggcccctctgcc

SEQ ID NO: 19607 - DNA, 35 bp, Artificial Sequence
  Synthetic oligonucleotide
atagtccgtcgcatgcacctcacctgggtttcccg

SEQ ID NO: 19608 - DNA, 35 bp, Artificial Sequence
  Synthetic oligonucleotide
tgccctgcccccacctaaggtggacgaccttccat

SEQ ID NO: 19609 - DNA, 35 bp, Artificial Sequence
  Synthetic oligonucleotide
ggacgtccgaccctctgctatttctacctgactct

SEQ ID NO: 19610 - DNA, 35 bp, Artificial Sequence
  Synthetic oligonucleotide
attgctcggtacccctctctgtcaccacctgcggt

SEQ ID NO: 19611 - DNA, 36 bp, Artificial Sequence
  Synthetic oligonucleotide
tctccccgccccatgaatacattctggcttgtaaaa

SEQ ID NO: 19612 - DNA, 35 bp, Artificial Sequence
  Synthetic oligonucleotide
gtactagggagggagtggggggattgaggcgtgaa

SEQ ID NO: 19613 - DNA, 35 bp, Artificial Sequence
  Synthetic oligonucleotide
ttgcctgcatcagcttatctccccgtatcccacca

SEQ ID NO: 19614 - DNA, 36 bp, Artificial Sequence
  Synthetic oligonucleotide
tgcattgagcctgggggtgtggggtgggctgaagga

SEQ ID NO: 19615 - DNA, 37 bp, Artificial Sequence
  Synthetic oligonucleotide
actctgccccattcgatacccagagccacttcacgga

SEQ ID NO: 19616 - DNA, 38 bp, Artificial Sequence
  Synthetic oligonucleotide
tctggtccgcagccaaactaacttcagcccccgagtga

SEQ ID NO: 19617 - DNA, 36 bp, Artificial Sequence
  Synthetic oligonucleotide
tcacctacaacacgagctccgtggcttcctgctcta

SEQ ID NO: 19618 - DNA, 35 bp, Artificial Sequence
  Synthetic oligonucleotide
tctaatccgccacccccctgattggacgggccacc

SEQ ID NO: 19619 - DNA, 35 bp, Artificial Sequence
  Synthetic oligonucleotide
tactacgtccgtttcgtccccccgcatgatatagt

SEQ ID NO: 19620 - DNA, 35 bp, Artificial Sequence
  Synthetic oligonucleotide
tgatggcctacctgcgaacctcctgactttcgaaa

SEQ ID NO: 19621 - DNA, 37 bp, Artificial Sequence
  Synthetic oligonucleotide
aacaggtagagacaaggaaaggagcagggaaacgtga

SEQ ID NO: 19622 - DNA, 35 bp, Artificial Sequence
  Synthetic oligonucleotide
tgacgcctcactccccaatccctcagggtatacta

SEQ ID NO: 19623 - DNA, 35 bp, Artificial Sequence
  Synthetic oligonucleotide
gatgccatacccctgggctgccgcctcaaccgaac

SEQ ID NO: 19624 - DNA, 35 bp, Artificial Sequence
  Synthetic oligonucleotide
tgccccataaccactgtgtgctcgtgccatccgtc

SEQ ID NO: 19625 - DNA, 35 bp, Artificial Sequence
  Synthetic oligonucleotide
ttgatccgcaggggtccgaccgcccgcctctctct

SEQ ID NO: 19626 - DNA, 34 bp, Artificial Sequence
  Synthetic oligonucleotide
gtgtccaccccatccagactctcgctcactagaa

SEQ ID NO: 19627 - DNA, 38 bp, Artificial Sequence
  Synthetic oligonucleotide
acgtaacgacccaaacctaatattgaggacctccctga

SEQ ID NO: 19628 - DNA, 34 bp, Artificial Sequence
  Synthetic oligonucleotide
tgcacactgggccttttacaacgaaaccgctctc

SEQ ID NO: 19629 - DNA, 35 bp, Artificial Sequence
  Synthetic oligonucleotide
tcacccattcacagtctgcgcttctctttcgtctc

SEQ ID NO: 19630 - DNA, 36 bp, Artificial Sequence
  Synthetic oligonucleotide
ttaggttaccttccgacgtcacctcttgcccccgag

SEQ ID NO: 19631 - DNA, 35 bp, Artificial Sequence
  Synthetic oligonucleotide
gacaccactccttctgcctctgcgctgtttctccg

SEQ ID NO: 19632 - DNA, 35 bp, Artificial Sequence
  Synthetic oligonucleotide
tacctcgcctcatacacgccatcaagacctcaggg

SEQ ID NO: 19633 - DNA, 35 bp, Artificial Sequence
  Synthetic oligonucleotide
gacacttcgccctatccctgcggataaaactccat

SEQ ID NO: 19634 - DNA, 37 bp, Artificial Sequence
  Synthetic oligonucleotide
accacgatagccgccgcctctcgcaatgacttgctga

SEQ ID NO: 19635 - DNA, 38 bp, Artificial Sequence
  Synthetic oligonucleotide
tcgaagacgcccactggatcgcgcactgcacacattga

SEQ ID NO: 19636 - DNA, 35 bp, Artificial Sequence
  Synthetic oligonucleotide
tacgatagcactaactactgtgctccataatgtcc

SEQ ID NO: 19637 - DNA, 37 bp, Artificial Sequence
  Synthetic oligonucleotide
gactgcctcgaacgtaacacgcctccactctcaaaga

SEQ ID NO: 19638 - DNA, 37 bp, Artificial Sequence
  Synthetic oligonucleotide
ggtgcgacgttgtctctttctccgtcccgttgcctga

SEQ ID NO: 19639 - DNA, 37 bp, Artificial Sequence
  Synthetic oligonucleotide
tctaggctagggggggtgggtgaatagtgctgggtga

SEQ ID NO: 19640 - DNA, 36 bp, Artificial Sequence
  Synthetic oligonucleotide
agattaggggagagcggtttaaggtggcggggggta

SEQ ID NO: 19641 - DNA, 35 bp, Artificial Sequence
  Synthetic oligonucleotide
gatctagctcctgttatcccccctacacgttaggc

SEQ ID NO: 19642 - DNA, 38 bp, Artificial Sequence
  Synthetic oligonucleotide
accctgggcctgtcgttttcacctgcctattcttttga

SEQ ID NO: 19643 - DNA, 35 bp, Artificial Sequence
  Synthetic oligonucleotide
tgatagccgatactgtcaccgccttggcccacttc

SEQ ID NO: 19644 - DNA, 35 bp, Artificial Sequence
  Synthetic oligonucleotide
ggggaaggggggagggtaaaagtatactaacgcag

SEQ ID NO: 19645 - DNA, 34 bp, Artificial Sequence
  Synthetic oligonucleotide
gaaccgtagggcggtgggcgggactggaggacgg

SEQ ID NO: 19646 - DNA, 35 bp, Artificial Sequence
  Synthetic oligonucleotide
actcaaccaaccgcctacgacctcgaaccagtaat

SEQ ID NO: 19647 - DNA, 36 bp, Artificial Sequence
  Synthetic oligonucleotide
tagcccaccgaccgccggggcccaaaaagtagaaaa

SEQ ID NO: 19648 - DNA, 35 bp, Artificial Sequence
  Synthetic oligonucleotide
attccatgcccgcatagtgccacgaacctagtgca

SEQ ID NO: 19649 - DNA, 37 bp, Artificial Sequence
  Synthetic oligonucleotide
ggaggggagggcggtaggcgtcgggagacgggggcga

SEQ ID NO: 19650 - DNA, 38 bp, Artificial Sequence
  Synthetic oligonucleotide
ggacctcacctgtcatacgcacatcttagcttcactga

SEQ ID NO: 19651 - DNA, 38 bp, Artificial Sequence
  Synthetic oligonucleotide
aatgcgccggtcgccgtgcctggctcacctatacttga

SEQ ID NO: 19652 - DNA, 37 bp, Artificial Sequence
  Synthetic oligonucleotide
taccccggtctggaccctcttttgtcagtctccttga

SEQ ID NO: 19653 - DNA, 35 bp, Artificial Sequence
  Synthetic oligonucleotide
agcacaccctatagcctgagccttttttcactact

SEQ ID NO: 19654 - DNA, 35 bp, Artificial Sequence
  Synthetic oligonucleotide
taccaccccaccgagcttaacgttccttgtttgct

SEQ ID NO: 19655 - DNA, 35 bp, Artificial Sequence
  Synthetic oligonucleotide
gatgaccagtcaggagcggaccaggggagggtgaa

SEQ ID NO: 19656 - DNA, 35 bp, Artificial Sequence
  Synthetic oligonucleotide
tagtgccctagccgtacaccttgctatagcaaccc

SEQ ID NO: 19657 - DNA, 36 bp, Artificial Sequence
  Synthetic oligonucleotide
tcccaccctggttgtcatccacgcactgcccactaa

SEQ ID NO: 19658 - DNA, 35 bp, Artificial Sequence
  Synthetic oligonucleotide
gaccgttctcatgtccagccctgttgccgccggca

SEQ ID NO: 19659 - DNA, 37 bp, Artificial Sequence
  Synthetic oligonucleotide
tgaaatggggggagagaggaaagagaagggagtgcga

SEQ ID NO: 19660 - DNA, 37 bp, Artificial Sequence
  Synthetic oligonucleotide
gagcgggggaggggaggtgtacggagcgatggttgga

SEQ ID NO: 19661 - DNA, 36 bp, Artificial Sequence
  Synthetic oligonucleotide
acgccgaacttcgaccccgttatgcctgactgctta

SEQ ID NO: 19662 - DNA, 35 bp, Artificial Sequence
  Synthetic oligonucleotide
ggggaccatccacgcgcagggccaccgctactccc

SEQ ID NO: 19663 - DNA, 35 bp, Artificial Sequence
  Synthetic oligonucleotide
tcacagctgccatcttgcttctaacaacgcatcca

SEQ ID NO: 19664 - DNA, 38 bp, Artificial Sequence
  Synthetic oligonucleotide
accctccatcccgtaatgcttcatgccacatgtcgtga

SEQ ID NO: 19665 - DNA, 35 bp, Artificial Sequence
  Synthetic oligonucleotide
agttagtgggcgggagaacgggggatgcagggtac

SEQ ID NO: 19666 - DNA, 35 bp, Artificial Sequence
  Synthetic oligonucleotide
tcagtaggggggggcggggtgaagattgctcgttc

SEQ ID NO: 19667 - DNA, 35 bp, Artificial Sequence
  Synthetic oligonucleotide
atggaggggggaaagatggggaaactacaaaagcg

SEQ ID NO: 19668 - DNA, 35 bp, Artificial Sequence
  Synthetic oligonucleotide
gcgccccacatgctcggcctgatagtctacgccac

SEQ ID NO: 19669 - DNA, 35 bp, Artificial Sequence
  Synthetic oligonucleotide
ttcctaccccgacgacacacaggacgcataacggc

SEQ ID NO: 19670 - DNA, 35 bp, Artificial Sequence
  Synthetic oligonucleotide
tgagggggggggtggggagggagcaatatcgtacg

SEQ ID NO: 19671 - DNA, 35 bp, Artificial Sequence
  Synthetic oligonucleotide
tttgagccctcgttgttcatgcacttgtattctgt

SEQ ID NO: 19672 - DNA, 36 bp, Artificial Sequence
  Synthetic oligonucleotide
tccaggcctctcccccttcgtagccggttcgttcca

SEQ ID NO: 19673 - DNA, 37 bp, Artificial Sequence
  Synthetic oligonucleotide
agacctggtgggggcgctgtaaaggggggagcgggga

SEQ ID NO: 19674 - DNA, 37 bp, Artificial Sequence
  Synthetic oligonucleotide
tccccaccccatactctttaagctccggacagttgga

SEQ ID NO: 19675 - DNA, 38 bp, Artificial Sequence
  Synthetic oligonucleotide
agagggtgggagcgcaccccatctgggtgggattatga

SEQ ID NO: 19676 - DNA, 36 bp, Artificial Sequence
  Synthetic oligonucleotide
gaatatccagccccacgtgtcgggctctcccctgta

SEQ ID NO: 19677 - DNA, 35 bp, Artificial Sequence
  Synthetic oligonucleotide
gcgaccacctccgccggtagtatcgactgtacccc

SEQ ID NO: 19678 - DNA, 35 bp, Artificial Sequence
  Synthetic oligonucleotide
tgctaaccgcccgctcgtttggacaccacaagcct

SEQ ID NO: 19679 - DNA, 35 bp, Artificial Sequence
  Synthetic oligonucleotide
gcaaccccgtcacacacatcggctcaatccactct

SEQ ID NO: 19680 - DNA, 35 bp, Artificial Sequence
  Synthetic oligonucleotide
acacctcgtcatatagctcatgactcctctcgtct

SEQ ID NO: 19681 - DNA, 36 bp, Artificial Sequence
  Synthetic oligonucleotide
accagagcgagtgacaggaagggaaggacgtagcga

SEQ ID NO: 19682 - DNA, 37 bp, Artificial Sequence
  Synthetic oligonucleotide
acctgcgcacgtggaaatggaaattggtgggaaggga

SEQ ID NO: 19683 - DNA, 36 bp, Artificial Sequence
  Synthetic oligonucleotide
ttgcctgcaggtctccacgtctgccttaccgaccta

SEQ ID NO: 19684 - DNA, 36 bp, Artificial Sequence
  Synthetic oligonucleotide
agtaccacctccgcgacagttctaactccccctgta

SEQ ID NO: 19685 - DNA, 35 bp, Artificial Sequence
  Synthetic oligonucleotide
gatgattccgctgttggaccttccctcgaacatta

SEQ ID NO: 19686 - DNA, 35 bp, Artificial Sequence
  Synthetic oligonucleotide
gtcacgctctccgggtggctcatcataccttacgc

SEQ ID NO: 19687 - DNA, 35 bp, Artificial Sequence
  Synthetic oligonucleotide
gatcacccgtcgccgtctccctactactgtcagat

SEQ ID NO: 19688 - DNA, 35 bp, Artificial Sequence
  Synthetic oligonucleotide
gtgatcgtcctccttgcatagttacgcgtcccttt

SEQ ID NO: 19689 - DNA, 35 bp, Artificial Sequence
  Synthetic oligonucleotide
tgcttaccaccgcgttgctcagacacttgcctttt

SEQ ID NO: 19690 - DNA, 36 bp, Artificial Sequence
  Synthetic oligonucleotide
acctcagctccgcgccgctccagcctctgccactaa

SEQ ID NO: 19691 - DNA, 36 bp, Artificial Sequence
  Synthetic oligonucleotide
atgccccccggctgaaagtgccatctcctggcccca

SEQ ID NO: 19692 - DNA, 37 bp, Artificial Sequence
  Synthetic oligonucleotide
tgacatcgctagaccctactatgctcatcctcttcga

SEQ ID NO: 19693 - DNA, 37 bp, Artificial Sequence
  Synthetic oligonucleotide
acgccccccgccgagactatgagcttgaattttctga

SEQ ID NO: 19694 - DNA, 37 bp, Artificial Sequence
  Synthetic oligonucleotide
gttggtcagcacttattcctctggggccacaacttga

SEQ ID NO: 19695 - DNA, 38 bp, Artificial Sequence
  Synthetic oligonucleotide
ttcgcacgtaccatcttgggacggaggacctttcttga

SEQ ID NO: 19696 - DNA, 35 bp, Artificial Sequence
  Synthetic oligonucleotide
actcgtgccctaatggcatcctttgttgctgtact

SEQ ID NO: 19697 - DNA, 38 bp, Artificial Sequence
  Synthetic oligonucleotide
gtgtgggggtgggcgccgtgggagcaagggcgaagtga

SEQ ID NO: 19698 - DNA, 37 bp, Artificial Sequence
  Synthetic oligonucleotide
agaccctccccattggccctgtatcacagctccgtga

SEQ ID NO: 19699 - DNA, 35 bp, Artificial Sequence
  Synthetic oligonucleotide
ttggcgctccctctccacctgccgaccgctgatac

SEQ ID NO: 19700 - DNA, 35 bp, Artificial Sequence
  Synthetic oligonucleotide
acgcctcccgaaccctgtcgactattcctgggact

SEQ ID NO: 19701 - DNA, 37 bp, Artificial Sequence
  Synthetic oligonucleotide
atgcggggacattaatggtggaggtagggtggtgaga

SEQ ID NO: 19702 - DNA, 38 bp, Artificial Sequence
  Synthetic oligonucleotide
tccgaggccttcttcgtggttcttctcctgccccctga

SEQ ID NO: 19703 - DNA, 35 bp, Artificial Sequence
  Synthetic oligonucleotide
atgtgggggggccgatggaagggcgtagtgggtga

SEQ ID NO: 19704 - DNA, 35 bp, Artificial Sequence
  Synthetic oligonucleotide
taagttcacgccattatctctcgcccgttctcgcc

SEQ ID NO: 19705 - DNA, 35 bp, Artificial Sequence
  Synthetic oligonucleotide
tgtcaggggagataacgaagagtggaagggggagg

SEQ ID NO: 19706 - DNA, 35 bp, Artificial Sequence
  Synthetic oligonucleotide
gagcgctcaatgccgctccctttgtaattgtcctg

SEQ ID NO: 19707 - DNA, 35 bp, Artificial Sequence
  Synthetic oligonucleotide
ttgacatccccacgcccctaagcgatcccaaggat

SEQ ID NO: 19708 - DNA, 35 bp, Artificial Sequence
  Synthetic oligonucleotide
gaaaacgttcacgacgttaatctaccccctcgcct

SEQ ID NO: 19709 - DNA, 35 bp, Artificial Sequence
  Synthetic oligonucleotide
ggaggggggcaaacaagaggatgggacatggcgga

SEQ ID NO: 19710 - DNA, 35 bp, Artificial Sequence
  Synthetic oligonucleotide
tgttaagccaccgttctacttgcgacccgcctaac

SEQ ID NO: 19711 - DNA, 35 bp, Artificial Sequence
  Synthetic oligonucleotide
acttcccaccggtcgactgcaccttaataacgatc

SEQ ID NO: 19712 - DNA, 35 bp, Artificial Sequence
  Synthetic oligonucleotide
gatgcaaggggggagtcagggggaaccggtggatg

SEQ ID NO: 19713 - DNA, 35 bp, Artificial Sequence
  Synthetic oligonucleotide
gacgcacctactacaggagtttgttctggcttcct

SEQ ID NO: 19714 - DNA, 35 bp, Artificial Sequence
  Synthetic oligonucleotide
tcacgacacaatgtcgcttcctttgccaatcattt

SEQ ID NO: 19715 - DNA, 34 bp, Artificial Sequence
  Synthetic oligonucleotide
ggaacctacgccccggctgtctttctcgagcaca

SEQ ID NO: 19716 - DNA, 35 bp, Artificial Sequence
  Synthetic oligonucleotide
agaacactgctcccgacgctgatcattcttccata

SEQ ID NO: 19717 - DNA, 35 bp, Artificial Sequence
  Synthetic oligonucleotide
gagacgagagtgggtacttatgacggagggggtag

SEQ ID NO: 19718 - DNA, 35 bp, Artificial Sequence
  Synthetic oligonucleotide
gtgggctagcacgccagccgaccttttcatcttgt

SEQ ID NO: 19719 - DNA, 35 bp, Artificial Sequence
  Synthetic oligonucleotide
tacccgattcgttcccgctgctatccagtgctaca

SEQ ID NO: 19720 - DNA, 35 bp, Artificial Sequence
  Synthetic oligonucleotide
acgtgagccgggcgcgtcgccgctccaactccctt

SEQ ID NO: 19721 - DNA, 36 bp, Artificial Sequence
  Synthetic oligonucleotide
accagccccattgtttttccgccggcctgacccaga

SEQ ID NO: 19722 - DNA, 38 bp, Artificial Sequence
  Synthetic oligonucleotide
gtgcggagggtgaatcgtggagggaagaatggacatga

SEQ ID NO: 19723 - DNA, 35 bp, Artificial Sequence
  Synthetic oligonucleotide
ggaggtcgggcggattaaacacgtgagggaggggc

SEQ ID NO: 19724 - DNA, 35 bp, Artificial Sequence
  Synthetic oligonucleotide
ccacaaccccagcccttgttcgcgccacctcctcg

SEQ ID NO: 19725 - DNA, 36 bp, Artificial Sequence
  Synthetic oligonucleotide
gcacgtttctggccgcacaaagccccgttcgttaca

SEQ ID NO: 19726 - DNA, 36 bp, Artificial Sequence
  Synthetic oligonucleotide
gagctacatgcctttctgaatccgttacgccactca

SEQ ID NO: 19727 - DNA, 36 bp, Artificial Sequence
  Synthetic oligonucleotide
ttgctacccggcgcttttacttccgtttgttcctca

SEQ ID NO: 19728 - DNA, 35 bp, Artificial Sequence
  Synthetic oligonucleotide
gttgagagggaagggatggcggttcaaggaggtca

SEQ ID NO: 19729 - DNA, 37 bp, Artificial Sequence
  Synthetic oligonucleotide
accacacgtcattcttccccccccgtctgctgaagga

SEQ ID NO: 19730 - DNA, 37 bp, Artificial Sequence
  Synthetic oligonucleotide
gccgcacgtacctctcatggttttgtcttaccccgga

SEQ ID NO: 19731 - DNA, 36 bp, Artificial Sequence
  Synthetic oligonucleotide
accacccgattccgtgtacctctctctcacagggga

SEQ ID NO: 19732 - DNA, 37 bp, Artificial Sequence
  Synthetic oligonucleotide
gctcaaagcaggtgaagcaatggatggtgctggtgga

SEQ ID NO: 19733 - DNA, 35 bp, Artificial Sequence
  Synthetic oligonucleotide
acccacagcatttgctgtcactcataacaccatga

SEQ ID NO: 19734 - DNA, 38 bp, Artificial Sequence
  Synthetic oligonucleotide
acacctctacacccatgcatttccgggacagatcatga

SEQ ID NO: 19735 - DNA, 35 bp, Artificial Sequence
  Synthetic oligonucleotide
acacacatgcagcaacagctaagcatcccctgtac

SEQ ID NO: 19736 - DNA, 35 bp, Artificial Sequence
  Synthetic oligonucleotide
gggcaactcacactctgctactaccacgccccact

SEQ ID NO: 19737 - DNA, 37 bp, Artificial Sequence
  Synthetic oligonucleotide
tgaccgggccggtgtgggagggtccaaacctaggaga

SEQ ID NO: 19738 - DNA, 37 bp, Artificial Sequence
  Synthetic oligonucleotide
acacacacgttcccggtaagccgccgttttcattcga

SEQ ID NO: 19739 - DNA, 37 bp, Artificial Sequence
  Synthetic oligonucleotide
ggaccgagctggtagaatgggggggcgggaaaactga

SEQ ID NO: 19740 - DNA, 37 bp, Artificial Sequence
  Synthetic oligonucleotide
gacgaggtatgagacagggcgggcgaggggggtttga

SEQ ID NO: 19741 - DNA, 35 bp, Artificial Sequence
  Synthetic oligonucleotide
atgcctgccttcgctcttttcattccgtcaccgta

SEQ ID NO: 19742 - DNA, 35 bp, Artificial Sequence
  Synthetic oligonucleotide
tagtcgatgccctattgtacctcccttccagcaac

SEQ ID NO: 19743 - DNA, 35 bp, Artificial Sequence
  Synthetic oligonucleotide
accatgacgaccggtaattacttctagcacctctt

SEQ ID NO: 19744 - DNA, 36 bp, Artificial Sequence
  Synthetic oligonucleotide
gctgccccacataactctttccgagcagcgcttaaa

SEQ ID NO: 19745 - DNA, 35 bp, Artificial Sequence
  Synthetic oligonucleotide
atcactaccgtcaggtgtccgtcgcccatctaaca

SEQ ID NO: 19746 - DNA, 36 bp, Artificial Sequence
  Synthetic oligonucleotide
gctaggaaggggtaataggtgggaggagggagaaga

SEQ ID NO: 19747 - DNA, 37 bp, Artificial Sequence
  Synthetic oligonucleotide
gtgagggtaggaagggagataggtgccaggggtaaga

SEQ ID NO: 19748 - DNA, 35 bp, Artificial Sequence
  Synthetic oligonucleotide
tgagcggtggggacatgggggaccaagggagagga

SEQ ID NO: 19749 - DNA, 35 bp, Artificial Sequence
  Synthetic oligonucleotide
acgtactaacacaccgctctcacaaccaggtcctg

SEQ ID NO: 19750 - DNA, 35 bp, Artificial Sequence
  Synthetic oligonucleotide
gcagacctctgcgcgactcccctatttccctgtct

SEQ ID NO: 19751 - DNA, 35 bp, Artificial Sequence
  Synthetic oligonucleotide
gcgctaccactgagcctggatcccctgtgaacatt

SEQ ID NO: 19752 - DNA, 37 bp, Artificial Sequence
  Synthetic oligonucleotide
gaccgccctgtcatcagtacacacctgccgcacccga

SEQ ID NO: 19753 - DNA, 38 bp, Artificial Sequence
  Synthetic oligonucleotide
gctgggaaaacggagggtggacgcagatcgagggatga

SEQ ID NO: 19754 - DNA, 36 bp, Artificial Sequence
  Synthetic oligonucleotide
acagaaggggaggtagggaaggggtatgcggactga

SEQ ID NO: 19755 - DNA, 34 bp, Artificial Sequence
  Synthetic oligonucleotide
gcttcgccacctctgcgacgaccttatttcccta

SEQ ID NO: 19756 - DNA, 35 bp, Artificial Sequence
  Synthetic oligonucleotide
tccgatcgggaccgaatgtgacgccgccaccctac

SEQ ID NO: 19757 - DNA, 34 bp, Artificial Sequence
  Synthetic oligonucleotide
gatggatcaacacagcatgcgctttatggcctac

SEQ ID NO: 19758 - DNA, 35 bp, Artificial Sequence
  Synthetic oligonucleotide
gaaccgctattcgtcgcactcaacgcgcgcatttc

SEQ ID NO: 19759 - DNA, 35 bp, Artificial Sequence
  Synthetic oligonucleotide
agattccacccatccgacctgttcatacgcgaaat

SEQ ID NO: 19760 - DNA, 35 bp, Artificial Sequence
  Synthetic oligonucleotide
tactccactccgggcactctgccaacctttagtgt

SEQ ID NO: 19761 - DNA, 36 bp, Artificial Sequence
  Synthetic oligonucleotide
acccctgtcccgagtacatctcctgtcctgtcacca

SEQ ID NO: 19762 - DNA, 35 bp, Artificial Sequence
  Synthetic oligonucleotide
tgccaatcaccgcttgcccaaggccactgctatca

SEQ ID NO: 19763 - DNA, 36 bp, Artificial Sequence
  Synthetic oligonucleotide
tctcgcctgaccttccagaccttacatatgacttga

SEQ ID NO: 19764 - DNA, 38 bp, Artificial Sequence
  Synthetic oligonucleotide
gccctggtgagctgaactatgcatgcaccatcccttga

SEQ ID NO: 19765 - DNA, 35 bp, Artificial Sequence
  Synthetic oligonucleotide
ttgggtcgctcgcactcggctatttacgctccaac

SEQ ID NO: 19766 - DNA, 37 bp, Artificial Sequence
  Synthetic oligonucleotide
atcaactcagtcgcatccgtgctaaaacccgtctcgc

SEQ ID NO: 19767 - DNA, 35 bp, Artificial Sequence
  Synthetic oligonucleotide
tctcactcatatcgcagccactctgaccctctatc

SEQ ID NO: 19768 - DNA, 35 bp, Artificial Sequence
  Synthetic oligonucleotide
gcacgcacgtatcccacccttccattgtattagcg

SEQ ID NO: 19769 - DNA, 35 bp, Artificial Sequence
  Synthetic oligonucleotide
aatccaaccgcactgagtccatggcactgcctaaa

SEQ ID NO: 19770 - DNA, 35 bp, Artificial Sequence
  Synthetic oligonucleotide
atttcactgctcaccgctgcatttggcttgtttca

SEQ ID NO: 19771 - DNA, 35 bp, Artificial Sequence
  Synthetic oligonucleotide
ggaccgccatcccgccgtcgccttacatctacgcg

SEQ ID NO: 19772 - DNA, 35 bp, Artificial Sequence
  Synthetic oligonucleotide
ttcacgtgccatgtctccgctctgagtttctatca

SEQ ID NO: 19773 - DNA, 36 bp, Artificial Sequence
  Synthetic oligonucleotide
gtgcaacagggagcaaggaaggaggatcagaccgga

SEQ ID NO: 19774 - DNA, 38 bp, Artificial Sequence
  Synthetic oligonucleotide
gccagagcggattagtggcccgacccctctccatttga

SEQ ID NO: 19775 - DNA, 36 bp, Artificial Sequence
  Synthetic oligonucleotide
ttacccccactcgtgcgatttcaactgactttacta

SEQ ID NO: 19776 - DNA, 36 bp, Artificial Sequence
  Synthetic oligonucleotide
tacaactcacatagccgcccacctctcaacgcagta

SEQ ID NO: 19777 - DNA, 35 bp, Artificial Sequence
  Synthetic oligonucleotide
gtgacatgccgggctattttcgaaccaccctaaag

SEQ ID NO: 19778 - DNA, 35 bp, Artificial Sequence
  Synthetic oligonucleotide
aacccccaagatccgttcttcacacctaagatccg

SEQ ID NO: 19779 - DNA, 35 bp, Artificial Sequence
  Synthetic oligonucleotide
gagaagggggggagctagggcaggctccgtagtgg

SEQ ID NO: 19780 - DNA, 35 bp, Artificial Sequence
  Synthetic oligonucleotide
tagacgggggaagggtagggcggagcctaggcaca

SEQ ID NO: 19781 - DNA, 37 bp, Artificial Sequence
  Synthetic oligonucleotide
gtccacctacccagcactgtttcctcagctttcctga

SEQ ID NO: 19782 - DNA, 36 bp, Artificial Sequence
  Synthetic oligonucleotide
actcaacccacctggttcccgctgttctcgtaacta

SEQ ID NO: 19783 - DNA, 35 bp, Artificial Sequence
  Synthetic oligonucleotide
tcccggtggccctgtgtgcccctttacccctcacc

SEQ ID NO: 19784 - DNA, 35 bp, Artificial Sequence
  Synthetic oligonucleotide
actgccgccctgccttcttaacatcatagcgtcct

SEQ ID NO: 19785 - DNA, 36 bp, Artificial Sequence
  Synthetic oligonucleotide
tctatgtgctccgttcccctgcccgtttcaccgcga

SEQ ID NO: 19786 - DNA, 38 bp, Artificial Sequence
  Synthetic oligonucleotide
gtggtcaaacacgggtatggggtgggttgggaaggtga

SEQ ID NO: 19787 - DNA, 35 bp, Artificial Sequence
  Synthetic oligonucleotide
gttccacctcagaaacccccattccgactatcgcg

SEQ ID NO: 19788 - DNA, 35 bp, Artificial Sequence
  Synthetic oligonucleotide
agcccatccctaactatatcatcctgccgccatcg

SEQ ID NO: 19789 - DNA, 35 bp, Artificial Sequence
  Synthetic oligonucleotide
tccattgtactgattcttttactgctccaccttcg

SEQ ID NO: 19790 - DNA, 36 bp, Artificial Sequence
  Synthetic oligonucleotide
gtcgacacagctcacacgttccccggtctgactaca

SEQ ID NO: 19791 - DNA, 36 bp, Artificial Sequence
  Synthetic oligonucleotide
atcagatggcccactctcgttgccgcgccctcttca

SEQ ID NO: 19792 - DNA, 37 bp, Artificial Sequence
  Synthetic oligonucleotide
acagacatcggagagggggaaaggggtggcacgcgga

SEQ ID NO: 19793 - DNA, 35 bp, Artificial Sequence
  Synthetic oligonucleotide
tctgaacgcgcattcgtggccatcccctgcgcacc

SEQ ID NO: 19794 - DNA, 35 bp, Artificial Sequence
  Synthetic oligonucleotide
gcaaagttcgagcaccgctttatagtccacccccc

SEQ ID NO: 19795 - DNA, 35 bp, Artificial Sequence
  Synthetic oligonucleotide
atccatcctacgtcgtttactcagccgcccccttc

SEQ ID NO: 19796 - DNA, 35 bp, Artificial Sequence
  Synthetic oligonucleotide
tcatagcgcgctcctatccgttgattcatactccg

SEQ ID NO: 19797 - DNA, 35 bp, Artificial Sequence
  Synthetic oligonucleotide
ttgtccgaggtagccagtccctatcgctcctactg

SEQ ID NO: 19798 - DNA, 35 bp, Artificial Sequence
  Synthetic oligonucleotide
ttgcctccctccggcgggcaggtacatccctccat

SEQ ID NO: 19799 - DNA, 36 bp, Artificial Sequence
  Synthetic oligonucleotide
tccgtccacccgttatcgcacccgttactcacttaa

SEQ ID NO: 19800 - DNA, 37 bp, Artificial Sequence
  Synthetic oligonucleotide
gatgcgttaccaccatcgcgccacccagaatcactga

SEQ ID NO: 19801 - DNA, 38 bp, Artificial Sequence
  Synthetic oligonucleotide
acccacccgcctttgcatagtttggatatgtcccttga

SEQ ID NO: 19802 - DNA, 35 bp, Artificial Sequence
  Synthetic oligonucleotide
ttgatccacgtactctcacctcaacagtgccccca

SEQ ID NO: 19803 - DNA, 36 bp, Artificial Sequence
  Synthetic oligonucleotide
ggaaacgggggtggacgtgagggggtttgatgcgga

SEQ ID NO: 19804 - DNA, 38 bp, Artificial Sequence
  Synthetic oligonucleotide
tgacatatcacatcctgccttttatgcgttccctttga

SEQ ID NO: 19805 - DNA, 35 bp, Artificial Sequence
  Synthetic oligonucleotide
taacctcagccacctatatgtttcgccgcatcaac

SEQ ID NO: 19806 - DNA, 35 bp, Artificial Sequence
  Synthetic oligonucleotide
gcaacgcgcttcacttcccgttcctcaatgagcac

SEQ ID NO: 19807 - DNA, 35 bp, Artificial Sequence
  Synthetic oligonucleotide
cctcactaacggcttgtattcagcgattctcgtcc

SEQ ID NO: 19808 - DNA, 38 bp, Artificial Sequence
  Synthetic oligonucleotide
atggaagggtagggagggtcttaatgccggggcaatga

SEQ ID NO: 19809 - DNA, 35 bp, Artificial Sequence
  Synthetic oligonucleotide
gacgtcgcaatgtcctgacatttataccttttttc

SEQ ID NO: 19810 - DNA, 35 bp, Artificial Sequence
  Synthetic oligonucleotide
ttagggcgggccagggagggacttcgcactgatcg

SEQ ID NO: 19811 - DNA, 35 bp, Artificial Sequence
  Synthetic oligonucleotide
tttgcgtgactggtacatttgctgcgtttgcccct

SEQ ID NO: 19812 - DNA, 35 bp, Artificial Sequence
  Synthetic oligonucleotide
gtgcccctgttcttgagcctcagccaccgaattct

SEQ ID NO: 19813 - DNA, 35 bp, Artificial Sequence
  Synthetic oligonucleotide
tccttgcccgtcctcattattgcctgttcactatt

SEQ ID NO: 19814 - DNA, 35 bp, Artificial Sequence
  Synthetic oligonucleotide
gtctctgccacttagtccggtacaccttctgccaa

SEQ ID NO: 19815 - DNA, 36 bp, Artificial Sequence
  Synthetic oligonucleotide
agtcgcatcgcccctgccggttatactttctcccga

SEQ ID NO: 19816 - DNA, 38 bp, Artificial Sequence
  Synthetic oligonucleotide
gtctccttcatccgcgtaccatagtctcactcacctga

SEQ ID NO: 19817 - DNA, 38 bp, Artificial Sequence
  Synthetic oligonucleotide
gccgcccggttcgtactagattccctgccttccgttga

SEQ ID NO: 19818 - DNA, 36 bp, Artificial Sequence
  Synthetic oligonucleotide
acgagtctcactctgctaccgatactgataaccata

SEQ ID NO: 19819 - DNA, 35 bp, Artificial Sequence
  Synthetic oligonucleotide
cttgccacccggtcgggtgttacccacgcacataa

SEQ ID NO: 19820 - DNA, 36 bp, Artificial Sequence
  Synthetic oligonucleotide
gcgatcagcaacattccgtcctttgaatctggcaca

SEQ ID NO: 19821 - DNA, 35 bp, Artificial Sequence
  Synthetic oligonucleotide
tatccccgacgcacctccgatccccgccagtgggc

SEQ ID NO: 19822 - DNA, 35 bp, Artificial Sequence
  Synthetic oligonucleotide
ggagccccctatgccccagagaacttcctgtcctt

SEQ ID NO: 19823 - DNA, 36 bp, Artificial Sequence
  Synthetic oligonucleotide
aggacacgccagatcttcaacctaccgccctcacca

SEQ ID NO: 19824 - DNA, 37 bp, Artificial Sequence
  Synthetic oligonucleotide
ttacagccccatttatgtttctgctctttgttcgcga

SEQ ID NO: 19825 - DNA, 36 bp, Artificial Sequence
  Synthetic oligonucleotide
acgtaatacatccgcctgccatgagttccatcttta

SEQ ID NO: 19826 - DNA, 35 bp, Artificial Sequence
  Synthetic oligonucleotide
tcaccattggcctaggttgactcactggctcctac

SEQ ID NO: 19827 - DNA, 35 bp, Artificial Sequence
  Synthetic oligonucleotide
gtttgcctcccgttgttctcggatttcccgtgtcc

SEQ ID NO: 19828 - DNA, 35 bp, Artificial Sequence
  Synthetic oligonucleotide
tgctccctcctgaaaccacgacttggcaacttctc

SEQ ID NO: 19829 - DNA, 35 bp, Artificial Sequence
  Synthetic oligonucleotide
actccgccggttccatcccaacgcagactccgtct

SEQ ID NO: 19830 - DNA, 35 bp, Artificial Sequence
  Synthetic oligonucleotide
taccatctgtccgcagcctcaaagacccttgtctt

SEQ ID NO: 19831 - DNA, 38 bp, Artificial Sequence
  Synthetic oligonucleotide
gcgaatgcacaggacctcctcatagctcttgtccgtga

SEQ ID NO: 19832 - DNA, 35 bp, Artificial Sequence
  Synthetic oligonucleotide
tctcagtcagcagacttttccatctttactttacg

SEQ ID NO: 19833 - DNA, 35 bp, Artificial Sequence
  Synthetic oligonucleotide
tctcccccgacgccatccccgacatctatcagcgg

SEQ ID NO: 19834 - DNA, 35 bp, Artificial Sequence
  Synthetic oligonucleotide
gtaaggaggaggggtatggtggacggcgatggcgg

SEQ ID NO: 19835 - DNA, 35 bp, Artificial Sequence
  Synthetic oligonucleotide
aaggacacccaagaccttgccccgataccggccct

SEQ ID NO: 19836 - DNA, 36 bp, Artificial Sequence
  Synthetic oligonucleotide
tcaccaccaccccactcttaagacgtgctttgccca

SEQ ID NO: 19837 - DNA, 37 bp, Artificial Sequence
  Synthetic oligonucleotide
ttcgtggaaactgggtgggaggggtgatggaacgaga

SEQ ID NO: 19838 - DNA, 37 bp, Artificial Sequence
  Synthetic oligonucleotide
acggacatcattgttcgcctgtatcaccctgccctga

SEQ ID NO: 19839 - DNA, 38 bp, Artificial Sequence
  Synthetic oligonucleotide
gatcgagagggggagtggcggtatgggaatgaatgtga

SEQ ID NO: 19840 - DNA, 38 bp, Artificial Sequence
  Synthetic oligonucleotide
gaccacatcaatggtcgtcttcactagtcatcatttga

SEQ ID NO: 19841 - DNA, 35 bp, Artificial Sequence
  Synthetic oligonucleotide
aaatcacccctgctcatttagcgtatgctgcctta

SEQ ID NO: 19842 - DNA, 36 bp, Artificial Sequence
  Synthetic oligonucleotide
gcctgggcatttgtcatcattcatctgtttccgtta

SEQ ID NO: 19843 - DNA, 35 bp, Artificial Sequence
  Synthetic oligonucleotide
tgctgtgcccctgggtgcccccttacacgaatgac

SEQ ID NO: 19844 - DNA, 35 bp, Artificial Sequence
  Synthetic oligonucleotide
ggtggtggggagggtaattggggcggagtgagcgc

SEQ ID NO: 19845 - DNA, 35 bp, Artificial Sequence
  Synthetic oligonucleotide
atgcgagcctctactcgtccaccacctaactctcg

SEQ ID NO: 19846 - DNA, 36 bp, Artificial Sequence
  Synthetic oligonucleotide
tcaccaccaccccacgcttaagacgtgcttttccca

SEQ ID NO: 19847 - DNA, 38 bp, Artificial Sequence
  Synthetic oligonucleotide
gcacccctcatctaggttcttcgggctacacactttga

SEQ ID NO: 19848 - DNA, 34 bp, Artificial Sequence
  Synthetic oligonucleotide
acccccccatgatgcatagcccacggttcccttc

SEQ ID NO: 19849 - DNA, 35 bp, Artificial Sequence
  Synthetic oligonucleotide
gccacccataattgtttccagcgagtctcgcccgg

SEQ ID NO: 19850 - DNA, 35 bp, Artificial Sequence
  Synthetic oligonucleotide
gaccacaacggggtggttatctaatgcctcctgct

SEQ ID NO: 19851 - DNA, 34 bp, Artificial Sequence
  Synthetic oligonucleotide
tcccttcaccctccagtccggtatcgggtacgta

SEQ ID NO: 19852 - DNA, 36 bp, Artificial Sequence
  Synthetic oligonucleotide
ttacgcggaaggaaggaaaactaggaatgaagggcg

SEQ ID NO: 19853 - DNA, 35 bp, Artificial Sequence
  Synthetic oligonucleotide
tggtaaatgcagacaccgttcctctgtcccccatg

SEQ ID NO: 19854 - DNA, 35 bp, Artificial Sequence
  Synthetic oligonucleotide
gtgcctcccgtggagttgttagtcccctcgaccct

SEQ ID NO: 19855 - DNA, 37 bp, Artificial Sequence
  Synthetic oligonucleotide
gcgtgcctctccgtcagcctttcttgacctccgttga

SEQ ID NO: 19856 - DNA, 35 bp, Artificial Sequence
  Synthetic oligonucleotide
accctgcaccgtcgaaactacctggcttccggcac

SEQ ID NO: 19857 - DNA, 35 bp, Artificial Sequence
  Synthetic oligonucleotide
tcggagcccgcgcgtaggtcctgccctctcctgtc

SEQ ID NO: 19858 - DNA, 35 bp, Artificial Sequence
  Synthetic oligonucleotide
tcttcacccctcttgtatcttcgtgagctatattc

SEQ ID NO: 19859 - DNA, 35 bp, Artificial Sequence
  Synthetic oligonucleotide
actcgaccctcgcatgctattatcgctggccttcg

SEQ ID NO: 19860 - DNA, 35 bp, Artificial Sequence
  Synthetic oligonucleotide
tgcccattgcacccaactctcaaataacggccact

SEQ ID NO: 19861 - DNA, 36 bp, Artificial Sequence
  Synthetic oligonucleotide
atcaacccattgtccgtatgcttccgtgatttcaaa

SEQ ID NO: 19862 - DNA, 36 bp, Artificial Sequence
  Synthetic oligonucleotide
acctgccgacgttccctcagcttttgttgcgtgcaa

SEQ ID NO: 19863 - DNA, 35 bp, Artificial Sequence
  Synthetic oligonucleotide
gatcgccaccaagcaccccaaaatgtcgctttaca

SEQ ID NO: 19864 - DNA, 37 bp, Artificial Sequence
  Synthetic oligonucleotide
tgccattcacacagcaatgtttgcctccccttttaga

SEQ ID NO: 19865 - DNA, 38 bp, Artificial Sequence
  Synthetic oligonucleotide
gaccggagccgaatcgccatcgcccccgtttgttttga

SEQ ID NO: 19866 - DNA, 36 bp, Artificial Sequence
  Synthetic oligonucleotide
tgcaaccgtcgccactcaccgatgacccttcgcata

SEQ ID NO: 19867 - DNA, 35 bp, Artificial Sequence
  Synthetic oligonucleotide
gcccttcccatgccttggcgctcccctacgcccta

SEQ ID NO: 19868 - DNA, 36 bp, Artificial Sequence
  Synthetic oligonucleotide
ccgatgacgcccaccatccgaactatgccaccttta

SEQ ID NO: 19869 - DNA, 36 bp, Artificial Sequence
  Synthetic oligonucleotide
gattcgccgcttgacatccgacgtcctcctgtttta

SEQ ID NO: 19870 - DNA, 35 bp, Artificial Sequence
  Synthetic oligonucleotide
tgcccgcgctcctccccctcgtcgtgcgtaggcac

SEQ ID NO: 19871 - DNA, 35 bp, Artificial Sequence
  Synthetic oligonucleotide
gtcaactccactgtcataccgccgtttatcctgac

SEQ ID NO: 19872 - DNA, 35 bp, Artificial Sequence
  Synthetic oligonucleotide
agacacggcacccactgagctttttccctgtctat

SEQ ID NO: 19873 - DNA, 35 bp, Artificial Sequence
  Synthetic oligonucleotide
tcccccccgttcgccatggttccctggacgtaatt

SEQ ID NO: 19874 - DNA, 35 bp, Artificial Sequence
  Synthetic oligonucleotide
tgccgctgcacatgtctgccttcgattttgttctt

SEQ ID NO: 19875 - DNA, 36 bp, Artificial Sequence
  Synthetic oligonucleotide
agcgccctgttctgccccccctttccttctgggtaa

SEQ ID NO: 19876 - DNA, 37 bp, Artificial Sequence
  Synthetic oligonucleotide
gtctgcgtgctcctcaccgttgcatccacctgactga

SEQ ID NO: 19877 - DNA, 38 bp, Artificial Sequence
  Synthetic oligonucleotide
tttaaccgcgcgaggtactgcccctctcctacttgtga

SEQ ID NO: 19878 - DNA, 37 bp, Artificial Sequence
  Synthetic oligonucleotide
gtagcgccgctctagccctgttcttgccttaacttga

SEQ ID NO: 19879 - DNA, 35 bp, Artificial Sequence
  Synthetic oligonucleotide
gtgcccgattacgcgtctcgcccaggctctaacac

SEQ ID NO: 19880 - DNA, 35 bp, Artificial Sequence
  Synthetic oligonucleotide
tccgacgtcgcccttcctgattattccagcctgac

SEQ ID NO: 19881 - DNA, 35 bp, Artificial Sequence
  Synthetic oligonucleotide
tcacgatcccacttagcctgtcatctatgcgatcc

SEQ ID NO: 19882 - DNA, 35 bp, Artificial Sequence
  Synthetic oligonucleotide
cgacgctagttcgacctttcatttgaggaccgtcc

SEQ ID NO: 19883 - DNA, 35 bp, Artificial Sequence
  Synthetic oligonucleotide
tcgtgcattatccggtttgtccgtacttctgtctc

SEQ ID NO: 19884 - DNA, 35 bp, Artificial Sequence
  Synthetic oligonucleotide
ttcgcctcggtactccccccatgactgtggtttat

SEQ ID NO: 19885 - DNA, 37 bp, Artificial Sequence
  Synthetic oligonucleotide
gctctcagcaacccacgacgaccccttccctgtgcga

SEQ ID NO: 19886 - DNA, 35 bp, Artificial Sequence
  Synthetic oligonucleotide
gccctgtaccgctctgactcgtatttgctttctga

SEQ ID NO: 19887 - DNA, 36 bp, Artificial Sequence
  Synthetic oligonucleotide
agtccggtcacatccgtttctacgtacttgttctta

SEQ ID NO: 19888 - DNA, 35 bp, Artificial Sequence
  Synthetic oligonucleotide
ttcaacacctgcctagctatccgcttcgagtttgc

SEQ ID NO: 19889 - DNA, 35 bp, Artificial Sequence
  Synthetic oligonucleotide
tgcgggcttgcacgtcgtacttttttctagccttc

SEQ ID NO: 19890 - DNA, 36 bp, Artificial Sequence
  Synthetic oligonucleotide
gcacgttgcgcagaaggatgggggttgaaaggtgga

SEQ ID NO: 19891 - DNA, 35 bp, Artificial Sequence
  Synthetic oligonucleotide
atcgcagacacctacgaagccactggtcctaccgc

SEQ ID NO: 19892 - DNA, 35 bp, Artificial Sequence
  Synthetic oligonucleotide
gtgtgcaccgagggctctccttttttcgatcgttc

SEQ ID NO: 19893 - DNA, 35 bp, Artificial Sequence
  Synthetic oligonucleotide
ctagagcgccccgttcccctcgcctggatagacca

SEQ ID NO: 19894 - DNA, 36 bp, Artificial Sequence
  Synthetic oligonucleotide
attccctcggtcctttctcttttcaaagacgttcca

SEQ ID NO: 19895 - DNA, 34 bp, Artificial Sequence
  Synthetic oligonucleotide
cacaccaccccccgccactacgaatttacgtgca

SEQ ID NO: 19896 - DNA, 38 bp, Artificial Sequence
  Synthetic oligonucleotide
accgctcccccactgtgtcctacctctaggcttcatga

SEQ ID NO: 19897 - DNA, 38 bp, Artificial Sequence
  Synthetic oligonucleotide
gaagtcgtcgcgcttatgtcccttctctacctggctga

SEQ ID NO: 19898 - DNA, 38 bp, Artificial Sequence
  Synthetic oligonucleotide
atgacacgcgtgcgcatttcgtctccaatacttcgtga

SEQ ID NO: 19899 - DNA, 35 bp, Artificial Sequence
  Synthetic oligonucleotide
actgaattgcatcatcccagcccaccaccgatcgc

SEQ ID NO: 19900 - DNA, 35 bp, Artificial Sequence
  Synthetic oligonucleotide
tcccgcgacctactgaccctcaacgagaaaccatc

SEQ ID NO: 19901 - DNA, 35 bp, Artificial Sequence
  Synthetic oligonucleotide
tgcccctacggtcgttcttccttcttgttcacctc

SEQ ID NO: 19902 - DNA, 35 bp, Artificial Sequence
  Synthetic oligonucleotide
ggaactgcccccccgataatttttgaacgaacgtc

SEQ ID NO: 19903 - DNA, 35 bp, Artificial Sequence
  Synthetic oligonucleotide
gcctgaaggcctgaaactgccccggttccccgttc

SEQ ID NO: 19904 - DNA, 35 bp, Artificial Sequence
  Synthetic oligonucleotide
gactaccgcacacaaattccaacctagacgattgg

SEQ ID NO: 19905 - DNA, 37 bp, Artificial Sequence
  Synthetic oligonucleotide
gtgagggggaaaggcaagagaatctgggcatcacaga

SEQ ID NO: 19906 - DNA, 35 bp, Artificial Sequence
  Synthetic oligonucleotide
ttccaccatcatagtagtccccattctcgcagtcc

SEQ ID NO: 19907 - DNA, 36 bp, Artificial Sequence
  Synthetic oligonucleotide
gcaacctctcctgcgcatgctcctgtaaaatctcga

SEQ ID NO: 19908 - DNA, 37 bp, Artificial Sequence
  Synthetic oligonucleotide
gcacccttacgccgcctcgtatttgttctccccttga

SEQ ID NO: 19909 - DNA, 36 bp, Artificial Sequence
  Synthetic oligonucleotide
gcgaacatcaacttccacccgtactgacccgcaata

SEQ ID NO: 19910 - DNA, 35 bp, Artificial Sequence
  Synthetic oligonucleotide
ttcgcgcggctccggcacgtaacatccaccccgct

SEQ ID NO: 19911 - DNA, 35 bp, Artificial Sequence
  Synthetic oligonucleotide
aatttgccgcatccgcaagcgcttactcacctggt

SEQ ID NO: 19912 - DNA, 36 bp, Artificial Sequence
  Synthetic oligonucleotide
acgaggggggtccggggggttttggggaggatgcga

SEQ ID NO: 19913 - DNA, 37 bp, Artificial Sequence
  Synthetic oligonucleotide
agaacggaaattggtgagggggtcggggtagactgga

SEQ ID NO: 19914 - DNA, 37 bp, Artificial Sequence
  Synthetic oligonucleotide
tcagcccgcagcccacactcgtactaacctgaactga

SEQ ID NO: 19915 - DNA, 36 bp, Artificial Sequence
  Synthetic oligonucleotide
tgacttgcatcgcgagttctttttcagtccacctta

SEQ ID NO: 19916 - DNA, 35 bp, Artificial Sequence
  Synthetic oligonucleotide
gtactctcacactgtcatgcctcctcgcccactgc

SEQ ID NO: 19917 - DNA, 35 bp, Artificial Sequence
  Synthetic oligonucleotide
ttcggacgccactcctgcctagaccaattcaaccg

SEQ ID NO: 19918 - DNA, 37 bp, Artificial Sequence
  Synthetic oligonucleotide
taccgggcagggaggggcgctagtgggacatacctga

SEQ ID NO: 19919 - DNA, 35 bp, Artificial Sequence
  Synthetic oligonucleotide
aacaacatggatggaggcaggaacactgtaacacc

SEQ ID NO: 19920 - DNA, 35 bp, Artificial Sequence
  Synthetic oligonucleotide
atctcaccatcgtcacgagctgaaccgtcccctcc

SEQ ID NO: 19921 - DNA, 36 bp, Artificial Sequence
  Synthetic oligonucleotide
ttaccaccgatcttcttcctggccagtctttctaaa

SEQ ID NO: 19922 - DNA, 35 bp, Artificial Sequence
  Synthetic oligonucleotide
taacccccacgataccagccttgccgactgggcaa

SEQ ID NO: 19923 - DNA, 37 bp, Artificial Sequence
  Synthetic oligonucleotide
gaggggcaagctgctccgaacgatccatataccatga

SEQ ID NO: 19924 - DNA, 38 bp, Artificial Sequence
  Synthetic oligonucleotide
gtgacctcgcctttaccgtgcacgatttccctacctga

SEQ ID NO: 19925 - DNA, 35 bp, Artificial Sequence
  Synthetic oligonucleotide
gtcactcgcactccctctccctggcattctgtcgc

SEQ ID NO: 19926 - DNA, 35 bp, Artificial Sequence
  Synthetic oligonucleotide
gccgaccgccaccactctggtctatctttcccggc

SEQ ID NO: 19927 - DNA, 35 bp, Artificial Sequence
  Synthetic oligonucleotide
ttctcccgtgcaactggtgttactactattcccct

SEQ ID NO: 19928 - DNA, 36 bp, Artificial Sequence
  Synthetic oligonucleotide
ccatccaccatcatctgccgagcacacctgaacaca

SEQ ID NO: 19929 - DNA, 35 bp, Artificial Sequence
  Synthetic oligonucleotide
tccatttgccacacagaccgtctaacaccattgca

SEQ ID NO: 19930 - DNA, 36 bp, Artificial Sequence
  Synthetic oligonucleotide
tgacccaccattgcgtgcgaatgcttagttccttga

SEQ ID NO: 19931 - DNA, 35 bp, Artificial Sequence
  Synthetic oligonucleotide
gataacacaggcagatccgcactaacccctctcta

SEQ ID NO: 19932 - DNA, 35 bp, Artificial Sequence
  Synthetic oligonucleotide
tcatatcctgagcgcccaacgtggcatcccccgta

SEQ ID NO: 19933 - DNA, 36 bp, Artificial Sequence
  Synthetic oligonucleotide
gccaggggcgggggggcggtgaggagatatgatgta

SEQ ID NO: 19934 - DNA, 35 bp, Artificial Sequence
  Synthetic oligonucleotide
tgcacttggcatcatccgtccattgcgccctatcc

SEQ ID NO: 19935 - DNA, 35 bp, Artificial Sequence
  Synthetic oligonucleotide
acacggtccgacgggctcgatagctttttgtccct

SEQ ID NO: 19936 - DNA, 35 bp, Artificial Sequence
  Synthetic oligonucleotide
tcacctctacgccccatctaccgacattagcttgt

SEQ ID NO: 19937 - DNA, 37 bp, Artificial Sequence
  Synthetic oligonucleotide
tgtatcccgtactgccccttataactccactcaacga

SEQ ID NO: 19938 - DNA, 38 bp, Artificial Sequence
  Synthetic oligonucleotide
accatctccagccatagcgaacgttcaaccattactga

SEQ ID NO: 19939 - DNA, 38 bp, Artificial Sequence
  Synthetic oligonucleotide
tttaccagccgtctcattccgctacctcctcgtgctga

SEQ ID NO: 19940 - DNA, 38 bp, Artificial Sequence
  Synthetic oligonucleotide
atgcatgatggggggataaagggggaacgatatggtga

SEQ ID NO: 19941 - DNA, 36 bp, Artificial Sequence
  Synthetic oligonucleotide
actgaaaccccgccacccgtttatgtttaattcata

SEQ ID NO: 19942 - DNA, 36 bp, Artificial Sequence
  Synthetic oligonucleotide
cgaaccacccgtgtacgtcgccccactgtattggta

SEQ ID NO: 19943 - DNA, 35 bp, Artificial Sequence
  Synthetic oligonucleotide
gcatcattaacactccgcacaaccacatggactcc

SEQ ID NO: 19944 - DNA, 35 bp, Artificial Sequence
  Synthetic oligonucleotide
tcacccaacagaccgagtactgactcacgtctctc

SEQ ID NO: 19945 - DNA, 35 bp, Artificial Sequence
  Synthetic oligonucleotide
gtggaaaaggaatagatggaacacggggagatgtg

SEQ ID NO: 19946 - DNA, 35 bp, Artificial Sequence
  Synthetic oligonucleotide
ttccgtcgctgataggatctgccacgttcttcttt

SEQ ID NO: 19947 - DNA, 36 bp, Artificial Sequence
  Synthetic oligonucleotide
ttacaacagcctgcctcctcgttaacatcttgtcaa

SEQ ID NO: 19948 - DNA, 37 bp, Artificial Sequence
  Synthetic oligonucleotide
gacaccgcatactattaggcccaatacacactttcga

SEQ ID NO: 19949 - DNA, 37 bp, Artificial Sequence
  Synthetic oligonucleotide
aacgttaggtaaggaaggggggggaaatacgaatgga

SEQ ID NO: 19950 - DNA, 36 bp, Artificial Sequence
  Synthetic oligonucleotide
gaccacacagtatcgaaatcaagcaacatacactga

SEQ ID NO: 19951 - DNA, 35 bp, Artificial Sequence
  Synthetic oligonucleotide
tactcctcccgcctttgacctgggtatctgttcac

SEQ ID NO: 19952 - DNA, 35 bp, Artificial Sequence
  Synthetic oligonucleotide
attcgacctggctcctcgcgcctaacctttgtcgc

SEQ ID NO: 19953 - DNA, 35 bp, Artificial Sequence
  Synthetic oligonucleotide
tgccaccggccactggcccccagcatggacctcct

SEQ ID NO: 19954 - DNA, 33 bp, Artificial Sequence
  Synthetic oligonucleotide
tcctgggcagacttcgtgtcccccttgtcctct

SEQ ID NO: 19955 - DNA, 36 bp, Artificial Sequence
  Synthetic oligonucleotide
gtgtgcacatctttcgttaaaggctacatccaccaa

SEQ ID NO: 19956 - DNA, 36 bp, Artificial Sequence
  Synthetic oligonucleotide
agcgggcccgggggagataggaacggggatgccaca

SEQ ID NO: 19957 - DNA, 36 bp, Artificial Sequence
  Synthetic oligonucleotide
tcacctgcccaccatattttgcacgatttttggaca

SEQ ID NO: 19958 - DNA, 36 bp, Artificial Sequence
  Synthetic oligonucleotide
gtgaagccgcagttctttaccaactgcccttgttca

SEQ ID NO: 19959 - DNA, 36 bp, Artificial Sequence
  Synthetic oligonucleotide
atgtccgcaccttgtctcttgccttccaggttttca

SEQ ID NO: 19960 - DNA, 37 bp, Artificial Sequence
  Synthetic oligonucleotide
gacctcccgaatccgttacgctgcctgtttgctacga

SEQ ID NO: 19961 - DNA, 37 bp, Artificial Sequence
  Synthetic oligonucleotide
aacgcaacttcgcagcacctgtccacataattcccga

SEQ ID NO: 19962 - DNA, 35 bp, Artificial Sequence
  Synthetic oligonucleotide
gtgacccaccccgttgaatagatcctacaatttgc

SEQ ID NO: 19963 - DNA, 35 bp, Artificial Sequence
  Synthetic oligonucleotide
gagagagaacaatactcaggaaagggacggacaag

SEQ ID NO: 19964 - DNA, 35 bp, Artificial Sequence
  Synthetic oligonucleotide
atgccatgctacaaaatgcgactcacggctacttg

SEQ ID NO: 19965 - DNA, 34 bp, Artificial Sequence
  Synthetic oligonucleotide
gaccatccctctttacctccattggcgtatacca

SEQ ID NO: 19966 - DNA, 36 bp, Artificial Sequence
  Synthetic oligonucleotide
tcgtacggtcgcctcattttttcaccctgggattca

SEQ ID NO: 19967 - DNA, 38 bp, Artificial Sequence
  Synthetic oligonucleotide
atgtggagtgggggtgattgggcggacgggtggtatga

SEQ ID NO: 19968 - DNA, 35 bp, Artificial Sequence
  Synthetic oligonucleotide
accccccggacttgctgttaccagttgcacaatcc

SEQ ID NO: 19969 - DNA, 35 bp, Artificial Sequence
  Synthetic oligonucleotide
ttcacatagcccacctccagttcccagggtactcc

SEQ ID NO: 19970 - DNA, 35 bp, Artificial Sequence
  Synthetic oligonucleotide
gaatgagcagctcgcctctttttactccacacctg

SEQ ID NO: 19971 - DNA, 36 bp, Artificial Sequence
  Synthetic oligonucleotide
gatgccctcccccacattattgagacgctcccggaa

SEQ ID NO: 19972 - DNA, 38 bp, Artificial Sequence
  Synthetic oligonucleotide
gatcgagcgcgtaggatccctttatcgttgcctcttga

SEQ ID NO: 19973 - DNA, 35 bp, Artificial Sequence
  Synthetic oligonucleotide
ggacacgaccaactgttcgatcttcatgtgtcccg

SEQ ID NO: 19974 - DNA, 35 bp, Artificial Sequence
  Synthetic oligonucleotide
aagcaccatctcctgccccattgaactcctggtcg

SEQ ID NO: 19975 - DNA, 35 bp, Artificial Sequence
  Synthetic oligonucleotide
agaccaggtcgatttgactctgcgtactacctctt

SEQ ID NO: 19976 - DNA, 36 bp, Artificial Sequence
  Synthetic oligonucleotide
atcgaaccaaagaggggggcaagggtttgggacgga

SEQ ID NO: 19977 - DNA, 37 bp, Artificial Sequence
  Synthetic oligonucleotide
aacagtgacgggaaaagggtgggcgaacgcgagttga

SEQ ID NO: 19978 - DNA, 37 bp, Artificial Sequence
  Synthetic oligonucleotide
tctccgctcccgcccctggtatcacgactttatttga

SEQ ID NO: 19979 - DNA, 35 bp, Artificial Sequence
  Synthetic oligonucleotide
agaaatgggtgtgaggtggttggggtgttgaggta

SEQ ID NO: 19980 - DNA, 35 bp, Artificial Sequence
  Synthetic oligonucleotide
actacccgcacctccacggacatccctactgcgac

SEQ ID NO: 19981 - DNA, 35 bp, Artificial Sequence
  Synthetic oligonucleotide
ccaaccacctgctgtagcttcatctctcccggatc

SEQ ID NO: 19982 - DNA, 35 bp, Artificial Sequence
  Synthetic oligonucleotide
gcctgacgtgttgtgcttcccattgtctgctccat

SEQ ID NO: 19983 - DNA, 35 bp, Artificial Sequence
  Synthetic oligonucleotide
tgccaactggcacgtcaccaccctcatatcctgtt

SEQ ID NO: 19984 - DNA, 35 bp, Artificial Sequence
  Synthetic oligonucleotide
accccgttggattcgattgcccccctgtccttaca

SEQ ID NO: 19985 - DNA, 36 bp, Artificial Sequence
  Synthetic oligonucleotide
acgatctaccgccgactcacgcattcgcctctacca

SEQ ID NO: 19986 - DNA, 36 bp, Artificial Sequence
  Synthetic oligonucleotide
tgcaacaacattgtaccacctctcgcacggaatcca

SEQ ID NO: 19987 - DNA, 36 bp, Artificial Sequence
  Synthetic oligonucleotide
tgatccgccaaatcccgctcgtggcccgttaaggca

SEQ ID NO: 19988 - DNA, 37 bp, Artificial Sequence
  Synthetic oligonucleotide
gcacacgcttgcatccgcgctttccagctctctccga

SEQ ID NO: 19989 - DNA, 38 bp, Artificial Sequence
  Synthetic oligonucleotide
tcagaccgctggctcgccctgtcccccattccccatga

SEQ ID NO: 19990 - DNA, 36 bp, Artificial Sequence
  Synthetic oligonucleotide
gcactcccgtcacatcacatttttacccatcgctga

SEQ ID NO: 19991 - DNA, 34 bp, Artificial Sequence
  Synthetic oligonucleotide
acccgctaccagcccccattcatgaaaccttgta

SEQ ID NO: 19992 - DNA, 35 bp, Artificial Sequence
  Synthetic oligonucleotide
accaacgcccctgaccttgcccaggcaaacacacg

SEQ ID NO: 19993 - DNA, 35 bp, Artificial Sequence
  Synthetic oligonucleotide
gggatacgggtgggcgggggtgaacttgctatagt

SEQ ID NO: 19994 - DNA, 35 bp, Artificial Sequence
  Synthetic oligonucleotide
aaccatgcacctggcacatacactttctacatcaa

SEQ ID NO: 19995 - DNA, 36 bp, Artificial Sequence
  Synthetic oligonucleotide
tccatccaccccctgcagagagactaaggctaacca

SEQ ID NO: 19996 - DNA, 38 bp, Artificial Sequence
  Synthetic oligonucleotide
agcgatgcatctccgactattatgcggcccctccctga

SEQ ID NO: 19997 - DNA, 37 bp, Artificial Sequence
  Synthetic oligonucleotide
aaggtggagggagggattggggaagttgaccagttga

SEQ ID NO: 19998 - DNA, 38 bp, Artificial Sequence
  Synthetic oligonucleotide
gagaaggggttggaggacgatgtaatggtgccggttga

SEQ ID NO: 19999 - DNA, 38 bp, Artificial Sequence
  Synthetic oligonucleotide
acgaaaccagccttcccacggtaagcttccctctttga

SEQ ID NO: 20000 - DNA, 37 bp, Artificial Sequence
  Synthetic oligonucleotide
tttaccctcaccgcctttataccagaccctgttttga

SEQ ID NO: 20001 - DNA, 35 bp, Artificial Sequence
  Synthetic oligonucleotide
gttaacactctccgccacatcactcagtacaggaa

SEQ ID NO: 20002 - DNA, 37 bp, Artificial Sequence
  Synthetic oligonucleotide
tctatcccacgtgagttcgctacactcttcctttgga

SEQ ID NO: 20003 - DNA, 37 bp, Artificial Sequence
  Synthetic oligonucleotide
aaccacaatgagcctcctgacacctgaacagtcatga

SEQ ID NO: 20004 - DNA, 37 bp, Artificial Sequence
  Synthetic oligonucleotide
taacaccgacgatcctaatatgcctgacccctcttga

SEQ ID NO: 20005 - DNA, 36 bp, Artificial Sequence
  Synthetic oligonucleotide
tcatgtgtacctccctcctgagctgcttacgcccta

SEQ ID NO: 20006 - DNA, 36 bp, Artificial Sequence
  Synthetic oligonucleotide
tctacacgccgccaacaagccgcaacctgacactta

SEQ ID NO: 20007 - DNA, 36 bp, Artificial Sequence
  Synthetic oligonucleotide
gacctaccactatgcctcataagaatctgcacctta

SEQ ID NO: 20008 - DNA, 36 bp, Artificial Sequence
  Synthetic oligonucleotide
tccatcagccacctttacttatccacgtcggcttaa

SEQ ID NO: 20009 - DNA, 36 bp, Artificial Sequence
  Synthetic oligonucleotide
accaccgaataagtcacgtcctccctccgcccctga

SEQ ID NO: 20010 - DNA, 35 bp, Artificial Sequence
  Synthetic oligonucleotide
gcgcaatcggctctgtcaacactcgcatcttcata

SEQ ID NO: 20011 - DNA, 35 bp, Artificial Sequence
  Synthetic oligonucleotide
tccgaacatctcgaccttggtcttcgcccctacct

SEQ ID NO: 20012 - DNA, 35 bp, Artificial Sequence
  Synthetic oligonucleotide
atcgccacgatatatattactgtcttccctctgtt

SEQ ID NO: 20013 - DNA, 35 bp, Artificial Sequence
  Synthetic oligonucleotide
gtctaggggggagaggagaaggggaaggtagattt

SEQ ID NO: 20014 - DNA, 35 bp, Artificial Sequence
  Synthetic oligonucleotide
tcagagggcatccgggccgtacttacctatctcaa

SEQ ID NO: 20015 - DNA, 37 bp, Artificial Sequence
  Synthetic oligonucleotide
atgcacctccgggccaagccagtttctatcacctcga

SEQ ID NO: 20016 - DNA, 38 bp, Artificial Sequence
  Synthetic oligonucleotide
gcacaaacagtggggaggggtggttgaaagggcggtga

SEQ ID NO: 20017 - DNA, 37 bp, Artificial Sequence
  Synthetic oligonucleotide
tcacctcatgttcctcgtggtccatcctggtttgtga

SEQ ID NO: 20018 - DNA, 35 bp, Artificial Sequence
  Synthetic oligonucleotide
tcttggctgggcaccgcgggagggagggtaagcta

SEQ ID NO: 20019 - DNA, 35 bp, Artificial Sequence
  Synthetic oligonucleotide
attcatacgtacgtatgccgcatacgagatccccc

SEQ ID NO: 20020 - DNA, 33 bp, Artificial Sequence
  Synthetic oligonucleotide
gccactgtccttgagttctctgtgtctgttccc

SEQ ID NO: 20021 - DNA, 35 bp, Artificial Sequence
  Synthetic oligonucleotide
acatccgcgtgttgaatgtaatcctctttgccgcc

SEQ ID NO: 20022 - DNA, 36 bp, Artificial Sequence
  Synthetic oligonucleotide
tccatgaaggcgcctcccctcccgctgacttaacca

SEQ ID NO: 20023 - DNA, 36 bp, Artificial Sequence
  Synthetic oligonucleotide
tctgccccttgtgacgacgatctgtcctctatctca

SEQ ID NO: 20024 - DNA, 38 bp, Artificial Sequence
  Synthetic oligonucleotide
tactcgagccacccatgttaccacccgaccctagttga

SEQ ID NO: 20025 - DNA, 35 bp, Artificial Sequence
  Synthetic oligonucleotide
gaggtcccctcgcccaccgcatttcaaggccttgc

SEQ ID NO: 20026 - DNA, 36 bp, Artificial Sequence
  Synthetic oligonucleotide
acacgcggtgaggggggcgggtacaagttacttgca

SEQ ID NO: 20027 - DNA, 37 bp, Artificial Sequence
  Synthetic oligonucleotide
acgcgaggggatcaagcgggaggcaggaaatgaggga

SEQ ID NO: 20028 - DNA, 38 bp, Artificial Sequence
  Synthetic oligonucleotide
gtctcccccgcccatgcacgatcctcgccactgtgtga

SEQ ID NO: 20029 - DNA, 35 bp, Artificial Sequence
  Synthetic oligonucleotide
gccccctgtacccgtccatccgcggccaaaacacc

SEQ ID NO: 20030 - DNA, 35 bp, Artificial Sequence
  Synthetic oligonucleotide
tcactcaccgctatgttcgctggaaccggacctgc

SEQ ID NO: 20031 - DNA, 35 bp, Artificial Sequence
  Synthetic oligonucleotide
gttctgtccacctgatacattttacttgcctacct

SEQ ID NO: 20032 - DNA, 35 bp, Artificial Sequence
  Synthetic oligonucleotide
tacctcgtcccgtcacacacaccccctggtcccaa

SEQ ID NO: 20033 - DNA, 36 bp, Artificial Sequence
  Synthetic oligonucleotide
tccttcaccacatgtaacccttacctcagacaggaa

SEQ ID NO: 20034 - DNA, 36 bp, Artificial Sequence
  Synthetic oligonucleotide
tatgctccgccgttgctccagcgttccctcactaca

SEQ ID NO: 20035 - DNA, 37 bp, Artificial Sequence
  Synthetic oligonucleotide
ggtagtcccatacactctcgccgccactccgtctgga

SEQ ID NO: 20036 - DNA, 38 bp, Artificial Sequence
  Synthetic oligonucleotide
ttacccctcccacggacttgaagacagtacacagttga

SEQ ID NO: 20037 - DNA, 37 bp, Artificial Sequence
  Synthetic oligonucleotide
gacagtcaacgggcggaacaagaggggggagctttga

SEQ ID NO: 20038 - DNA, 35 bp, Artificial Sequence
  Synthetic oligonucleotide
gtgtactgttacgtcaatcggttcttttcgcgccc

SEQ ID NO: 20039 - DNA, 35 bp, Artificial Sequence
  Synthetic oligonucleotide
tgagtcctcaaccgtacagatgtcgctcccatctc

SEQ ID NO: 20040 - DNA, 36 bp, Artificial Sequence
  Synthetic oligonucleotide
tcactcggtggtatcgatccgttctgccctcttaca

SEQ ID NO: 20041 - DNA, 36 bp, Artificial Sequence
  Synthetic oligonucleotide
atccgcagactccccgtaaccaccacccacccctca

SEQ ID NO: 20042 - DNA, 38 bp, Artificial Sequence
  Synthetic oligonucleotide
tcacccgtgctatcccgcccatcctgttccgaaggtga

SEQ ID NO: 20043 - DNA, 35 bp, Artificial Sequence
  Synthetic oligonucleotide
gtccaccagggaacattttctgttaatcacactac

SEQ ID NO: 20044 - DNA, 35 bp, Artificial Sequence
  Synthetic oligonucleotide
tcagtcgtacctctcatgtctgcactcctgcgctg

SEQ ID NO: 20045 - DNA, 35 bp, Artificial Sequence
  Synthetic oligonucleotide
gactgggcacattttaactttccgtaaattctctg

SEQ ID NO: 20046 - DNA, 35 bp, Artificial Sequence
  Synthetic oligonucleotide
tagtaccgaccatcctcagtaactaggttgcacct

SEQ ID NO: 20047 - DNA, 35 bp, Artificial Sequence
  Synthetic oligonucleotide
gaacctgccgcacattctatggcattgccgttaca

SEQ ID NO: 20048 - DNA, 36 bp, Artificial Sequence
  Synthetic oligonucleotide
aaagtacgcccgagaagtccaacctgccatctacca

SEQ ID NO: 20049 - DNA, 35 bp, Artificial Sequence
  Synthetic oligonucleotide
tgttcaaccagcgatcgtctcttcgtactctctgc

SEQ ID NO: 20050 - DNA, 35 bp, Artificial Sequence
  Synthetic oligonucleotide
tactagtcaccgcagtttcgatcatgtttcgtttc

SEQ ID NO: 20051 - DNA, 36 bp, Artificial Sequence
  Synthetic oligonucleotide
gctgtcacagcactagcatactgccattgatctgca

SEQ ID NO: 20052 - DNA, 37 bp, Artificial Sequence
  Synthetic oligonucleotide
actcagggggggctgggcgggttttagtagttgggga

SEQ ID NO: 20053 - DNA, 37 bp, Artificial Sequence
  Synthetic oligonucleotide
aacacccccacgccaccgactccggttaaggtattga

SEQ ID NO: 20054 - DNA, 35 bp, Artificial Sequence
  Synthetic oligonucleotide
ggaacccacacctgtcctgtccgctgacggtatta

SEQ ID NO: 20055 - DNA, 35 bp, Artificial Sequence
  Synthetic oligonucleotide
tccgaactcaaccacaggccctgcaacttcccgac

SEQ ID NO: 20056 - DNA, 35 bp, Artificial Sequence
  Synthetic oligonucleotide
taagtgcctcggcaatggaaagggggggtgggttg

SEQ ID NO: 20057 - DNA, 35 bp, Artificial Sequence
  Synthetic oligonucleotide
acgtctccctcctcacagtgtttcacccatgcact

SEQ ID NO: 20058 - DNA, 37 bp, Artificial Sequence
  Synthetic oligonucleotide
gactctgcccccattttgacaccgcatcccttgcaga

SEQ ID NO: 20059 - DNA, 37 bp, Artificial Sequence
  Synthetic oligonucleotide
ggtgcaacatccggcgtcaccccttgccgaccaatga

SEQ ID NO: 20060 - DNA, 37 bp, Artificial Sequence
  Synthetic oligonucleotide
agccggggagtaggagggatgcgggaactacggctga

SEQ ID NO: 20061 - DNA, 38 bp, Artificial Sequence
  Synthetic oligonucleotide
tgaggcccacatccgccccgcacctccctgccaggtga

SEQ ID NO: 20062 - DNA, 35 bp, Artificial Sequence
  Synthetic oligonucleotide
gagacccacctccctatcacgtagtgcgtgttcta

SEQ ID NO: 20063 - DNA, 35 bp, Artificial Sequence
  Synthetic oligonucleotide
tcatacccatgctaccttcctgtcaggacaccaac

SEQ ID NO: 20064 - DNA, 35 bp, Artificial Sequence
  Synthetic oligonucleotide
acacggtggagcaatcgtcgaccccctccctttcc

SEQ ID NO: 20065 - DNA, 35 bp, Artificial Sequence
  Synthetic oligonucleotide
actcattccgggcctgtacaggaaccctgcctatc

SEQ ID NO: 20066 - DNA, 35 bp, Artificial Sequence
  Synthetic oligonucleotide
ttgatcatcgtgttggcctgctttaccattctcct

SEQ ID NO: 20067 - DNA, 35 bp, Artificial Sequence
  Synthetic oligonucleotide
gactcgcgcaacatggtctaatctcctgtaccctt

SEQ ID NO: 20068 - DNA, 35 bp, Artificial Sequence
  Synthetic oligonucleotide
ttcgaggactggtgggaaggtggggaaggtataaa

SEQ ID NO: 20069 - DNA, 36 bp, Artificial Sequence
  Synthetic oligonucleotide
gattgtccggctgtgaacgttgcccgtcgcccacca

SEQ ID NO: 20070 - DNA, 36 bp, Artificial Sequence
  Synthetic oligonucleotide
tgacccagtgccgctgtcccctacctcaagtgctca

SEQ ID NO: 20071 - DNA, 37 bp, Artificial Sequence
  Synthetic oligonucleotide
gacgccgttcgctggttttcaagctccttctgctcga

SEQ ID NO: 20072 - DNA, 38 bp, Artificial Sequence
  Synthetic oligonucleotide
gcatgtcttcggtccacttcccccacctgctacggtga

SEQ ID NO: 20073 - DNA, 38 bp, Artificial Sequence
  Synthetic oligonucleotide
gaccgatcgcacccctcctgctgtacaatctcctttga

SEQ ID NO: 20074 - DNA, 38 bp, Artificial Sequence
  Synthetic oligonucleotide
gcttggccccacctgcgctatttctgtcctggttttga

SEQ ID NO: 20075 - DNA, 35 bp, Artificial Sequence
  Synthetic oligonucleotide
gctgaacaccgtgtccctggtgatatttcccatac

SEQ ID NO: 20076 - DNA, 35 bp, Artificial Sequence
  Synthetic oligonucleotide
acacatacagacggctgaccctgcgcatcactgtc

SEQ ID NO: 20077 - DNA, 35 bp, Artificial Sequence
  Synthetic oligonucleotide
aactgtgaggacccgacttccatctacgcaccttc

SEQ ID NO: 20078 - DNA, 35 bp, Artificial Sequence
  Synthetic oligonucleotide
tgtttgctcttcatcccgcccgttttttacgcctg

SEQ ID NO: 20079 - DNA, 36 bp, Artificial Sequence
  Synthetic oligonucleotide
tgccggtccactgaactattattgccactaaatcca

SEQ ID NO: 20080 - DNA, 37 bp, Artificial Sequence
  Synthetic oligonucleotide
acacgcccgagccaatcacttccattcgttctacgga

SEQ ID NO: 20081 - DNA, 38 bp, Artificial Sequence
  Synthetic oligonucleotide
tagggaggggaaagggaggggagaagcacgtggcatga

SEQ ID NO: 20082 - DNA, 38 bp, Artificial Sequence
  Synthetic oligonucleotide
ttacggtacgggagatagggaacggtggtgagggctga

SEQ ID NO: 20083 - DNA, 36 bp, Artificial Sequence
  Synthetic oligonucleotide
tacatgggggttggctagaagaagccaagggagtga

SEQ ID NO: 20084 - DNA, 37 bp, Artificial Sequence
  Synthetic oligonucleotide
ttgacgtgcataggacaggggaggggcggaaaggtga

SEQ ID NO: 20085 - DNA, 36 bp, Artificial Sequence
  Synthetic oligonucleotide
tgcacctccgggcccttcacgaccctccgacatgta

SEQ ID NO: 20086 - DNA, 35 bp, Artificial Sequence
  Synthetic oligonucleotide
atggagggatgggagggatcgcgagagggtaaggg

SEQ ID NO: 20087 - DNA, 35 bp, Artificial Sequence
  Synthetic oligonucleotide
ctcatgcgccgcatgcccgttctctctctcaccat

SEQ ID NO: 20088 - DNA, 36 bp, Artificial Sequence
  Synthetic oligonucleotide
gatggagtgggcgggcggggacagagatgtcaggaa

SEQ ID NO: 20089 - DNA, 36 bp, Artificial Sequence
  Synthetic oligonucleotide
acttcgcacagtgcggctatatcctcatgcacctaa

SEQ ID NO: 20090 - DNA, 37 bp, Artificial Sequence
  Synthetic oligonucleotide
tgccgacgtacgcggtaattgttgccatcacatctga

SEQ ID NO: 20091 - DNA, 34 bp, Artificial Sequence
  Synthetic oligonucleotide
aacctgctgctgatccccatatttgcttgcccaa

SEQ ID NO: 20092 - DNA, 35 bp, Artificial Sequence
  Synthetic oligonucleotide
gcgcccggccatcctaccacgacccagttatgcta

SEQ ID NO: 20093 - DNA, 35 bp, Artificial Sequence
  Synthetic oligonucleotide
actcagtacgcctccccgcccgtaatacatgaacc

SEQ ID NO: 20094 - DNA, 35 bp, Artificial Sequence
  Synthetic oligonucleotide
gtggggaaaggcgggggcggttagggtcaaggaag

SEQ ID NO: 20095 - DNA, 36 bp, Artificial Sequence
  Synthetic oligonucleotide
tccatcgcacaccggctctttatccatgcacatgga

SEQ ID NO: 20096 - DNA, 37 bp, Artificial Sequence
  Synthetic oligonucleotide
acgaccactcctggttggggcccctgactctaattga

SEQ ID NO: 20097 - DNA, 34 bp, Artificial Sequence
  Synthetic oligonucleotide
actcgccgtcaccccgcgtgcgcctattgcctta

SEQ ID NO: 20098 - DNA, 35 bp, Artificial Sequence
  Synthetic oligonucleotide
gcgattagccgtactgttgtccatattccgcctac

SEQ ID NO: 20099 - DNA, 35 bp, Artificial Sequence
  Synthetic oligonucleotide
gtgtaggcgcaccgcttcctcgacataactcgtcc

SEQ ID NO: 20100 - DNA, 35 bp, Artificial Sequence
  Synthetic oligonucleotide
atcatccataggcctccggttggactcgactcctc

SEQ ID NO: 20101 - DNA, 35 bp, Artificial Sequence
  Synthetic oligonucleotide
actgaacactaactcgcgtgatcgaaaactgtctc

SEQ ID NO: 20102 - DNA, 35 bp, Artificial Sequence
  Synthetic oligonucleotide
tcacctacgccctgttgttattcgccacgccgaat

SEQ ID NO: 20103 - DNA, 35 bp, Artificial Sequence
  Synthetic oligonucleotide
gcacagggaggggaactctgatgggaccagggagt

SEQ ID NO: 20104 - DNA, 36 bp, Artificial Sequence
  Synthetic oligonucleotide
acagacacatctgtcgccgtcacctagccgcacaca

SEQ ID NO: 20105 - DNA, 36 bp, Artificial Sequence
  Synthetic oligonucleotide
agccaccaacacgccttgctccgtgcaggccttaca

SEQ ID NO: 20106 - DNA, 37 bp, Artificial Sequence
  Synthetic oligonucleotide
tcatcggcaccaccaactatgccagccccaacctcga

SEQ ID NO: 20107 - DNA, 36 bp, Artificial Sequence
  Synthetic oligonucleotide
ttgggtgtggggtgtggaggtaaggaatgctggtga

SEQ ID NO: 20108 - DNA, 38 bp, Artificial Sequence
  Synthetic oligonucleotide
aacaacctggccatgatgcgtcctctctgcccctttga

SEQ ID NO: 20109 - DNA, 35 bp, Artificial Sequence
  Synthetic oligonucleotide
tctaaccgtgcgccatggcccccttccgtaacata

SEQ ID NO: 20110 - DNA, 36 bp, Artificial Sequence
  Synthetic oligonucleotide
gcctaacaacgcacacagccataggttcacgcccta

SEQ ID NO: 20111 - DNA, 35 bp, Artificial Sequence
  Synthetic oligonucleotide
gaactgccgctgcccaatcgtacctaccgcggccc

SEQ ID NO: 20112 - DNA, 35 bp, Artificial Sequence
  Synthetic oligonucleotide
ttagacgccgcacgctcgcctggcccttccctgtc

SEQ ID NO: 20113 - DNA, 36 bp, Artificial Sequence
  Synthetic oligonucleotide
tgatacctgccgctgatcttagcactcaaccgcata

SEQ ID NO: 20114 - DNA, 36 bp, Artificial Sequence
  Synthetic oligonucleotide
tcgccactcaacattcagccaccggatcccttggta

SEQ ID NO: 20115 - DNA, 35 bp, Artificial Sequence
  Synthetic oligonucleotide
attgcgggtggtgggatgggcaggagataaaatcg

SEQ ID NO: 20116 - DNA, 35 bp, Artificial Sequence
  Synthetic oligonucleotide
gtagccaactacccggcagtccatccctgatcgct

SEQ ID NO: 20117 - DNA, 35 bp, Artificial Sequence
  Synthetic oligonucleotide
gatacgaccccgcccccgcactgctgcaaatatct

SEQ ID NO: 20118 - DNA, 33 bp, Artificial Sequence
  Synthetic oligonucleotide
tccgaaactcgactgcccgggatcccacttcaa

SEQ ID NO: 20119 - DNA, 36 bp, Artificial Sequence
  Synthetic oligonucleotide
tcccatgccaccgacggtctatgtctagttacttca

SEQ ID NO: 20120 - DNA, 36 bp, Artificial Sequence
  Synthetic oligonucleotide
tgatcgcaataagggggaatgggggtggtactggga

SEQ ID NO: 20121 - DNA, 38 bp, Artificial Sequence
  Synthetic oligonucleotide
agccagccctccccgggccactatgaacactccgctga

SEQ ID NO: 20122 - DNA, 38 bp, Artificial Sequence
  Synthetic oligonucleotide
ttgctccagcatcgcttgccgcctagtatcctccgtga

SEQ ID NO: 20123 - DNA, 38 bp, Artificial Sequence
  Synthetic oligonucleotide
gttccagcccatctctccataccatcgagccgttgtga

SEQ ID NO: 20124 - DNA, 35 bp, Artificial Sequence
  Synthetic oligonucleotide
gctgccccaaccctattatgtccggttaaccttac

SEQ ID NO: 20125 - DNA, 35 bp, Artificial Sequence
  Synthetic oligonucleotide
gacacacgcgcctagctgttacatcaatccgtatt

SEQ ID NO: 20126 - DNA, 38 bp, Artificial Sequence
  Synthetic oligonucleotide
ggtaaaagccgggaggaggtgaagggcagtatgcgtga

SEQ ID NO: 20127 - DNA, 36 bp, Artificial Sequence
  Synthetic oligonucleotide
ttaccgaccaccgccatgaatccagccacctcctta

SEQ ID NO: 20128 - DNA, 35 bp, Artificial Sequence
  Synthetic oligonucleotide
aggggcacacacccttgcccgctcgatccttatac

SEQ ID NO: 20129 - DNA, 35 bp, Artificial Sequence
  Synthetic oligonucleotide
ttggtagagtccaaggtcgaaaacggggggatggg

SEQ ID NO: 20130 - DNA, 35 bp, Artificial Sequence
  Synthetic oligonucleotide
atcgtagtgcgcggtctcttctcgtttcattcatt

SEQ ID NO: 20131 - DNA, 36 bp, Artificial Sequence
  Synthetic oligonucleotide
tgttgacgtgccacacgtgtcccacaccttccaaca

SEQ ID NO: 20132 - DNA, 36 bp, Artificial Sequence
  Synthetic oligonucleotide
gcccgcacactaaccctggtagcaacgcctgtttca

SEQ ID NO: 20133 - DNA, 38 bp, Artificial Sequence
  Synthetic oligonucleotide
tagtccccggtgcactcccgcatatcagccaccactga

SEQ ID NO: 20134 - DNA, 37 bp, Artificial Sequence
  Synthetic oligonucleotide
gatcacgcatacccatgttacgttcagcattttttga

SEQ ID NO: 20135 - DNA, 36 bp, Artificial Sequence
  Synthetic oligonucleotide
gaacaacgggaggaaggggaggggccaaatgaatta

SEQ ID NO: 20136 - DNA, 35 bp, Artificial Sequence
  Synthetic oligonucleotide
tcagcacactgcccccttacgatgcacgccgcctt

SEQ ID NO: 20137 - DNA, 38 bp, Artificial Sequence
  Synthetic oligonucleotide
ggaacctgtcggtaccacatgcctgccccccccgctga

SEQ ID NO: 20138 - DNA, 38 bp, Artificial Sequence
  Synthetic oligonucleotide
gtcacaccacattcccgtagcccgcccgtgttccgtga

SEQ ID NO: 20139 - DNA, 35 bp, Artificial Sequence
  Synthetic oligonucleotide
atgctccctcgtccactatcagtcaacatacaccc

SEQ ID NO: 20140 - DNA, 35 bp, Artificial Sequence
  Synthetic oligonucleotide
tacctcactttccccccgatgacttagggtcatgc

SEQ ID NO: 20141 - DNA, 35 bp, Artificial Sequence
  Synthetic oligonucleotide
agtgtacgccgttcgtgttttgcccttttttcctt

(The sequence listing continues in the following parts.)

What is claimed is:

1. A plurality of oligonucleotides, wherein each member oligonucleotide comprises a sequence that has at least 95% homology to a sequence listed in any one of SEQ ID NOs: 3062-3081 or SEQ ID NOs: 103062-103081.

2. The plurality of oligonucleotides according to claim 1, wherein each member of the plurality of oligonucleotides comprises a DNA, RNA, 2'-O-methyl, phosphorothioate backbone, PNA, LNA, UNA, or any combination thereof.

3. The plurality of oligonucleotides according to claim 1, wherein each member of the plurality of oligonucleotides is labeled.

4. The plurality of oligonucleotides according to claim 1, wherein each member of the plurality of oligonucleotides is attached to a nanoparticle, liposome, gold, magnetic label, fluorescent label, light emitting particle, radioactive label, biotin, digoxygenin, or polyethylene glycol (PEG).

5. A method comprising:
(a) contacting a sample from a subject with the plurality of oligonucleotides of claim 1;
(b) removing members of the plurality of oligonucleotides that do not bind the sample; and
(c) characterizing a presence or level of a complex formed between the remaining members of the plurality of oligonucleotides and the sample.

6. The method of claim 5, wherein the sample comprises a tissue sample, bodily fluid, cell, cell culture, microvesicle, or any combination thereof.

7. The method of claim 6, wherein the tissue sample comprises fixed tissue.

8. The method of claim 7, wherein the fixed tissue comprises formalin fixed paraffin embedded (FFPE) tissue.

9. The method of claim 6, wherein the bodily fluid comprises peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, fecal matter, hair oil, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, or umbilical cord blood.

10. The method of claim 5, wherein the comprises sequencing, amplification, hybridization, gel electrophoresis, chromatography, or visualization.

11. The method of claim 10, wherein the sequencing comprises next generation sequencing, dye termination sequencing, and/or pyrosequencing of the members of the plurality of oligonucleotides.

12. A method of determining whether breast cancer cells in a subject are likely to be responsive to a treatment comprising anti-HER2 therapy, the method comprising:
(a) obtaining a sample from a subject having breast cancer;
(b) contacting the sample with the plurality of oligonucleotides according to claim 1; and
(c) characterizing a presence or level of a complex formed between the members of the plurality of oligonucleotides and the sample, wherein the presence or level is used to determine whether the breast cancer cells in the subject will be responsive to the anti-HER2 therapy.

13. The method of claim 12, wherein the determining comprises comparing the presence or level or visual analysis to a reference.

14. The method of claim 13, wherein the reference comprises a presence or level determined in a sample from at least one individual without breast cancer.

15. The method of claim 12, wherein the plurality of oligonucleotides further comprises at least one sequence that has at least 95% homology to a sequence listed in SEQ ID NO: 3082-3111 and SEQ ID NO: 103082-103111.

16. The method of claim 12, wherein the plurality of oligonucleotides further comprises at least one sequence that has at least 95% homology to a sequence listed in SEQ ID NO: 3112-3161 and SEQ ID NO: 103112-103161.

17. The method of claim 12, wherein the plurality of oligonucleotides further comprises at least one sequence that has at least 95% homology to a sequence listed in SEQ ID NO: 3162-103061 and SEQ ID NO: 103162-203061.

18. A method of visualizing a sample comprising:
(a) contacting the sample with the plurality of oligonucleotides according to claim 1;

(b) removing the members of the plurality of oligonucleotides that do not bind the sample; and
(c) visualizing the members of the plurality of oligonucleotides that bound to the sample.

19. The method of claim 18, wherein the visualization comprises visualizing a signal linked directly or indirectly to the members of the plurality of oligonucleotides.

20. The method of claim 19, wherein the signal comprises a fluorescent signal or an enzymatic signal.

21. The method of claim 19, wherein the visualization comprises use of light microscopy or fluorescent microscopy.

\* \* \* \* \*

UNITED STATES PATENT AND TRADEMARK OFFICE
CERTIFICATE OF CORRECTION

PATENT NO. : 10,731,166 B2  
APPLICATION NO. : 16/084504  
DATED : August 4, 2020  
INVENTOR(S) : Domenyuk et al.

Page 1 of 1

It is certified that error appears in the above-identified patent and that said Letters Patent is hereby corrected as shown below:

In the Claims

Column 245, Line 62, Claim 9, delete "broncheoalveolar" and insert -- bronchoalveolar --

Column 246, Line 26, Claim 9, delete "blastocyl" and insert -- blastocoel --

Column 246, Line 27, Claim 10, after "the", insert -- characterizing --

Signed and Sealed this
Eighth Day of February, 2022

Drew Hirshfeld
*Performing the Functions and Duties of the*
*Under Secretary of Commerce for Intellectual Property and*
*Director of the United States Patent and Trademark Office*